United States Patent 7,745,391 (HUMAN THROMBOSPONDIN POLYPEPTIDE) - sequence listing, part 253

SEQ ID NO: 721819 - DNA, 588 bp, Homo sapiens
  misc_feature (8)..(8): n is a, c, g, or t
  misc_feature (11)..(11): n is a, c, g, or t
ggcgatgnatncggccaaccgcgccgcgcacctgacgcagcgactgctgacgttctcgcggcgccagccgatcgatccgcagccgttctccgtgaccacgaccctgcaatcgatggccgacctgttccggcgctacaccggcgaaggcgtgtcgctggcgttcgagctcgatgcggacctgtggccggtgcgctgcgaccgcaaccagttcgagaacgcgctgctcaatctggtgatcaatgcccgcgacgccatgccggacggcggaccgttgacggtgtccgcggccaatacttatctggacccggcgttcctgagaccctatccggaggcgcaggcgggcgagttcgtggaggtaggggtgacggatgtgggctgcggcatgacgcccgacgtattggcgcacgctttcgatcccttcttcaccaccaagccgctgggagaaggcaccggcctgggcctgtcgatgatctatgggttcgccaagcaggcgggcggcgtcgtgacgctggaaagccaggtgggggcgggcacgtcggtgcgcatcttcctgccccggcaccagggcacgacggccgatgcggccgc

SEQ ID NO: 721820 - DNA, 223 bp, Homo sapiens
  misc_feature (33)..(33): n is a, c, g, or t
tttaaaggcaggggctattcagggaagcagtgnacatacatgtcaaagggtgctgggacttagtgctgctgaaaagcgtgggtgaatttctctcaataatagctgtggagcctgtggagtcagtgttgtggattggctaggcctcttttcatgcacgcctggggagactgcgttatctttttggcaggtgggtgaaaatgtgagggctcatgccccttcaagg

SEQ ID NO: 721821 - DNA, 176 bp, Homo sapiens
tgtcccattcacaatataacgcactgaccgagatccaatagaggtttctcatgttctctcaccatcttcatatgagttcagtgtctagaggtgcaggcatctgaagtctggtggagtgggtgcagtgatggctcaaagtgtgcaatgctccgagcagaataaagcagtgcgccgtc

SEQ ID NO: 721822 - DNA, 321 bp, Homo sapiens
ctggcggcgcaagacgtgctggcaaatggcggcgcgggtgtttctccattctggctggtaggcagtatcctgatgcttacgctcggcgagctgtgtctgagcccaattggtctggcgaccacgctgttggcaccggaaagaatgcgtggacagatgatgggtctgtggttctgcgccagtgcgctgggtaacctggccgcgggtctgattggtggtcatgtgaaggccgaccagcttgatatgctgccagatctcttcgcgcgctgctcgattgcgctgcttatctgcgccgcggtactgatcgttctcattgtccgattc

SEQ ID NO: 721823 - DNA, 319 bp, Homo sapiens
tctacaggatcccctcagatctgctcagttccatacatattaagtatgtccagtaactgggactcagctcagctcatcattggcgttcagcgcaccccttccatcgtttctgtcagcttataggctatattaccaccgaatgatccacaagcaaggcttgattaagtccagtcgtcccttacgggtcctctcctttgtcgcagcagccttttttctctgctggtccccatatcaggtggtgtcccttatcgccacagtctgaatccgtgagttattgcaaggcatgtactatgaaattggtattgctgtgcatctgaca

SEQ ID NO: 721824 - DNA, 318 bp, Homo sapiens
gcgttacctgatcctgctgccggtcgcgatttcctacgtgggcatcagcaagcgcgccatcgccaaaagcaagaaagacgcgaaccgcgaacatagcttctggcgcctgctgtccaaatttgccagcccgaaagtcgcgccggtttcggtgttcctggcgttgatcgcctttggtggcggcctctggtacagccagaacctgaagattggcgacctggaccaaggcgcaccggaactgcgcccggattcgcgctacaacaaggacaacaacttcatcatcagcaattactccaccagctccgacgtgttggtggtacg

SEQ ID NO: 721825 - DNA, 190 bp, Homo sapiens
tggacccaaggttcagtccctttgctttcaggaccccctgtcctgactctctcctgatggtgggccctttgtgttcttctcttcctgtgggatctctttcctttttgacctggatacgctttggtttttcaacttttctaccccaaagaaaagattattcaataaagtttcctgcctttttgcaaacata

SEQ ID NO: 721826 - DNA, 483 bp, Homo sapiens
  misc_feature (28)..(28): n is a, c, g, or t
  misc_feature (285)..(285): n is a, c, g, or t
  misc_feature (291)..(291): n is a, c, g, or t
  misc_feature (451)..(451): n is a, c, g, or t
aaaaatctgccagccaatacagaagacnacataaaagctgccatcaaccctaggttggaggatggagaccaaaatgggagcctgtaatcatccagtcagccctcaaatcagtttgaggtttaaatatatacttacctacatgtccagaaattaaccaaaactaagtggtcctaggcaatgatactcttaggtgccagagcaacgcaaatagctcaggcactatctcaacccggccatgtgagattcccacgataagccttactcacaaactgatgtacaaacgcncgaggnactaatcaaacagaagaaagagccaacagggtcaacagacataactatctctaaaaatgcagaaaagatggtggtgcatgcctatagtcacagctattcaggaaagcttcagcctgggagttcgaggctgcagtgagctgtgatggcaccactacactcnatcctgggtgacagactgagactctgtcatta

SEQ ID NO: 721827 - DNA, 214 bp, Homo sapiens
tagaggatccctttgctggtgaggtcagctgtatccagacttcagaggcatgtgatcactgaggtcaggagtcgagacagctgacacatgtgaaccgtctctataaaatacaaaatagcagggtggtgggggtgctgaatccagctatcggaggtgaggacgagaatcgttgaaccaggaggggaggttgactgaggcaagatcgtaccgttgc

SEQ ID NO: 721828 - DNA, 133 bp, Homo sapiens
gttcccactgtaaacttagtccatatctctgtatatgtaagtctgaattattctataaaaatcacattaaaaaggtaaaataacttaagtgcaatataacctgatctgtatcttataaatttcaatccataaa

SEQ ID NO: 721829 - DNA, 678 bp, Homo sapiens
agatctttgataagtatcccatgctgcactgacaaagctactaatggtgaatcatacggagtctgcgtctcatcagttcatgtgatggtacagcgttagccattctgtgagcttaagattcaagtgctagcatcctttcactcgactaaattcaatatctgacagtgagatagggtcaaagcatgtcggaggcctgctaatagactgctgccactaggtgagaccaccctctgcacttacaaagagctgtactttacgcaggaccattgatctctgtgcacatagtggtgcacacctgtagggatagcttgcttaagcagctgtggcaggacacttgtacccatacttaacggccacagggagctatgaacagtgccactgactacatcatgcttgagagaagcgttcgcctgtctctgaaacggacagctctcttttttttgccaaaactgtccaggtgttctggagggtttttaagacattgtcacaagtggtaacttaaattgcgccactccagcaatgctaatgttcaccgctttttaaattcattgcattttcttgaggtagtccactgaataactttggaacccgctgacatatgaacggttttgtttacaatttaaggagggatctcaacaccccccttaacgttttccaaaaactgtggaaatgtattac

SEQ ID NO: 721830 - DNA, 202 bp, Homo sapiens
gaggttttcacctagtcacagagcagcacctaccacgtcctcctttccacacctagcaaactctgttacttcggctgaatatttagtgtaattacatctcagctttgaggtctactgtggcaaatttccggattaagaggttccctggttgtgaaaatacatcagataaatcatgagggccactatcatcctccttctgctt

SEQ ID NO: 721831 - DNA, 475 bp, Homo sapiens
agctcagtgaccacgagttcatcgaggaaaaggaaaacagattgctccaattgtgtcagcgaactatggctcttcctgtaggacgaggaatgtttaccttgattttcgtaccatcctagttccaacatgagccattgccatattccatcaattgaatctagactgtggcgtgccccttcctcaggaacacacacagtagacctctaatagctggaaacatcgagtgtgcctccacaatatgacaaggctgggccgagctttcataagtggtagtggctagctggcctagaagatagctcctagcctcccagaatcgactcaggcttggaattgtttacaaataagcccaagacatgctgacgttggccaatgagtatgctggctttctcatggctctgggtttgaatgggcaccttaccaagctggcgactctcaatatccatgactacttgaccaagggccatgaaatgacaag

SEQ ID NO: 721832 - DNA, 591 bp, Homo sapiens
  misc_feature (591)..(591): n is a, c, g, or t
ttttttttgagacccattcttgctcttttgcccttctttgttggagtgcaatgcctctatcttggggcgctgctttctacacctcccggttccttccttttttctttctttttcttcggggacaaagtttttcctttttcccccccccccccggggggcacttgcgttttccgggaccccccgaatcccccccccccgggtgtttaggagttttccccccccccccccttcggccgcagaatccgggggccccccccccccccccccctattttgctctttttgagagagacgccgttttcccccattgccggcccaccccggggggtgttcctcccccccacccccccgggggtccccctttgtgatcccccccccggttcttctttttggggaacctgtggccccctccttcttgaagaaaccccaataaccttttttttcccccccccgaacccccttaatattttccccctcttcccccccggggcgggcgccgctcccctgggaacctccccccccgacctttttggggggcccctcttttatttttctgccccccgctcgcgggcataaacccctggggggcccn

SEQ ID NO: 721833 - DNA, 169 bp, Homo sapiens
tttggggggggggggaaaaaaaaattggccctttttaaaaacggggaaaaaacctggggtaggggggggggtccccctccaaatgtttttttttacaactggggcatgggcctttgggggaggaagttttttttcccctaaggggcccccataaatgtttgttttttta

SEQ ID NO: 721834 - DNA, 458 bp, Homo sapiens
  misc_feature (382)..(382): n is a, c, g, or t
  misc_feature (385)..(385): n is a, c, g, or t
atgtgggtgttctgattttgggttggtggttggttggttggttggttggttttggttttgttgagacagagtttcgtgtatcccaagctggcctcaaacccactgtgtagcagcagatgaccttggacttctaagatcatccgtgtgtgttcctgacagtgtgatgagtgtataggtcagagccctgtccccacagttctccatggagcatcaacctgaattgaggagcgaggaggggaatgtcctgtgctgtacagaacttggggttttgttctaatttcatctctggtttggttttgttttctggctccttccctctctatgtgtgagagaagttttttaaattgtctgaattgtatgctaagtagcttatctccaaganagntgtgtttaactagtgatttttgcagaaaccatgctggatattaggtaaaaaaattaaagggtttagggttttg

SEQ ID NO: 721835 - DNA, 776 bp, Homo sapiens
atgtgtcgtactttcatagcccttattttttgttctgcaataggaaccctttttccctacggacaacatgggttcggtctacaacggcggtgtgttccatttcccgctgcacttgtgtgatcggcccatgtccgcatttgacttgcctgcgtctcctgatgtttcccaaccctcattttctactttggcgcctcaatgggataccccatagtgtcggccaatcgtgtatcgccctttgcttagtgcctttgcgtaatgacaaaagagttttgcgtcagtgcacgtggatgacccttccaagagtgcttgatgaccacgcgtgacactggtgtcgtgtctcccttactcccatcacgtgaccacttcgtcgcaacatgctttgtcacaagaccatcttaaacccaaatggcttattcccaaggaccaggaagattgactccaaacatctctctagtgagcagtccctcacgcagtcgctccctatgtgagttcgtcccactgtgctaagatgacgagcatcttcgttgctgtctcccattcccgtgggtgtcatgagagcgtgtggtacgtgggtcctcaggtccccctgaactccctgtataatctgctataaatgatcgggagtcattcactggcgccgccccacccgcacttatgcactgtgtgagtggtctcagtcagtctcctactctgtctccactctcttccgctctactttagtgttcactctcattgttcgggtctaccctgcacccgtcggtccccttgccagctta

SEQ ID NO: 721836 - DNA, 220 bp, Homo sapiens
  misc_feature (1)..(1): n is a, c, g, or t
nttaagctaatacgtcgggatgctggtgtttagttgcaagagaaacatcgggtcctactgaagcccgcgggccatcatggcacagtggtgcattccccagtagtacttcaatcacgtgcgacaggcccggtccggtttcagttcctgaaagtcccacgtcagactaaagtgttgttacaacgatccgaagtttgcgccacttagtgatcacttaagcgcc

SEQ ID NO: 721837 - DNA, 417 bp, Homo sapiens
ctgaggcagaagaatcgcttgaacccgggaggcggagtgagtagtgagctgagatggcagctgggcaacagattgagtgagactccatttcaagaaaaaaaaagaaagaaagaacttatgttccaacatcgagggttcctggtccatgatggatataactagccaaaacgattactaaaaatattaaaactggtaactgtcacaatctacataacagtccatggtcacagtgtactattctcctcacctatagtatcggactccttgaaaccaatgtgcatttacctggtaatacggtgaggtgacctaaggtggtattgctagaaatcagggagtagcaactagatgacgtgtcatggtgaactctacctgtgtcaaaccagaatcatgtctaggcctgactggttgatcaaatgg

SEQ ID NO: 721838 - DNA, 817 bp, Homo sapiens
gagagaaggcccggaggggttctgcggtctgtagtggcgctgttgggcccgtgcggattgtaagctgctggtttgcggctgggaagagcggcgagagggtcggcatcttcgtcgggatccccgcgaaggatgtagtgcgtgccatgagagtcgtcacccgcatggtgttgaagcgttcatgcctccctcagagacgatctgggatctagcaattgggcaggcagcgagactgtgggtcatgaagagagcaaacacgaaaagttcttgagacttatgcggtgcccgcgaccggaaagaacatactggtcggcttgtcatagggagatcagaaatcaaaatctcacttccgaaccgggggaagaaagacaagaacattactgaagaactgagtctccaatatcagcaaagtatggaccagtacattatcacggaagatatcgggatattgtggacttggttcagtgaggtagaagaccatgatggcgaaggtgatgtggtggagatgatgatgatgacgatgattgattcacgtgatcctgaaaggttccagatgattcctgaaaggcgaattcagaagtcaggaggaagcgaagagtctggttgaagaaactccatgtttgttgaggcccctgattgaagtggagggatccaaaaacaatacagctgtaaaaagcgattataaaatggatgtgtggtaaatacagtggttcataatcccaaaggatatggtatggattaagaagtaagcctatggtacaatgcactggggaggactggtttgagacaagagcttggttttattttaaagggcttatta

SEQ ID NO: 721839 - DNA, 753 bp, Homo sapiens
gagtatctgtgaggtaggtaccattatcccattgtatagaaaagaactctaaataagtgattctagagacggggtctcaccttgtgtctgcccgagtgctagctgatgatcccccatagctcacatgttagcactcgacgctccctgcggctgaggcataacctcgctgcctcagcctctagaatatctggggttactatggcacatgccataatgcgccagtctaatttactagaaatgaatttggataataagaagacaggggtcagccgtatggcacttcccataatggtgctgggagtttacaggggctgtaatgccaactatggcctaagctatggtaaacttgtatatcttaattctctctactcttggtataacttaatgagaacatacggttgtctgcgtcgtggtccgagcgcgtgagctgggagctgcagccgcgaaacaggatcattttggctgcgagtatgcgaagcacatctggataacgttaattggagtcccctagggatgggatttcgattcgtgtggctttaaagactcttctcgcggtagtttaagtcgtttgtggaactatacaatgggggtgaccctaggagtgggggggaagggaaaacttgaagtgggcgagtgaatatgaggaagattttaaaggaaaataacttttaaatctaatttagagggaagttattaattggatagtgggtaaagaagaatttaagaagttcaaagggatttgcgagggaagtg

SEQ ID NO: 721840 - DNA, 1969 bp, Homo sapiens
  misc_feature (1914)..(1914): n is a, c, g, or t
taattattatataatttattgaaaaaaaacccgttctttcttaacaatattcgccattattctccccgactgtgccccagggtggagtgaagggctgtttggcatctggacacactgtggaggggagcccaaaatgtgcctcttgcaggcgcccatagccccgatgtgccacagggactagagcctgtgctatgcatgccaataaacggagtgcctcacaaacctctataaatgtgcccaattgagagaagcgcatatgaggagaccagtgacagccccagagaggagagaggaggagaccaatacaccaaggagagcaagctacaacaaagatcgtcgggctcacacaaggttccccaccacctcggtgcgcgcgtgtgcgcgcccaaagagaactataaaaatcatcactgtgagaacacccccacaatacacgatgcggagaaaccaataaacgcggcgagacatataaagagcgacaaagtggagcatgagcccacagtagacacgcagcgcgagcaacaagaaacagatagagaagacggacagacgaggatccacacaagagcaacagagagagaggcaacacaacaaaacaactggacagacgagaaacaaaccaaccacacagacgagaacaaaacaaacgccacatacaaccacccgcacaatgacgccaaccacacaacctagagagatagaaaacacaccaagcagaagaacaacaaaccaaagagacccaccaacgcacacacaacacccgaaagcaacaagcgacacaaacaaaacacaacaagaccgcgaacaacaacaacacacgcacagaggaacaaccacacaaaacaagactagaaaagcgcacacaaacacatactaatctaaatagaaaacaccaaaccacacaacatcatatacttactacaaacataaataacatccatacatacatacacccacacacacatactacaaaccataaaaaaaatacaatacaatagtattcatatccaacaatcgacaattatacaaacagtctacacaaaaaacaataccaataacattaatcctcgaatcaacagcactgacaataaacaaaatgataatcaaacattatactacgtaacatagaacactatatctacaaaccaatacactacatacacaatctcgccgaatctgataaacaaaaaagacgtacaatatctcgtactcactccacgcaccataatagagagatacaccacccataatccaacatgatagacaaccacgacaacgcacacaacgagaagaatcgacatcgcagtagacctaacatacataccacacagaaatatacgaagtagaaaacacactgatacaagcaccgagaaccagtgcacaaaatgagatacacaacacaacacaacaacaaaaagagaacgaaaatactatacacaataacgcaaagagaaaacagcagtacgacacaagaaagcaagcggaggacacaatacacgtggaaatccaggaacgtccaagaaacgagcacacaccacgagaacaattcgatgagtcaaaagcaacactaacatgagtatgacacaacatcaagacagacaagctggactaacaccacaaatcagacgacgaaactccataccataaaatcaacgaacacaatcaaccacacaaccaaacttatgaaacacacagtacacagtgctacaacacacatgcaaacaaccaagaaacaacatcacacacatctactatagtcactcaatctacaatatatgcaaccctacccaacactacactaacaaaatacacttcacatgtcaccaaaacgttatctcaaattcactacacataatactcaatactatctatcacaactgagaatacacatatacgacatacaaaacaattaancaaacacacaaactacaaacagctccaaaaacaaaatataacatacactcatata

SEQ ID NO: 721841 - DNA, 929 bp, Homo sapiens
  misc_feature (617)..(617): n is a, c, g, or t
ggcgcacggtgcctggcgcaccccactggcctgcgcccaagtgtctggcactccctagtgagatgaacccggtacctcagatggaaatgcagaaatcacccgtcttctgtgtcgctcacgctggagctgtagaccgagctgtcctattggccatctgtggctcctcccctaatgattagttgtagtagcaacctcctgttgatgacactatggtcatccgtgggaggggtcttattaaatgaggtgaacccttgagctgaagatccacggagaaagtacttttcttctcccaggccacctccaggttcaagtgctgtgggacccaataccatttgcattgagactgggtgagcctgactccgtatttcatcacatggcgagacaggtgaaccaaatgtgaaagtggatccagaacaagatttgaaacaagacatgtgggatttcaatccgtgtcacaggcaagcaggaacatagaaattttctgttcgacttaataagaaggagtctaggcgtgacccagaagtggccttcattatctgcagggattgaaaatgaagcagccattgtggagatctccacagatcttgagaatttctggaatggccattatggacttncgtgcacgtggattgatcggaattcaggattgttgcgaagggagggtagcccgtggtaccccgcatttccgaggatattcgtcacgcggacgcatgcacaccaggtcacacatggtttttagttgatgacattttccgatggcggtttggatttaccctacaattcgtgtcaatagggcgctttatcttactttacgcttgccatcaggagtgcccctttcacacgttgcgtgacataccttgttgctctaaacaatctaccttgccaagacctaggctttgcttttccggcaaaacgcacagaagtgacaa

SEQ ID NO: 721842 - DNA, 905 bp, Homo sapiens
  misc_feature (120)..(120): n is a, c, g, or t
gctggtgtcattgattaaccacattctcctagcacaccattgaatccactatggatctaagtgtgtgggggactcttgggtggaagggttctgaatgatctccctcgttcatccctcccngataatcgtgtgaatacttgattctagttgagctattacaccagttgtaacaccttcctcgtgttactgtttgaaaaaacatgaaagtaagatctacatcaatacatccattgttataattatactgctaccacgttgcggcctggaggagaacttgatggtggcgcctgtatagtatcaagtattcagcgaagcttgatttgggtggcatttatccgcatactagcgtgaatgtgcgtgaatccactttggcctgtgtactgtgactgacatatagactgtggatctgtgtgaggccctatgaaattctgcactttacattatatactctaccttcattaattgactttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcgtttatcatcttgtcacaatccacttaaagaagttaggttataatttccagtgacaagattttcttcccagagtagggttataaaacgagggctggggggggtaactttacctacaattagtaagtatggtgcagaatttcatgccaaatgcggagtggcagcagtgttgattatttaaacattatttaaacaaaacaaaaaaatgaatgccccaattgctgatgttagatcccggcgttcttagacccg

SEQ ID NO: 721843 - DNA, 297 bp, Homo sapiens
  misc_feature (72)..(72): n is a, c, g, or t
ccagactcacgaatgactgcgagacgatgcttcaggagtgacattattagtctatctctactcactggacantctatgctgagatagttttaatacgctatgataggagtatatggatctaataattgcattcttgtagctagtgaatatatagtatatgtgtcaggcattatatatcctccttcataaaatggttatttcttttgcccatttatctgttagagtcagtatttttggcattgatttggatgagctctttgttgagaacaaactcagcaactctttaggttgtcattt

SEQ ID NO: 721844 - DNA, 348 bp, Homo sapiens
tatttagttcaggaagaggaatcttgatcttcattccagggtgtcttctgccttcttgcgtgccctcaattcggttctcccagttccatgctgctcagctacacgttctcactcacacacttttgctcacataatacccatattggcctgctgcatctgctgaagctgttatttctaaagatctccagtaataaccacgtagtctgttatgcaaagttcggcaaatacaacgtcaggaccacagcaaggtggctagcagaggtctttcagaggaagagggagggcttcctttgtggagtgctgaccacttctgtttcctgttctcccctcagatcctttatagtcaat

SEQ ID NO: 721845 - DNA, 303 bp, Homo sapiens
ggctgtcaccgcagtggtttcagccggggaacatgcgcctataggagcgatgtgggttgggaccaggagggtcgcaggtcctgatattggtcgggatgtggatggctgtggtcccctggtgatggggcctcttatggcctgtggcttctccccctctccgtggagcgagggagggggagaggggggagtccgggtgccagggtggtgtgtgacatgtgtgggacttggttggtgtccagtgtgatgggggcttgaatggtgcttcgtgatcgcatcgcctgtcctggaatctgaggagatact

SEQ ID NO: 721846 - DNA, 449 bp, Homo sapiens
ctcagttaatccacccaccttggcatcccaaagtgctgagtatacaggtgtgagccaccacgcccatccgtctctgatatttcacataagcccattgctccagctactgtcatggtatgtagattaccttagctgtggcttaaaaataactatcctcagaatttagttgtcaggagaaagcaggacaattaagctgggtcgagattgtggcttgactaacagctgataccatttctcaattgggatcatttggtatatgtccccaagagacacctctgaatagtcagaaggaagaaaattgtgcaatgagttacgacggaatgggatgacagatacagaaacattgtaaacacatttgtcacgtaccctctgactgaaatcctggaaagagagtgctcatatcctcctttccttgaagacagttcttacttattcttacagaaagattt

SEQ ID NO: 721847 - DNA, 123 bp, Homo sapiens
gggccaacccaaaatggactggattggccattcgacttctttcccttcaaagtggcattcatcagaggagtatggggggaaaaatgctcagtctctcccatccttatcctgtgcctcttacta

SEQ ID NO: 721848 - DNA, 688 bp, Homo sapiens
gctctttctcagtgaccgggtggtgtgcttaggtgaggcgcagacggggaagcggagccgacatgccaggtggcccggagctgggttgtcgcaagaacttatgtgagcccgcggagacccttcgagaacatctcgtctcgaccaagagcgtgaagctgatcggcgagtatgggctccggacacaacacgtgaggtctggagggtcaacatttaccctggccaagatcgcgcaatggccgcccgggaatctggtgacgctctgatgagaaggacccacggacgtctgtctcgaaggccagacgccctgttgcgggggcttggtccgctatttgggggttgcttggatgagggccaaggatgaagactggaattagcatctcttggggccgtgaagagtagaggattctcttaggaggagaccgccttgccaggaaccccgagggtccttctggcaagtcgtgggcgcttggagcccaatgtgcctatcacaacccaaggcctcggcagttggttagagtcccggcgcaggcaggccgattattccaaggtggtcccggcaaagacagagtggagtggaacacgatcaccgggtgccttttaatttggtgacagtccttggattgtccccaggaaagacaacagtccgaatttcttcattcggcgacttctccccttacgggggtctggc

SEQ ID NO: 721849 - DNA, 364 bp, Homo sapiens
tgtgccatcatgcccagctaatttttgtatttttggtaaacacagcatatcagcatgttatccaggctgatctcgaactcctgggttcagtctgcctgcctccgcctcccaaagtgttgggaaccaccatgcccacccttattattgctttttagtaagttttttttttttttttttttccatttggttggttggtttggtttttgttttgttttgttttgttttgtttttgagactgagtcctgctctgctgcccagcctggagtacaaagacgttagcactttgggaggccatggcaggaggattgcttgagctcaggagttggagaccagcctgggcaacatagctaaaccctggctctac

SEQ ID NO: 721850 - DNA, 545 bp, Homo sapiens
  misc_feature (111)..(111): n is a, c, g, or t
ccgcagatcctgggaattaaaggctcccccttttgtcccttgtatttagtccctgttccattccaggcgttgttctaagtttggggactcacaaagaagcccctccttcanaaactacaacaagggggttcgcttatccccacctaacaacccgtcaatgtgaaatcttttcctttattaaaacaataatgataatggattggtttatataaccctatgtttagacaagttcaaggcgagcgtgtctttctataaaaagttttgttagtgagggaaattcgtccatggggccctctattaaagcggggaatagggttatgtggatggttcgcctttaataaatgagccgcttgctgaatgtattaacccgcgagcgtggagcaatccgttccctctttgggcgtggggaacccgctcatgtaaaatgcccgcccttaatgaaggagcaaggggtgggaccctttctgtaagtaccgcgtaccccgggtgttaatatcttgtcggggtggtggaataaaaactcccgcccacgtgcagggtttaaa

SEQ ID NO: 721851 - DNA, 709 bp, Homo sapiens
aatgaaaataattaaatggttggaaaatgtctgtctaaataaaggtcacagacactgggcctatttaatgcagaaatatgaaggggcaaacctatccacattcctcaaggatgtgaaaagaaataggcagagagatcattttcttcagtttttcaatggaaaaaaaaatacattcaaaagacgtcttcaccatacaaggaattcgttggtgtcagactggctactgaccaattccaagacaaaccgtacactcaagatagaagttatcctctcggaacactcagacattttttgttttctgcgttccactataattcaattggccaacaattaaagggcagttctcacatttaagacacaaggggggttgggattgcaaaaatggcatatttaaaagataggattactggtaagggttctgcgcctggggttgggttctggtataagcatcccggattaatgcatgtgctggtcagcatgagagtgggaacgccaccaaataagtagctatggtcggggaaacggttgaaatacgagtcttgaattatcaggtggtccagtacgagggtgtgggtgaaaaagcaggacttcccaaattggacctgttggacccatatttgaagtatctggaaccttacaggagataggcaaaaacctttcttcgggacatcttaagtagccttatgaatgatgatatatacaagagaga

SEQ ID NO: 721852 - DNA, 227 bp, Homo sapiens
gcatcgctattgcggtgctttcctgctacgtgatgatatagcaatgtgttttctccccctgctttgcagtggggtattgatctgccatctttttcaagaaccagtttagggccaggcacagtagcttacacctataaccccagcatttcgggaggcagaggtcgcggtgagccgagattgcaccattgcactccggcctgtgcaaaaagagcgaaactccgtctcac

SEQ ID NO: 721853 - DNA, 190 bp, Homo sapiens
aagtaacagcagcatcaccaccacccacaccagtgccaccgagcccttcctaagtggatgggccgaccctgggggcccagcacctggaggcaggcggttcccccacacggcatgtgacccaggagtttgtgagcaggacactgaccaccagcggaacccttagcaccacatggaccaacagttcttccca

SEQ ID NO: 721854 - DNA, 877 bp, Homo sapiens
  misc_feature (307)..(307): n is a, c, g, or t
  misc_feature (487)..(487): n is a, c, g, or t
  misc_feature (749)..(749): n is a, c, g, or t
  misc_feature (856)..(856): n is a, c, g, or t
gcgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccaacgtgaaagggaggaggaaacacctgcttaccaagggcctgggatccctganttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaangcctccaagcagcatcgtcttaaacgctaccacagaccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctcccccaccctctcctccggcccccacccagtgctgcaccgagcccatcctctgtcaccnttccctacagcctgaggagtacatggcctacgttcagaggcaagccgactcaaagcagtatggagataaatcatagaggagctgcaagatctaggcccccaagtgtnggagtgagaccaagtctgggg

SEQ ID NO: 721855 - DNA, 187 bp, Homo sapiens
ggtgatctttgcgagcgtgcttctgtaaatattctatacactttatcctttttgtgagatgccgtttcacgtctgtgctcgcccaggcaggactgcaatggcgcgatctcggctcagcgtgcaatctccgcctcccgagttcaagccgatcctcctgcctcaggctcccgagtagcttggattacag

SEQ ID NO: 721856 - DNA, 195 bp, Homo sapiens
ctggcaccctggtgctggtgcatcgactacggcaggtagggggtgggcagggagggtcgtgaacacatttaggctgcttgggctgctgtgtgccggtgttgcctacactgtaactagcagcatagtgcttaatttgttcacaagaaatgctgcttccctttgaattgttgcgggggtctagaagttgcacttttt

SEQ ID NO: 721857 - DNA, 549 bp, Homo sapiens
  misc_feature (461)..(461): n is a, c, g, or t
ggctgcattcctgcgcacgcccgaatccatgaaaacgggcacccgaaaaccaacactccttaaaatttccactttggggaatttcccaagggttttggggggccccaagggggggccacaaagtggaaaaggcgtttttttttgggaaagggtggtttttttggaaaaaaaattttttgggggcgctttgggggccaaaaaaaacccccggggaaaaatgccctttctcccccgcggggggttttttttttttcaaaagggattttttttaaaaaagagtttggggaaaaaaaaaaaaacccccccccggtgttttgccccccaaaaaaaaaaccccgcccccccatagtgggtgggggggaaaaaaatatttttttggggggggggagaaaaaaaaaaaaaagggcggggttttttttgggggggggggggggaaacacaaaaaaaggaggggggggggnccccccccccccccaaaacccccccttctctttttcttggggtgggggggagaggggggttttcccgcccccccccgggctgtgtgtt

SEQ ID NO: 721858 - DNA, 366 bp, Homo sapiens
tgactgatagcagctccccccactaagcaatggcaggcaccttgacggacagcagctacccactaagcaagggcaggcaccttgactgacagccagccagtgcactaagcaatggcagagcacttgacttatagccagcccataccactaagcaaaggcagggcaccttgacttatagccaggccaacgcgcaacaagcaatggcaggacacctgacttgcagccagcccactcgactaagcaatagtaggacaacttgacttgtagccagctcaacccagcagcaatggcaggataccttgacatggagccagcctacactactagacaatggcagggaaccttaacatacagccagaccatacc

SEQ ID NO: 721859 - DNA, 277 bp, Homo sapiens
ggcgtcgtaccctatcatactattcacccttttctgcctactgatagtgatatctgaaagggttatcaaatcagctctcctctagaaataaataggttggtatctctaaacctggacatcagataacacactacacatgtaacattctgaatgagcagctaattcacgtgctcacaatgtccacagggaccaccacggctcttttacctgggaccttgtacacggacggacggacggacacttcgaccgggtacccgagactcgaacttcgtacatc

SEQ ID NO: 721860 - DNA, 388 bp, Homo sapiens
acgaggaggacaggggcggtgggcgggaggcttgccagcttcaacactcatgcgatcgcctaatgtgtacacatcatgaccaactcatcatcactgtggatattctttgtgttataaagaataaagatgtccatgtgtctgtctagatgatttgcattccatcccggctgaagctgtccgaatgagactatgggctgtgcctccgcctatcatgtagacacctgatagaatgatgatgatgcccagaacgggtcttactaccacaactgacatgagttttgtgatgagtattggatcaaactattggcataggtctacatgatacatggcgcgcaagaagagcataccatcgcattcatgaaccacgagatcttggcatagtgccgct

SEQ ID NO: 721861 - DNA, 337 bp, Homo sapiens
  misc_feature (274)..(274): n is a, c, g, or t
aaacctggaagccttaaggggctcagatttccactatagaaaagaaaacattctggccaggtgcagtggctcatgcctgtaatcccggcactttgggaggcccaggtaggtggatcacctgaggtcaggagtttgagaccagcgtggccaacctggtgaaacctcatctctactaaaaatacaaaaattagcagggcatggtgacgtatgcctgtagtcccaggtactcgggaggctgaggcatgggaatcgcttgaacccaggagatggaggnttgctgtgagccaagatcacaccactgcactccagcctgggcaacagagcgagactccgtctc

SEQ ID NO: 721862 - DNA, 894 bp, Homo sapiens
  misc_feature (134)..(134): n is a, c, g, or t
gtttcctccgccataatcctgtccctattccggcttctccccattgtgtggaccccccgggcgcccgtgtcccccgtcttgtgtggacccaactttgggacccacactcttggagggaattcctccccccccgncgccttgattttggcccaactttcggggtcccctcataagcgccaaagggggtcacccgtccgtaccaagtcccctcaagttcacctgggggcccccccttgtacttcctcgcgggggttgccccctctactaatccctccagtttttccccgccccccctagtccccccccggggttttggccaaaatggccaacctcgggttcaaagctgtttccttccacccccggtttccaatttccgcctggtttcccccccatgttgttggcacccggcccccctccaagcggggggccgccgggtccctcattttccccgtgggccccacaccccttgagagattctgggtcccgacatacccaggacggagagcctccgctgctccctgggatgcttcccctctgtgcgtgtacaccccgcgtggagtgctgggcaccccctctctccccggggcagggtttcccgccacacggtttcctctccgggcttcccttgaagggacggcacaagagtttctgccaccggtgattttcttggtgccccccgtggtctcccgagggggaggctccccagaattgtttcccgggctacttgtgctgctccccccgaaggaccacgccctgggttcatcacccacgggtccacccaaccaattcgtgagccggcattcagcaccccctatccgtcccccccaggcttgagcccccggtccccctcccatttttaaacccaaaaaagggccccgctctccaaacaataac

SEQ ID NO: 721863 - DNA, 845 bp, Homo sapiens
  misc_feature (845)..(845): n is a, c, g, or t
gtttgaaggaactgaggactggatagttgcaaacaaagatctgattgacaagaggaagtgcaccatcacaggtctgccaacagatgcaaagatcttgtgcgtgtgaaggctgtgaagtgctagcgtggtgccagctgagctcgcaagatactattctcagccgcattctcgtgaaggaaatcagtagagaacctccagagattcgcatcccaagacagcctgaaagcagatctatatccgctagagatgggaggaggctgtcaatctggttataccctttccagggaaaaccaagaccagaattcacttggaagaaggatggtgctagaaattgagtgaagaatcaagattaccactattcgccaactctgagagctgatgcaatcatattatattaagaaaagcagagaggagccatctctgggaagatatgatctgccaagtcaaagtggacaaatttcgtggtagaccgcgatcacttgacatccagatcattgagcgtgcgggtccaccccaaattggggaagattgaggatgtccggggagacaatgttcgtgtcacgtgggactcaccatggctgtggcatgctggttcccggctttaccatcagagggtggcaggagacctggagggtcgccttgggctttcttgaaccgggcccatggtggtgggctggggggattctccggcttctggacaggtggcccggggggccggttgagggttggccggggggagccaaacggtgtgaggtcgcggcttcccggtgcctctgggtgccccgcggggcaccagcaagtgtgtacaaggtgtgcccgcgccgttgtcggtgttgctccttggn

SEQ ID NO: 721864 - DNA, 148 bp, Homo sapiens
tgtgccagctgcttcagtggccggtgtgcaggtgcaccaatacagggctgccactaagatgatattttcatggagctgtctggggaaggagtagattcaagttaaagtgctcttaggcattcagtgtagacagagttctacagtcatg

SEQ ID NO: 721865 - DNA, 356 bp, Homo sapiens
gggcatcttgcccatgaatgcattcatggatcgtggccagcatagagtttgaatagcaaatccttggacacgggcgcttctgtttcatgcacgatccgcagaacatgtgtacgcgggtccagtccttaacatgtttggccgagttcgatctttcccttaatgagcagaggctcaaccactgtggggtgcacagtaatgtccacatgatattggtgcacagtgcagggctcctctcgagccctggcgcggtagagctcgcgcgccctaaggttggccgcgttcatgggcagactgaaaatgggcctcgccaaggtgctcgcggtagaagtagcatgcagtgcctcgctctgcgccat

SEQ ID NO: 721866 - DNA, 226 bp, Homo sapiens
gtgggtgaccgtggcttgtgggttgaccgtggcttgtgggttgaccgtggcttgtgggttgaccgtggcttgtgggtgggccagatagagaataaagcggctgcccgagtcagcgttggcaacccgctccagtccccctccacactgtggaagctttgttctttcgctctttgcaataaatcttgctattgctcactctttgggtccacactgcttttatgagctg

SEQ ID NO: 721867 - DNA, 291 bp, Homo sapiens
gcacaaataaacctagagcccggagacaggaaggacatataaaagattagatgagaataaatgaaatagagtgaagaaaagtagagacacatcaatgcaaccaaagagttgattctatcaaaagatcagtaaaactagacacaccctctgctagactgaccaggaaacaaggagactcaacattactaaaatcagaacatgccggagggaacatttcaactcgcacttggagaaataaaacagattatgacggcatattatgaataactacatgtcactaaattatccatg

SEQ ID NO: 721868 - DNA, 1265 bp, Homo sapiens
gcttggaggagtttgtcctccagtctggagctgtctgggatatagtcccgaagacctgactgctgcctatggcagcatcttggaagccattatagcccatgggcttgtttccgtgtgattcgacaacggaggatctgcgcatacggttctcggacttggaaataggcaggtggtcggtgcgcaccaagcacattcgcaagattgcgatccaggccctcctgtgagcagcatcagagtgctggagagtcggtggccaacacgtgcgcgcctggatagccatgggctctgcctggaccttggatcactgacactccgtgacggactgaaagacagcagaagacgccgagcatccagagagaagaacacccaggccagacaccactggaggggtcttccagtgaggacagacccccacgaagggcaggcacctccttctcacagaaacccggggacaccaagaggcgcgccagacatgggccagtgagaatggggagaccgaagccgagggcaaccagatgaccccatgcaagaggacagagctcccaggactcaaatctggaccacagcctatggagcccggctgctgaagaatggggcaggaagccacaggacccatctcacagaacccagactctcgaagacaaccgcctgcaacgggagccagccaaaggaacgaccaagaagggttgtcaagagaagttcaagataccacagggaccaagaagcacgagctgcagccggaccaaggcggcagacatacccagagggggatcattgaagaacccccagaaggttacacacgaagaagaccacgcgaagcttgacaaccatctccccagggcagccaaggggacaaggggacctgtaaaagttgacaggataacaaccagaccagacacagaagcgaacgaggcagtgaaacactgggacacatcctaggcctgcgaaggggaatgaaggaaggcacacgaggctaccaaaatatgaaccacacgagtgtacagcacgtaggtaacacgattaaggaacaaaaaaggagagtcgagaacaacactacctacggaacaaccaaagatgcgatataccagtgatacagaacaacgatgaaatcagggagtagaagataactaacaggggagaaagaaaagagaaaaccaactaaagcagtggaaaagaaagaaagcaagagaagatcagagacaaggagaagacgagatgaacagtaggtacgagacacaaacaactgaaacagccgatcctagagg

SEQ ID NO: 721869 - DNA, 843 bp, Homo sapiens
  misc_feature (2)..(2): n is a, c, g, or t
  misc_feature (103)..(103): n is a, c, g, or t
  misc_feature (114)..(114): n is a, c, g, or t
  misc_feature (119)..(119): n is a, c, g, or t
  misc_feature (164)..(164): n is a, c, g, or t
  misc_feature (175)..(175): n is a, c, g, or t
  misc_feature (197)..(197): n is a, c, g, or t
  misc_feature (242)..(242): n is a, c, g, or t
  misc_feature (281)..(281): n is a, c, g, or t
  misc_feature (361)..(361): n is a, c, g, or t
  misc_feature (387)..(387): n is a, c, g, or t
  misc_feature (392)..(394): n is a, c, g, or t
  misc_feature (506)..(506): n is a, c, g, or t
  misc_feature (514)..(514): n is a, c, g, or t
  misc_feature (528)..(529): n is a, c, g, or t
  misc_feature (572)..(572): n is a, c, g, or t
  misc_feature (600)..(600): n is a, c, g, or t
  misc_feature (700)..(700): n is a, c, g, or t
  misc_feature (794)..(794): n is a, c, g, or t
  misc_feature (800)..(800): n is a, c, g, or t
tntttttgcatgctgtttgtatttgtgtttttactggtgagacactagttgttcagggcctggctttggttcaccccctttagtgctttcccacacttcactnaaccctctccntttcntcgctgctaatagtctttttattttaaagcaattcctggaactgntttaggggctnaccatggttgctgggtgtcccncctcagataggaatgctgctgggcgattgttttatagtcttgttntcacaggccggactaccaggtggcccattactccagttnaccttctctactggctttgctgacctgctaccctacccctcacattgtttgccttgcccagcctgtgtacactctacttntgctgtcagttctcgtactttgcctnataannnagtccttcctgttcttttataggtggggtctgtctggggattctctctctctctctctctctgtgctctctctatctctctttctcgtgctcgttctgcctcccttatggcnggacggtngctccggtgaagcnntgagaaaactcttttggcctcatgtcaatgttctattgcattnagagcccaagaacccatggtcagttganacgggcatggcagtttcaactcgattttcctgtcacacgtttaacagtggtttcaaatttatatccagtgtgttttcaatatacccaaacatttaactgnagcttttggtagatgtatagttcttttttttttctttctttccccaagatggagtctgctctgttgctcaggctggagtgttgcagtgagctgngatcgngccacttcactccaacctgagcaacagagcaagatcctgtctc

SEQ ID NO: 721870 - DNA, 478 bp, Homo sapiens
  misc_feature (443)..(443): n is a, c, g, or t
  misc_feature (459)..(459): n is a, c, g, or t
  misc_feature (468)..(468): n is a, c, g, or t
attcggcacaggggttattttaaaaaataaacgtatttcgggataattttaggtttacagaaaagttgcaaagtgagcgcagagggtcccttctgccactccgcagcctcccctctgtaacttcaaagcccacaggattggctgttgtagctgagaaaccgtcgctgggtgtccctgtgaactccggactttgaatttcactatcaatgtcctgtttctgctctaggaccttgtccccgctgccacctgtgggagacagcctcccgtgcaccatttgcccagcaccctcaggcctgtgacggtctctcagtctttccttgtcttccatgccctgcagttctgagagggcctggccaggcaagtttgtccaggtgccccgatccaggcttgtcttgtgctttctcgtgggggtggacgacaggtttcagggagggggtgctgcngcctgtctcaccccantgttggcgntccctgacat

SEQ ID NO: 721871 - DNA, 162 bp, Homo sapiens
tacgatgtcaccgaggggttatgtgcccaccactactatttgatctagcaaaatgtctcagaactattattagcactagggcttggatatcaaggactctcatacatttaactcagtacccactcaaggccttacacaaggggacccagcacattcgaccca

SEQ ID NO: 721872 - DNA, 1229 bp, Homo sapiens
tctctggtatgccaaatatttaatataaatcttggaaacaagtccagatgaaataaaattcaaagttggcaaaaccgtgaaaatatacctaaatggtcaaatattcctcatggccccaaatcagtaatttttttaattcctaatgcacaagagttatgccttcaaacggcttaaatgactatttgatatgatcacacaaaccagtttccaaatagtaaagccagtcatctggcaattggtagggacaatgggtaacaagattatagagacaccttacacacacacacacaacacacacaccgcgtgtgtgccgcccaattgacaaaaaacattgtgggcctctcctaaaataagaagctgtgaagaccctataatggctgccgagggagggcacccctgggtgtcccccctccataagattccgaggtagttccctatgaacccaatagcaattgcggggcatattggacggagggagtgactctgaacagccaggttgtgacactccgtggtgcgggaacccttatcatgtaccccccatgtggttgcccctgaaaaaatgttgccaatatattttggcgccccccatattgcttgcgcgcgtgtctctttccaacattccctcaataataagacaccaaaaacccgggttgccccttggggtgggggcatccgcattggctggaacagacgcaacgtcataggtcacaccgtttggagacgtcagaaaaagggacataacccaatgtggcctgggtgggccattggctaaaccccgaagaatgtcattctttgcccccgtgaactgcggttctaaaccggaggtgctcacccccaatctccaaaaaatattcgtccggggggggcaataaagagaaacccggggcggcaaaactaataaacacgacgcgagtgttgggagtatgcctcgtatcaccccctggtccacatggtgggcggcagagagttacatatcacaggccgcaaaccccgacccagaagccgcgcagaggagagactaccggcaaaaaaacacagacggtggtgcctaacacgggagtcacaaagcaagggggccccaaaaaaaagcgcgcgccacaaccgaggaccggcccccgagagaggggaaccccacaagggcgaggagaggcacaccaactgccccgacaacgagctgacaagccacccagcaggggcccaagtgccgaccagcacactataaaacagag

SEQ ID NO: 721873 - DNA, 671 bp, Homo sapiens
  misc_feature (671)..(671): n is a, c, g, or t
tagaatattggtgaactttatactggttagaatcactgtccattaaatgatcactagctacgggtcactaaatttacaaattagggaaattatatataaaatactgcaaaaacacagtaaaaagactagaagttcgcccatttctggctcaggaagtctcttcactcctaagcttacatatggttggtcctctctgggcttcaaaatttctggctattattactggtgtttaccctccttttggatcttccttttggtcccccagtgccagaacttccagagccttctacgctccagatggccatctttttggtgtatgccatttcggaacagtcttcaatggatcgcctggtctggaaagagaggatgagctggcctggtgctcaattattttctccctggtgcacgctggtcttttctaagccaggagctccctcatttgggaaatctcttctttcagctggtggcactcatcagcaggtaatgggccctgtgaattctcccatctgggtatctcggtgtcgtgaatgattccttcagcctaatattaacggcttcaactcgttccttcttatcgccaggtcttcttcagacatatttactcggcaatttttaaccattttttcaatatcatcttgggttaatccaccagaagactggtttaacaactn

SEQ ID NO: 721874 - DNA, 208 bp, Homo sapiens
ggctgaggcaggagaattgcctgaacctgggaggtggaggttagcggtgagctgagatatgagccattgcactccagcctgggcaacaagagtggaaccctgtctcaaaaaaaagaaaagaaaagaaaagaaaatagcgccaagtccattttcaaagtggttgtaccagtgtacctatcccaccaccatgtatgagtgttacagtcgt

SEQ ID NO: 721875 - DNA, 103 bp, Homo sapiens
  misc_feature (25)..(25): n is a, c, g, or t
tgctgggattacaggtgtgaaccancacacccagcccacttctgccatattctgttggccagtgtgacaaggattgctactgtcctacccaccctcctttcac

SEQ ID NO: 721876 - DNA, 592 bp, Homo sapiens
tccattttttattaattgaagcacagtgaaaagaggcaaaatgttttatgaagtttatgttttttagacagggtgttggctgttcaccaacggaaaagaaaaacagaggaatgagctctcgatctttattatctttctcttattctcatgcgaggctgagaggcttttaaatgtgatgttataagcctaaggcaggttgacttgcatcaacaagggttttaccctgctcggcagagcaggtatacttatcgacaggcttgcaggacttttatacaaaagctgcgaaatcattcataacagctttctggtgctctctagatgccttgggcttgtgtttcacaagctcaacaagtgcagtttggcacatgagttgtctctccttctcagaaagtgtgcatatatctgcatggaaggtgaatgtttcagcattaaactcttttggaacggatgtttcatcgactttgacacctgaaaagtatggttcgctgttcaccaaggattgtgtgaagcatttgctgactctgggacttactggacgttgttgagacgaaaaactggagggcggggggtccaataactcctagaaggttgg

SEQ ID NO: 721877 - DNA, 225 bp, Homo sapiens
ccgggggcccccctttttttaaggtttttaaaaaagccaaacccggttttgggaagcaaggtttcctcggggccccaaggctttaacccccccccccttccagaattttttgggcggggcaaaacctggggaaaaaatttttttaaaaaattttgggggaaagggattttttttttaaattttccaaaagcctttcctttccaaaaaaggttttttttgggccca

SEQ ID NO: 721878 - DNA, 341 bp, Homo sapiens
  misc_feature (37)..(37): n is a, c, g, or t
gaaaagccaaccccggggccctttttttgaacccccnctgggaaaaagggggttaggtaacacccaaaccgggctttcaggtggggggggcccccccccccctttgggaaaagttccggtttttgtagggcaagcaaaaaccaagcccggttggggttatggaaaagttaaaaatttttttgtcccccctaagtttaaaatggtaagaaaaacgattttaaagaaaacttttcaaaattcccgttgggggaaaaatttcaaaaaccccttttttctttacaccctaaaacgcccttttcccagggttttgtcaaaaaaacccaaaaaagtgggttttttta

SEQ ID NO: 721879 - DNA, 1439 bp, Homo sapiens
ccacgcgatcggatcaagcctcagatgacttgacaccataaagccacagacaaggtactatgggggggagggcagggaacatttacatacttttactagtggattcttaagaacatactaacacttgagtattagcaactaattacaggaaccataacgtgcgaccacatatatcttaaacattactgaagttaaaactatggcttctaagtccttatccaaactcagtcatccaaactagtttatagcattacttccaggttggactattcttgtaatcttttaaatctcgcgctaaacggtggcattaactgtagatagttgctgatttctgttgtaaacccaaacacgtataactacagtagtacgctaactaaactattatactactagtagtatagattaagacccccatgcccccatctatcttatacctacactaagtcacatgcagacccgcggtaacactccagtgacacaccaaacgcgtgctctgaacaccatagctatacccaggcaacggctaaactctatcaatcacgactgttatgccactctacgcactccactagacaaaactggccccctgcgactaccgctgcaccacacacacaccgcgcatcagccagccaccacctacgaccccacacacacggccacaacagtcaaacacccacccacaccaccaactacccagcatcactgcggcggtacctcaccccactaccaacactccaccacacagacacaacacacaaccggtcactaacaccggcacaactgcgaccaccaacccaacaacccgaacccaccatacacatcctaccccaaacaacacaacactcacagacacaccacccgccccacatcacacaagcgaaagacacacatcgcgtccagcacgcggcactcacatcactcagcctacacgaacaaactcgcccctcacgagcaacgccacccccggcggcaacaaacacgaaaccaacggacgaaaccaaaggcccgatcgccaacattaacactctcaccttgagcaaaccaagaaaacaagggagcagcacacatgcgacaacagaacaaacaagagacaccgcccagcacaaacacaatggccacaacagacactacgagcacaaacgcataacaacaggaggcacagatagaggccaacaataatgacaacacagaagacaacgatgaacaaaacagaagcacccacagcaacaaccacacaagaccaggcaacccagagaaccaaacgcatcacaacacagccacaacaaacgcaactagacaacacagcaatcccgcacacaacgccgaaagactaggaaacgcgaacacacagcacacaatcaacaacacacacacacaaccatagcacacaaccgcaacacaagacacgaaatcgaaccaaagaaaacagacaacgaaga

SEQ ID NO: 721880 - DNA, 980 bp, Homo sapiens
gagaggtgagacgtcgcgcccgggagtccgccggctgcgccaggatggagtcggtgaaatgccttggccacccacctgaagtaagttcatacaaactggtgcgcttccggatcgcgggcaagcgaaatgtgaagcccaaagatgcgagcaggacctcggtcagaagcgagcctggaaaagttgcgtaaaagatatcgtcaaactcagaacccaggtcgcccaatctgcggcacgcctgttgatccaggcgctggcatgcggggagaatgcactatggcacgggtggcattattttcatcttggttcttcccgagctctgggaccacaactggggaaggatgagatggaccaatcaagtgtggagaacagaaggtcccactggttgagccagagatttacatctggtccttggatcagtcgcaggactgggggtgttcatggagagcaaagggggaaggatcgcaggggtggcgtgtgaaggagcttgcccataagagtctcacccttgaggtttagaagatctgggtgagaaatacagagaacagtgatggggcggactagtttgccggtatcaatgggggatgggattggaagagtttttgggtaaggcatgtgacctcgtgaaacgggaagtgggacgaaggtatggtaatagtgtggctgggagtgggccggaactgggacttttcccgcctgtttttcaggccctcagaaggttggacgacccgctcagtgggtgaaggaattaaagaccgtgccactgcgcagggggcgggtacctgcgaaaagcaggctcgggaccatttggagagcccggggccaaaaaagttgcagccacacctgaggcgcgtctcaaaagatggggatgcccacgagaatgcttccgaacgaaaaaataaagttggggcccaggtaaatatgggaaacggggatcagcagagcaagggcgtaacacaggagggacaggtcaaacaaaagaa

SEQ ID NO: 721881 - DNA, 942 bp, Homo sapiens
attccaataaagcacgtttccatagcatgttgcagatttcacatgcaagtatgtgggtttactgaatgaatttagagcacactgaaagtagttttaccaggaagtgcagagctgttctggttgacttaggtattacaggcagacagctccaaccagccagacaacaagcgacaagaatcgatacataaatatcgttgcctatgatcatagccagggttaaagcgtagccacagcttgctgaaataggatgtgcaatagcgtgactgattgatatcaatgccaattatgttgagtggctacatacatgaccaattagcttatattgcgtgcccaaggccctactgaatttccacagttctgaagatttctggagaatgatatgggaacataatgtggaaggttattgtcatgagtaactaaaccatcgtggagtaaaggaatggataaaatgttatcaggtactgggcctgccgagtgggagtgaggagtacgggtaactttctggtcagtcagaagagtgtgcaatgtgtcttgcctattatactgtgaggaattttactctatagaaacaccaaatgtaaagaagggctccctgataggaagatccggtggacgtgatggactgcgcagtatcacgtacacgcaggtggcctgccttgggtagttgccgtagttatcccttgcctgttgctgtcctttgtgagagggtgcctatgccaggctgctgccgtggggcctgtgttcgccactgctgtgctgggttgggagaaccggccttttttgtgcctaacagtttgtgggggatccagacgaggggctgtcaccagtttgggtcttgagactcggccctgaatttttgggcaccgggggcatgtgttctcctgaagggtggcggttcaatcggggcgtgggtttccctgttggcgcctttggagggcagaa

SEQ ID NO: 721882 - DNA, 188 bp, Homo sapiens
gctcttatactcctggatgaatgcagtaaggtggtcctagataatatccatgggggttccttaagaatatttatcaacatatttcagtcccgcaaaggcctccagtaccactatttgggtctttttaaagggctttccgattatttttggctcacaccttttgggcaaatttgaagttcacaaaaagg

SEQ ID NO: 721883 - DNA, 1384 bp, Homo sapiens
tctgttgtggatgtcctttgtttcgcttgttttggttctcttcttggtgggcggttgtcttccactcgttggtaggcgctggttcttaattcttgtgggatctgtcttttatagtggtttcgctttgttgtgcgctctcggttttctagtttgggatgttttccgggttttattttttctcggttcccctgtggttatttttctcgtgtcatcttgggtgattccttggtcatgtcccttttttcacgggtctccccacggggggtttttttctggtgtctcttcttgtcgccccgggtgtcttcgggggggcttttgctgcgatgtgttttccctgctctctttgtcgtggagttcctccgtgtttttgggggggattgtatttttttcatcctggggtggttcttctccctgaaggggggggttctcctcgaggcgccgctgtgtttcgtagaatgttcttctttcgatactgcgcttcttgtgcgtctaaaatgtgcgccaacacccaagattgtggttctcctttgttccctagtgtgttttttttactaggcgcgtctacatttgtgtggctccccggcgcccaaatatggtgtggggggcgcgtcacataggggggtttctacatatgctgtgtcggggggagaatctttaaatattccttttttcttcttccgtgaaccctgtggtttttgggcgcgctggtgcaccgggggcacagagtctcaaagaatttggggtgcccccactgtgcgcagaattttgatagcgggttttggccacacgaatctcaaccctggtctcctcacgagaattgtaaaggggaatctgggccacctcaagaggtttaaattttttccgcgccacgcggaatttccgaaaactccctctggccccacataagacattgttggggcacagggcaaaacccttttggtgtcacacccgtttgtggaacaccacagagagcccttccccttgggggtgcacagctctacggcgaccggttcgagaggccccccggcccacacacactttcacaggggtgccctcggtgatagtgtataggcgcgtccccctccccctgggagagtgtttgtgtccgccgtttccttagaaaatgttgtacacgacgagatcccaggcgttccctgggagaccctcttgtgggcacgagctttaggcttgtgtcagacttgggtaaatgggccccacattcatcttgttttttttgccctccacacttttccacccacacatgttgtagagagcaagggagaccccgggtcaattccggggggggcccccgggcgagaaacccccgggggtttggtggctccacaaaaaaaaagacccccgggaccccaggaggaaaaaaaaa

SEQ ID NO: 721884 - DNA, 828 bp, Homo sapiens
tgggaaacagtttggctcttgtattccccggttggattgcaggggttgatctcaattctaaattcattgtaacctcggcctccgggatactcttggcttcagcctctggggtagctggggattaacaagcacccaaccaacgcccagttaattttggtatttccggtagagaaggggtatttcaccatgttggcgccaggttgggtcttgaactcttgacctcaggtgatcctcttggatatggggctcccaaagtgcttgggaatctccaggctttgagccattgcgcccagtctacacactatttctggttagcccaacagttggtcggttcatatttacccctcattttcacgctcagggagtcatacctagaatagttacacacaagagggaactgggaacgccaaacatttggtacagtatggtgtaagaaggtcacctccatactcctttaatttcacatgagtgctgatgtgtttggcagatgagcttaacgttgaggctgtgggaattgggatacgtggaaaagactttaccggtatttagggaggttatatctaagttctggaaaattggtcacttgcttgggttggcactattttttttaaatttatattttgtcaaggtaatcacaggtgtgcaatattgcaagagtgggtaaaattttatttttcagaggttgattgggagacattttgtttaaccccagtcctgagaggggagacacttggaagagttggacagttaaggttgggagaaaggtattgggacttggaagaaaagataaagggtatgcgcaaaaaggggtgccaaaatagtgaaggg

SEQ ID NO: 721885 - DNA, 118 bp, Homo sapiens
ttgtacgttttcaattcatcatcagtgttatgtcagcagcatttgcattgagcagctaatgttctgaactttacttactaattttcagtgtccttaagcggatcagcggtaccgagct

SEQ ID NO: 721886 - DNA, 135 bp, Homo sapiens
acccggattttgtggtctgggcttgtatgtcccacttctctgcgaaagctttccaggtattcaaagaaacttgggtatagtcatctaagtttttggtcactgcagccatagctgcattagggggcacccaagaag

SEQ ID NO: 721887 - DNA, 754 bp, Homo sapiens
gaaggcaagaggaagcaagggaaggaggaacgaaaaacgaaacgaggagactgaaacgggggacgaaaacgactacgacacgacaaaactaacttgaacgggagaactcagaaaaataaagagaagaaacggacaagacaactacaacgagagaaacgagaacagaacgaaagacgcaaaagaacacaagaacagaaacgagagggagaaagagagggacgaaagggacgcgaaaaacaattgtataaagtagggagggaaggcgagaggaagcaagggaaggacggaagaaaacgaacagaggagatgaacagggggagaaaagatacgaacgaaaaatacacttgaagggacgaactcagaacacacataaagagaagacaaggacaccgacaactccacgagagaaaagagaaacgaaggaccagagcaacaagaacacaagaacagacaagagagggcagaacagagacgggcgaccagggagagaacaaaaattgtataacagtagggaggggaacggcgacgagggccgcaagggaacggcaggaagcacaaacgaaacgaggagatgaaccggggggacgaaaaaacgattcagccccggaccaacttcaccttggacacgggaaggaatcccagcaaccaattaacagggaggacacgacccaggaaccagcacatttctcaaggagaagcaacagagaacaagacgcacaagcagcaacccagaaccacaaggcacgacacccgg

SEQ ID NO: 721888 - DNA, 136 bp, Homo sapiens
ggtctctggttgacaaacatatgttgctgtagagttcaggggagacgtgcgtcatatcttgttcctagtgttgaaagtagtggtgagggtgtttattataataatgtttgtgtattcggctatacgtgtccggcca

SEQ ID NO: 721889 - DNA, 1065 bp, Homo sapiens
gacttgcccaagccactgctgttggagcttcccaggaaaaaaaaaaaaaataaaaaaaaaaaaaaaaaaaacacccatttttcccaaccttttatttggaacttaggataaattcccggtgttaccagaattttccggaaaaagggtaccactggtcggacaaataaattttgacacaagtgcacagaaacacaaagggggtgtgtttaagaatgcttttactcacaaaggccaggaggggcaaatcccctatattgccttctttagattggcccccactccagtgcctcttattgcggggttgttgccccgctgtcgtgtgcacgtgcggcacaattaaaagcgctatttctgtggaaacctgttgtccacacaattctcgtgacaacgccttacctttgagagaatgtgcgccacaaaccccgtggcgggaacaaccaccacctggcgcaagttgtttctcacccccaattgtactgcaccaatctctttacaacactatgtgtctaactcacaccggagacaatttccgcacaaccgtgtagcgagcttactccgtatcggggtagttctaagtggccatcatattctcatgacgccacaggcagagtgggcgagagaaaacgagggttcttccatcctctcaaacacaaaagtgggagcgggccctcccattacgaaacaaatcatctccgctcctcatcagtggcgggggacatcttatcccacaccagaaacacgcaacccccaaacgctttgtgtgtgcgccaaccgaaacgtggttcttgtcgcgacacagacccggttcgtggtgggatcaccccaacatacactagctgcacgcgagacagccaaatgaagttatcctgctaacctacattttgagtgcggcgcaccagtaggaactcggagacactatcaacgcagcgtgttcaacccacacccttcacaccactgagcgaccagcagatgtcgcacacagttgttgtcctcatgtccacaaatcaccgtccgggttggagcacaccaaacatttgttgcccccgggcaacaacccacagcaaa

SEQ ID NO: 721890 - DNA, 156 bp, Homo sapiens
cacgaggggaagctgagaagcgggcccctgacatcagagaagaaaaaacttcctgtcagtatcaggtacaaactgagagacaattgatacaaacagaatttgatcagcttataatcatcctaaataatgaggagcagagagagctgcaaagattgg

SEQ ID NO: 721891 - DNA, 273 bp, Homo sapiens
ccctccatgaaattcaagacaaagaagaaaaaaacctcaatgttattggacctaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttat

SEQ ID NO: 721892 - DNA, 768 bp, Homo sapiens
tttgtctgggcagggcgctcactgttgcggcgtctactaaagattgccgaagccagaaagatgtgagtttctattcaatagatttgaggccactcatctcctgaggctacattgtcaagtagtaactgagatgcagcttcaaccaaagaacttgaccatatgttatttgcaccagatgttcacaaacaaattcaagcctggtgagacctgcatgcagtccgacctattgaaaagtctctaacacatagagtctgttgactataaacaccgacgtggtgtgaaatccgagatcgagccactgtcctgtagaaggactgccaaagactcctttggcaccaatagatggggactgttgaaaactgaagttgaaggtgacctaaaccgctccacatgcctttaatcagtgggacggggtttcagtgtttcgaaggccatcttttaaaaagagattacttccgcgggcgacttaaacacccttgaaattcatcacgcacaaagctattgcttcatgtcaagcttggttaacccattgcctatccgcccctaatagtggcagattaattggaagtggccggattaacaacgtggagaagggggaaccccgagtggaacaccgtaaacacattgccggaatgccacttatagaatgtggagtattggaaatagaccttacaactcctcttcaacaaatagaaaccttaaacccaaatggaaatgtaaaattaatatttttgttccccggactttgatttccactatttacttggg

SEQ ID NO: 721893 - DNA, 123 bp, Homo sapiens
ccacaatgaataccacttcacacccactaggatggctataatttaaaacaatggacaatggcaaaagttggcaaggctaggacgaaatcagaacattcatatgttgcatgataggagggggga

SEQ ID NO: 721894 - DNA, 920 bp, Homo sapiens
agcggctctttcctttcgctgctgcgagccgcagacatgagtatgctcaggcttcagaagaaggctacgcctctagtgtcctaccgctgtggcacgaagaaggtctaggttagactcccaatgagaccaagtagaaatcgctcaatgccagactcgccgtcagtcagatccggaagtctcatcatgagatgggctgatcatccgcaagcctgtgacggtccattcccgggctcgatgccggaaaaacatgcttggttccgcctgtgacatgggcatggtcacatgggcataggtaagcggaagggtatcagcgctaaatgcccagaatgtccagagaaaggtcatatggatcgaggagaattgacgtgatatctgcagtccggctcgctcaggaagataccgtgaatcttacgaagatcgatcgccatcatgtagtcacagggctgtacctgaaggtagaacgggtgacatgtgttccaaaaacaagcggattctcatggaacacatccacaagctgaaggcatgacaatgccctgcaatgaagtctcctggttgaccaggctgaggtcccgcaggtctaagaccaaggaagtcacgcaagtcgccgtgaagagcgcctctaggtcaagaaggaggatgactcatcaagactttatccgaggaggaaagacgatcaagaactattcactccacttttgtctgttcatactgtccttctgtgattacgtagatgaggcattaaatgaaaacaagcttaatctgggcatgcagaggtgctgtgtcttccatgcatggatcgcgggcaaaggggcttaatgctacaaggggggccccggttcaaccttgtgtgcctaaaaggaggtcaattccagttgggaacacacggcaaacggttccggtttccatggtaccggtgagtc

SEQ ID NO: 721895 - DNA, 530 bp, Homo sapiens
  misc_feature (54)..(54): n is a, c, g, or t
  misc_feature (67)..(67): n is a, c, g, or t
  misc_feature (76)..(76): n is a, c, g, or t
  misc_feature (96)..(97): n is a, c, g, or t
  misc_feature (131)..(131): n is a, c, g, or t
  misc_feature (137)..(137): n is a, c, g, or t
  misc_feature (245)..(245): n is a, c, g, or t
  misc_feature (285)..(285): n is a, c, g, or t
  misc_feature (319)..(319): n is a, c, g, or t
  misc_feature (401)..(401): n is a, c, g, or t
  misc_feature (463)..(463): n is a, c, g, or t
  misc_feature (523)..(523): n is a, c, g, or t
cctggggctccaggccccaagcccagcagcggagagtttataaataaataaatnacaaaagcgggcngggagtggnctggccagccctcccggggnnatggctcagtgcccagtgagtgacagcggcgggntccgcngtgagtcctcccccccccgccgcccgcgccgctcccgccccccccgcccccgtgaagacaaccccagggccaggcgcagggcgctgcaaagcagggtggaccgggggnggggggggtgcggggaggggatcctgggcccctgggcgcngtggacagcggcgggcttgccgggagggcccgcnccagcggaagcggtgcctcaaaaaccgtggccgggggaggagggcgggcaccgggccgggtgtggggcagggctgcccaganggtcacctgccccgcctcagtgcccgcctcaagcaggcgctgccggatggcgaacggcaggngggcatcgtcctcgtcccggagggctcgtggcgccccacgcccagcacgccgtacccgtngggcact

SEQ ID NO: 721896 - DNA, 222 bp, Homo sapiens
gccgcggatgcagtatagaggatcggaacgttcttctgcaggatacctctaggctgcagccatctgatcacgatggccaacatctttcaattcctgtagtcttatggctgccataatgttcagcttatccacttcaggttttagaggctttatactgggattcctaagctcttgtctcattgccagacattcctctaacttcaagcataccatcgttccaca

SEQ ID NO: 721897 - DNA, 695 bp, Homo sapiens
  misc_feature (689)..(689): n is a, c, g, or t
ttaatcctgttgctttctctcttcccagcacctgctgtggtccctggcacaccttgccgtacattgaatgaaggcaaagggagagatttcatcttagcaaaatgtcatgaactgcctggagaaccatgagttttctgttggtggggagttacgtcttggagggggcgccacttccaggactaaggcagtgtcggctcagctcgagaatgcagtgggtgacggggtcagcagccctaaaactccctccaccccggctgtgggaagcacccactgggggctccatcccgatgggcttcctgagctaaaatgggtgctttgtccatgctggataaatatgtggcgatgttggtgggttgggcaagtcagttacacgactctgtatgttcttcagatgatttggggatatcactgttattttaataagttctagaatttcccccattgacattgctacaaggcaattaaattaaattaaagttccttcttaataaaatgttccagtaaaacactttcctagtccccttgttgatacgtttgtctgcagtgactggattagctggcgggagaatagaagaaaagtggattttgaagggagattgtgcttgagtcacgcttccagctcctagtcattgtgggaccccagtgggctccccagagctttcgggtcttgatcatcctgtaaaaatganggtcct

SEQ ID NO: 721898 - DNA, 197 bp, Homo sapiens
cgaacgtcgagttcttctgtaaggacacacagaacaagacgcaggaatagccaattaggggggtgcctggtgatgaggaggggatgggtttgtcttgtcttctatattaaatttatggactagtctcattactccagaattatgctcttgtacctgtgtggactggagtatcttagtcgttggtttggtttgctggg

SEQ ID NO: 721899 - DNA, 100 bp, Homo sapiens
agtacagtcacaccttcattaattcattacctatatatattaactatgaactaagaatagaataataagagagaaactaaccaaaccaaaagttggctct

SEQ ID NO: 721900 - DNA, 142 bp, Homo sapiens
cccccccctccccccccccccccctttttggtaggtttgaattcttccagaagctgttgatgcgggttggccaggtttgagtcaaattgtactttgccccattgttaattgagaaacggtttcaataaaaaattctttttta

SEQ ID NO: 721901 - DNA, 180 bp, Homo sapiens
tacctcactaaagactccaaagcaatcctgccggtatctacgctcaacctcttcttccctagctcaaagccactatcatctgctgtgttagggattggggtacctgattggcagaaattaatcagctcccaaatggtacacaaggaaactaaagtgggtacccaaggaaaaaaaacggga

SEQ ID NO: 721902 - DNA, 1473 bp, Homo sapiens
aatatgtgggtgctgctggtggagtggcgctgtggcccgtcccgctccaaccatcccgtgccgttgctgcaagctcagtggcgtttgcaaaaaccacgtctggtgagtgacttgtgccgcaagcgcgggcgaaccgtggcgcgctcggggagtgtgggctggcggctgaatgactgagcgatgtgatacgaatgcacgcccgcgagagcgcggggtgaccgcgtggttggtgcgcgcctcccggggcgccgctgatagacgcaggggtcagcgtgcctgtcatggggtgcactcatgagcgccagtcaggtggtccaggaactacactgtgaggaggccgccagatgctggtttgaattcctgtggatgcctggtcaggttcaccaatctccagcacagcacggactgccgagggatccacagcacctgaagcacacagcatggcagcaaccctgtgacagtcacaagacgccacgctcacggcacggtgacagcacatatacccagacccagagagtccattggcccgagggaccctcaaacaaaacaactcatgcggagaacacgggccaatcaaggggtccatgcaggagcacaatccagaggtgcacaagatgacattccacagacttcagtacacagcaagcaaaagttcccgaaacctaacatggtaccgaccttggaccaactaggaactaggtcaaccctggaacagatgcatagaagcatggccaggagtggataatagaacacagtcaaacactaactcgacttgggaaattcaatacacagaggcacaagaacatgaccgatgagaaataattgagtccgcacaaatagacaaaagaaacagaaggagcccaagaaagcaatcacctacgaggagaacaacaaaaagaccttacagaggagcatataaccagagacacgggatgggacagaacccctgtagtagcaccaaagacacccaggaagctggaaaccgacaatagacacaagagagcaacgaacagggagagcccacacagggcaagcagagagaccaaagacagccatggggtacaacacccacgagcagggagtaacagaagaaacagtagaagatcaatgaaaaccatgaaaattagaaaaagacagaaccgaacaggaatacaaacagaacccgaaggacaaagagaagattaacgatgatagaagaagagagaaaggagagaacatgtgtcgactgacagcttaaaaaaaggatatagatatataaacaacatgggatgacagaacaaagagggatgaagtaaaagaatgaatctgtaacagagatgaaagcgactcagcgacaagcgattgacgagaccagagagacgaacgaagcaatgaacagaaatgtgatattacaacataatcagaagaacgagagaagaagaataaatcgaatcactaattgacaggcaaagaaggaagatacatcaatatcac

SEQ ID NO: 721903 - DNA, 1176 bp, Homo sapiens
  misc_feature (1175)..(1175): n is a, c, g, or t
taagggtaaaaaatgttcatttaaggattatcacttccactaccactgaggcctcgtgaaaagtgttcacaaatttctcaaaagcagcgagggggtacacaagttttttcaccacaaccacacaagcaacaaacgaaatctgtgccattggtggtcatctcgtgcatgaggtgcgtaatagtggggggttcaaaggtttctccatttggtttcaaatggctggattatgaatgtttccatgaaagaataaaaaggtatgggtagacacattttatatccaaggtacaaagggctgaggacttgggtattaaacaccaaggaagaatcctgtgaatcacaaacgccaatacccccaggaggtcaccccaatacacacaccacagctcataatcacgggcacggttcaaacattgattggtcctcgcgagatgtctcccgtggacagacgtgttccaaagacgttggtgtacagtggaggttaccagacacaaaagcataataccctgataaaccgaacccttataacgatattttacacaaaacctttaaggcaagtaaggagaatggctcgctctgatcgcacggagaactacgacatagcgactcacaccgtgggatccaaccacaaccctggcaacgtgtacacaaaaaggactgcatagtacacaggtggccccacacacaccacaaaacttgggaaaaacaggatggacacaaaccatggacagcgggacatcggggaaactaggacaccacgagagacgcggcaaatcaaacaggagagaagtaccaaatcacagaggggagggacaaaaaaacacagcgagaaccacacaacgggagaacacccaagaggcgccacagaaacccacaatgtcaacaaaagagaatgaaaaaagtaacaagcactaaaaaaaaaggccacaacggtgaaccaaacagagagaaaaaaacggcgtcgatcccctcgtatcgactctcgaagcatgtccctcgagagagagcgccattcagacagactagctagtgatgaagagacgatcaaacccttgcaagattgcacaatcaatgaaacgataacctacggaaagaagtgatcacaaaaagatctacaaaaacatgccagcgagctactacaagaccgctgaatgtactcggtgcgaggcacagcactnt

SEQ ID NO: 721904 - DNA, 820 bp, Homo sapiens
gcccagctctggttacccggctctgcatcgtgtctgccatgatgggccatcgtccacgtgctcgtgctcagccagaacactagaagcgtgaatccggaacgaaatacgttcgttctggacaacatcaatggctgccaagactattgcagatctcgatccgacacatggtttggggatcccaagatccagtgatgaagtatgcgtttctggaccctaatgtgggaggctagttagtgatagactcgaattcgatggctagattgccattgcttctgagcagtatatcaaggctccaggctatcgctagtcgtggcctacagtccactgcatccgaacagttaggccgtgcacccgaggactggacagacggttggaggatgggcaccacaatcagtagagttattctttggctatggcgcaacaatgcgtgtcgtgtatgctgacgccactgtccgtgtgagcacgcgagatgtcacccaaccagatggtgatcagttggcttaccgcaagaggccattttgcgcatgcgatcactgagtccaggccacccctctaacagcagacacatagaagtatcaccagatcgcaacatcaaggtgaccagtgcattatgaatgcctggaaccatctatcgaacaagcgtctcatttagtactccaaagcccatcgaagtcggtgagtcatctctgggcgttgcaacatttgccctgtgatgctgtcaacgcatggtacagttccgacggagaccggtcggacccgacgatcgaccttctccacactttatgcaagaagtggaccctcgatagcctgggaggcatcc

SEQ ID NO: 721905 - DNA, 260 bp, Homo sapiens
  misc_feature (243)..(243): n is a, c, g, or t
gaatctcgcggtcgatatacttatgccacgcgcttgaaacggcatattttttcttcttggtgtccaccgatagtggagtaagataacggatctctgattgtgattgtgccataaataaaaatcctccttgatttattcgttagtttttttcttcttgggctgtctcggctgcaacttcggcagtagcaggttcttcagcctttgcgctctcttgaacattctttttcatgccacgacgcttgnctgcatattcgaccgcg

SEQ ID NO: 721906 - DNA, 103 bp, Homo sapiens
tctatagcggagcggcacgcctgctgggggtatgttgtgttgtcaagtttggaagaactgttggtccatgtgggtgctaagggttccgctggtgctccgctta

SEQ ID NO: 721907 - DNA, 1358 bp, Homo sapiens
  misc_feature (1358)..(1358): n is a, c, g, or t
gcgctactttgtgcttccgccgttccgccgctcgcgctttctctgccggtctgcaactggaaggaatgagatcgccgcgcttggtcacttgacaaatggtctcctgtgcactgtgtcacagaggctggttttggcttggggacgatcggctctccctgagcgcgtgtttccgttccgatctgtcgggcgcctcctaggacggaccatggggcgtctactggtgtggcatgggtgctagagaggatctctcctatcgtgggcgatcggagggcccaagatgcgaaggtcagttggtcaattcctttgaccttcgcttgaaggtatccctcgatctgcaagccattgggcgactcagtcgatctccacagcattggtgcacagatccattggcatggaaggattccttggtctacccaatcaagctttctacatacgaagcattgtcgcaggtggccccgggaggaatgcgacccatttgcttgcgtgatcctgatgtgccccgccttgaagactcgccgagagggacgctaaacgacgagaagggaacgatggactcacggacttaatcgttttggcaagagcactttacaactacactccgggaccgagtgatgaccggttgtgcgcgaatccgatgggcctgcttgtccttgttcgcctttcttacagcccatcgttggtgtcaccaagccccagcctcgggcgcaagttagtccagttggaaccgtccttgtggtaaggaccggtgggtggtttcacacccaactatctgtggttgtccccgaattcattaccgggaagtggtggcctacctgcgcgcgtcactcgcgccaagccgtcgcaattcgcttggcggtacgttgagaaacgccttgcggcctggaggctcggggaggaaacgccattgggaagctcctggagcttttatcccctgtcacttgagagaaggaatttcacgttcctagcgttgaacagaccgaatgggccttacgaatggctttcttaccacaatccctacgtgggaccagtaggccgggggggaaaagaattcccggttggccggtccgaagcacatttcctcaggtgggagggaaccgcctttgttcggcttaatcggttaaccggagccccttgttgaaacattttccggaaagccacacggaacggacttgtgggccacatcgctgtgcggggcaatttcccgttccccttgcaatatttcctactctgggtaagggaaaagaaacgagcattatagtgaaaagtagttgggcgccagaaaattgtgtgcccacgcgggtgcacgtccacacacattgtggtggcaagctgaagccgggtttatccccggtaggtan

SEQ ID NO: 721908 - DNA, 120 bp, Homo sapiens
  misc_feature (1)..(1): n is a, c, g, or t
ntttctttcgctctgtacatgtacgtgctagctcatggactgcagtaggtaggacctttgtgtgttcgacagtgcaattagggaatctccccccaaactaggtgtcttctctttgaagac

SEQ ID NO: 721909 - DNA, 292 bp, Homo sapiens
gagaatgtcaatacatcatcaagtgccacatatctagcacatgtgcatatgatgcaagtaacagtaaacattagtgaataaaataagtcactaatgtaaacaggacatttatacaattaataatcaataatacaaaacaagtatctcactatgtagcacaagctagagtgcagctattattcacagccataatcatagctcagcgcagtctccaactactgggcttaagtgatcctctcacctcagcctcccaataattgggactataggctcataccatcatgactggctt

SEQ ID NO: 721910 - DNA, 162 bp, Homo sapiens
cacgaggtcatcatcaatgacatagcgtcacaaggctggaattaccggccggatgttctctgcacacaatattacaactgatcaagagacttgtccaaacactggaacattacaacctggggattatatatctgcgcccacatcgtactaaattttaccaca

SEQ ID NO: 721911 - DNA, 148 bp, Homo sapiens
  misc_feature (56)..(56): n is a, c, g, or t
gaatgatatggtgtgtggagatattccctttcgagcatacgaagagatcatcaggngccaggttttcgttcaggcagagggtctcttcagaaatgtcagcatctcattagatggtgcttggccgtgagaccatcagataggccaacct

SEQ ID NO: 721912 - DNA, 380 bp, Homo sapiens
cacgagggcggcgcctcaggtcggcgccaacgagttcagccccgatcagcgcaaggcgatcgaagcgatcgtaaaggactacctcgtcaagaaccccgagatcttcctcgaggtgcagagctcgctcgaagccaagctcgccaaggacgaggccgatcgcacgaaggcgatggttgcggagcacgccaaggagatctatcgcgctcccaatgcgccggtcgcgggcaatccggacggcgatatcaccgtggtcgagttcttcgattacaactgcggatattgcaagcgcggcttcggcgagatcgcgaagctcgtggagaaggacaagaacgtccgcgtggtgttcaaggaatttccgatcctgcgtgacgaatccgagc

SEQ ID NO: 721913 - DNA, 347 bp, Homo sapiens
tttggaaggaaaaaaaaaaatgggtgggggccccctggaaaaaatgggcccaaaaaccttaatcctccggggggatcccctgggggaagttcccgtttttggaacaggtttttccctgccgggaaaagcccagggcttcctttaaacccccttccctcccattaaaccgggaggaaaaaagcccaaagggaaccccccccgttttaagctgggggttttccgtcttttaatcctggggatgaaaaagaaccccgggtggggccctaaaaaaatgggtttttttccttatccgcttgggtttttttggggttttgtaaccccaaaaaaaaatgtttttttataatcca

SEQ ID NO: 721914 - DNA, 187 bp, Homo sapiens
tggtgatctagaggatcccttggggctccatcaggtctgccaggtgaagcccctcgggagaaattttacaacaaagggtcaagaaagcttggtttcttctaaagaaatatgcgtttttttctttctcacaaatagggtgactttaaaacggaccaggcttctcatttggtcttgggggtaccgagct

SEQ ID NO: 721915 - DNA, 177 bp, Homo sapiens
tacagcagacaacagcagaagggcatagagtacggctcccacagcactaattgacagtatgcctccctacggttgaaaatgcaaaaagcagtgtgacccccacatagctccggggagctacatgcctttagttttcttctgcaacatgggccacagggcaaaacatctgatatggca

SEQ ID NO: 721916 - DNA, 85 bp, Homo sapiens
tctgctgggatcttaaggtttaagctctgtacacagaagactaaggtgtgtgtcagtgccttgaggagaaatcgcttacagaaca

SEQ ID NO: 721917 - DNA, 97 bp, Homo sapiens
ggggcgcagagatgagcacacagctttgggcacggtccaggcaaactgaaatgtacgcctgaatttgtaaacagaagtattaaatgtctctttctac

SEQ ID NO: 721918 - DNA, 276 bp, Homo sapiens
  misc_feature (155)..(155): n is a, c, g, or t
  misc_feature (241)..(241): n is a, c, g, or t
aataaagcttgcaggttggaagttactctgggtgagtcagtgagtaaatgatgagtgaatgtgaggcccttggacatcactgtaccctactgtagactttataaacactgtacacttaggttaccctaaatctattttaaaattgttttctttcntcaataataaattacccttagcttactgtaacatttttacttgacaaaccttttaatttttaaaattttctgactgttataataanacttagcctgaaatacaaatgaattgtctaagtgt

SEQ ID NO: 721919 - DNA, 248 bp, Homo sapiens
  misc_feature (46)..(46): n is a, c, g, or t
  misc_feature (126)..(126): n is a, c, g, or t
atatgttattagatgccctaacgctgacgataactgtcatcacaanctgtacagcagccgtatcttcaaatgtgttgttttcaccacgtatttacgtatagcataataataattggtacttgagtncaagacgacatatagatacttcagctttgaagcatatagtaacatcattgtctagtcaggcagaggaaagaaattcaaaagcactttctttttcttctgtcagttcctttgcagtaagatcc

SEQ ID NO: 721920 - DNA, 107 bp, Homo sapiens
gcccagcacacaaccaaccaaagaaacccgaggaagacctgttatgacatatgtgggcagtgcgctgtagccgaacgacgagcgcagcgaagctattgagcgaggaa

SEQ ID NO: 721921 - DNA, 1171 bp, Homo sapiens
gctgacacatacctcccggccccctgacttgctcttacccccgtgcctcctttcccaggtgataccttgatcccatcctcctcgtatggacggaccgaagacgaaccgacatagttgggcgccagtgatgctaggtggctaggccttattgggggtcgcttctggtacgagcctcaggtcggctcctgcgcgatagtgcgatagacaagatgatctcggaattcgtgatagagcatgacaccgcgaagtgccaaaaggcggaacgggcgttgatagcatcgtccccaacacttcgcgtgcgagtgcatccccaggtgagcctgctcatgctgattactggacttctgaagatggtagtgagtgagagacggaggtagagaggaagaaaggacaggaacgcagactgggcaaccaggtgagtagcgcgggtgaaatgcaccgcgagatcgcacatagttggccttgactagagcaaaacgccccagtgaagcgcgtaccctcaggaggccccacgcgtggaccgactaggagtggcggacactcgtgcagagggggaagttcgcgcttgcacattgcacgttgaagcaaagcaggagacaagccaaacaggaagggtgggggcaaggacaccgatagaaacaccacagaggccgaaaggattgcgcgaggaagtggcccaggcatacccacagcatgaacaagggcacgcaagaaatgacaggtgctccaattgggcacgaggacaggcgaccaaagtgcgatggggctaacgcgcacaagtcccaagggcatgaagatggaccagtcaaagtggcgcgaaatccatggacgttccacaccgatgttggttagaccggatggctacagggacacacgcaacccagttcaacggtgccaaggagggacacaaggagagacgccaagtggccagtggtggcaaatgtcggatcaagagagagcgtgggtggacgttggagcggacacagcgatggggacacattgcacgaagccccttctctgacccttggactggcaacctcacacgagaaatgcgaaccgagaaaagcgatgcccacgaaagatacgaccgaccggaaagctatcatacagtcaaagtgaacttgtggcagccaagagaacacaagtggacgaagagggagagaacgatggc

SEQ ID NO: 721922 - DNA, 270 bp, Homo sapiens
acagcaaatatgtggagacttgcatttttactaatgcttcctgatgattacctacatctcagataattttggtaactacgtatagttatctggaacataactttcagtttcctctgctgttctcaagtgctgtactactgatcatccttgagatcacccactgaaaagtcttctcttatccagttttactatacgaaagtcttcttaacatttggtttgatgtcatgttctccgaagcatttactttacttgccttttccactttctgtg

SEQ ID NO: 721923 - DNA, 174 bp, Homo sapiens
cccgactagccctgacaggcattgcaatctcagcctcctgagtagctgggattgcagatgcctgccatctgtgcccaacctgggcaacaatgagtgaatctccgtcttaaaaaaaaaagaagacttgaccttgtggacccttagcccgtgtctggctacgtcgggggggtacct

SEQ ID NO: 721924 - DNA, 473 bp, Homo sapiens
tcttgggcctgtgttatctcaccttgggcctgtgttatctgtcacgcaggctggagtgcattggcacgatcttggctcagtgcaacttctgcctcccaggttcaagcgattctcttgcctcagcctccagggtagctgggattataggcatgtgccaccatgcctggctaatttttgtattttttttgtcttgcagttcttgcccttgatgtttccaggctctggagagtctgcaggcccaagggcttctctggacacccagaagagcacccacctcatggaaaagtggtcagactgttctccacacagtttccagtcctcaattctcctcactgggcagggctgcctgacctgggacgccaggaaaaccattctgcccctacatgaccacttcaatcagaaacagctcggtagtttggctgggtgtggtgcctcatgcctgtaatgccagcattttgggaggccaaggcaga

SEQ ID NO: 721925 - DNA, 86 bp, Homo sapiens
taaaagaaagccaatatacgtgtttggtccataattgaggaatcccacacacttctcaactaggttaaattaaatgccaggtaccg

SEQ ID NO: 721926 - DNA, 121 bp, Homo sapiens
tggggtgatctagaggatcggccaggtagattcacggtagatatagcaaattttttctttttgtatttctatgttctcacttttttttttttcctgagagagtctcattctggtcacccag

SEQ ID NO: 721927 - DNA, 124 bp, Homo sapiens
tctacgggaacagcgtatcagcttaacattaacgagagtcactatgctatactaaccccagggttggtcaatttcgtgccagccaccgcggtcacacgattaacccaagtcaatagtttatgct

SEQ ID NO: 721928 - DNA, 490 bp, Homo sapiens
  misc_feature (2)..(2): n is a, c, g, or t
  misc_feature (56)..(56): n is a, c, g, or t
  misc_feature (129)..(129): n is a, c, g, or t
  misc_feature (155)..(155): n is a, c, g, or t
  misc_feature (166)..(166): n is a, c, g, or t
  misc_feature (237)..(237): n is a, c, g, or t
  misc_feature (242)..(242): n is a, c, g, or t
  misc_feature (301)..(301): n is a, c, g, or t
ancgagcgtctaagagcatttaccttttcaaatgaccataggggttttaaagcganactgggcatgggagatatgggaatggtgcaggcacagagtctgtgtcttgtccccatggtgtctcaggtcatngctggtctggaggtctgatgggtgtnatggtgacttnggcccaatggtggtggactaatggttcatgactccccctaagcgggagtattccacagaggctccatgccnggttngtttcaagattcgcctctggggtttcttaaacaagagcataattagataaacatgcatngccggagaggagtgtctacagagggaaggaatgaaggggtgagagtggagaggtgaaagaaaaacaaagtaggtgatttttaaaactgaggtcccagcagccaaacaaccactggcctcgagataagcaacattaaaaccatttacactcctctaatgttgactgacggacaaccggggggtaccgagc

SEQ ID NO: 721929 - DNA, 107 bp, Homo sapiens
ggaacttggccacctccattgttctttgcttctgcacaagatccatgaaaatccattgatcaggagaacttcaacctgcaggacctctcaaggtacacatattgtag

SEQ ID NO: 721930 - DNA, 162 bp, Homo sapiens
agcctattaagaactcgtgaatagtttatctaggcactggtctaatgcacttcgcagactgtgattggcctggaagctcactatgcaatgattggcatgcagactcagctacttgttacaacgcaactctcatgttacggtctaccgtggggggcatctctc

SEQ ID NO: 721931 - DNA, 658 bp, Homo sapiens
  misc_feature (18)..(18): n is a, c, g, or t
  misc_feature (78)..(78): n is a, c, g, or t
  misc_feature (80)..(80): n is a, c, g, or t
  misc_feature (87)..(87): n is a, c, g, or t
  misc_feature (90)..(90): n is a, c, g, or t
  misc_feature (116)..(116): n is a, c, g, or t
  misc_feature (124)..(124): n is a, c, g, or t
  misc_feature (134)..(134): n is a, c, g, or t
  misc_feature (166)..(166): n is a, c, g, or t
  misc_feature (177)..(177): n is a, c, g, or t
  misc_feature (235)..(235): n is a, c, g, or t
  misc_feature (282)..(282): n is a, c, g, or t
  misc_feature (293)..(293): n is a, c, g, or t
  misc_feature (343)..(343): n is a, c, g, or t
  misc_feature (388)..(388): n is a, c, g, or t
  misc_feature (391)..(391): n is a, c, g, or t
  misc_feature (400)..(400): n is a, c, g, or t
  misc_feature (406)..(407): n is a, c, g, or t
  misc_feature (418)..(418): n is a, c, g, or t
  misc_feature (422)..(422): n is a, c, g, or t
  misc_feature (437)..(437): n is a, c, g, or t
  misc_feature (439)..(439): n is a, c, g, or t
  misc_feature (457)..(457): n is a, c, g, or t
  misc_feature (466)..(466): n is a, c, g, or t
  misc_feature (482)..(483): n is a, c, g, or t
  misc_feature (510)..(510): n is a, c, g, or t
  misc_feature (513)..(513): n is a, c, g, or t
  misc_feature (527)..(527): n is a, c, g, or t
  misc_feature (548)..(548): n is a, c, g, or t
  misc_feature (552)..(552): n is a, c, g, or t
  misc_feature (554)..(554): n is a, c, g, or t
  misc_feature (560)..(560): n is a, c, g, or t
  misc_feature (563)..(563): n is a, c, g, or t
  misc_feature (577)..(577): n is a, c, g, or t
  misc_feature (580)..(580): n is a, c, g, or t
  misc_feature (583)..(583): n is a, c, g, or t
  misc_feature (589)..(589): n is a, c, g, or t
  misc_feature (594)..(594): n is a, c, g, or t
  misc_feature (655)..(655): n is a, c, g, or t
ttgttattaaatcattcncttacaacccgtagttttaaaagtagatgcctaactcgttgtttcgagtccggagggtananactgtgnagnggtgcctgcaccccgcgagaagaatntgcgcctngttcaatatnctggtctgaaattggcgtgttggtcatctcgngcggtaaccanggtaggcaattcagaggaggggaaaaaaaatgggcgggcctcagtgcgcttgtatgtnggcgttcggacgcactgacgagcgtaatgttgtaacggcgggagctnctgggacggtngcggttggaggcaacgatgcaatatttggggcgctaatgaagtaagcagnggtggggcagtggtgctgctacgtggaggcatggctgtgtggtgnggngcgtttttngcagcnngcacggtattnctangacatccccggtggngngaaacacctacgtgtcgntgtcccacntcaacgtccacctctnngcggccctgcttgctcctgctgttttnctngggttcccatccgncaccccgcctccttcggactnctgngncggccnccncctgcactaccccnccngtngtcttncccgncccctggcgacacgcctgcgccactctggtgtccctgctctccttcccatccctattcttnggg

SEQ ID NO: 721932 - DNA, 728 bp, Homo sapiens
ggcctgcccttgacgcatagcctggggagcatcctgactgcttatgctgctccgatggcacagcatatgtgcgtcaatgatagaagaacatccaagtttcacactggccctggcaaaggtacatgggtctggacctccaagggaaggctctaacgatatcttgagctgcctcgagaggcagagagctgggagctggcatagtcctatcttcatggcgtcgtgaatcctaaacggaacatatgacaatgacgtaaggctccaaatgccgactatgcagagtgacaggcctgtgttcttcactctgggtttctagaagagtcctcacctctccctactccaccctgtgctagcacatatgcacttgacactgtctggatgtagatcgatcaaggggccgaacgagaacgaaagtgtccactctagcagggtgctgcacggtgtactctgggaggttcgccatgagtgcccagagataggctctgatgagcagtttactctacctaagaggatgcctctggtgagttacacgtatagtaggttgttcacttgtgtggtgcctgagggagtaaggggccctgaggagaagcgcagaggtggtcctcatgaccctgggggcggtgctggccgggggtggcttgctcggacgcgggagcatatgcctctgccgtccttggggggggacagctcttggcgccgtggccaggttctgtgggaaccttgtgggcctg

SEQ ID NO: 721933 - DNA, 651 bp, Homo sapiens
gcgtggggagcaggtgccggggtcagtgctacgtttaaattatggccgaacaagggcacgaagccgaaggagggaaaaagggcgagccacaacccccacgaaaaaaaaagtaagacgaacacgaaaagagggctggaggctggtgctttcttttacataacgggcctcggccttgcagtttcaccaagccttccctttagtgtatttaatcgccttctgattttctttttcaatgttcgtcttttcagccgcgccattgttgtttacgccggcgcggtgcctcccgttaaggttggttagccagccggccccctccaaacttctccacgttccccctattcccactcccccctccccctacgcccctacctctatacccctcaccaccccttcattcgcccccaactacccccatccatgccccctccactatttactcatctccataaccttgattctcacttataccctcactccctgttaactagctcaacatctcacgccctcactctcccacaaaccagaaatcaaatacgcaaaaacatatacacaaccagaacccacagaaaccggcggagcaaagtccccactgaaccttcccccacaacgcctgctcattggggggaggcgaccagcgggggtggaggggtg

SEQ ID NO: 721934 - DNA, 662 bp, Homo sapiens
cagcacgagcctcatatgactaagaaagtggattttgaatctctattttgctcaaaagttcagttcctagatatactagatgactagacagtgctactggaaaattttcaagattgtatggtcttttaaaggttttttatttttttttttttaatacaaacttaaccactattcactgtccacataatcaattgtcacattacaatgctacatgctaattaattacataatatacaattccagtgatggaaggcaattataatggatggtgctatatacaacataacactaccatctttaaccataacccatctctacagcaccacttcatctttttaaacaccctgagaatctatttattattactattatcctttatttttaaatacttacaatataatttacattcctaattaacttttatattatggcattaattttatttctattttattttatttatcatttacctatagtactattactattacatactatcacctataccctatttctactaaatactcaatacactattatacaatcactataactaccacttaagacttcccaaactaccctttagcatatcagtgacactccaatattgggtaacaaaaaaccttttaattgtccttcttaacatatatttctcccctgtt

SEQ ID NO: 721935 - DNA, 306 bp, Homo sapiens
ctcagtatagacggaagcccgatcataatagctgtacgagatttactgccttagacttgcagagagccagatcacttataccaggacccgatcttacacatccgtaagacactgacagatccagatccttataccatgcacccggatcctacctcctcagatactgacagatccagatcctcacaactgaaccagatcctacttcctcagacatagaaagacccagatccttataccaaggcacgatgttacctcctaagacactgacagatccagatccttatacctgcaccaggatcaaactca

SEQ ID NO: 721936 - DNA, 1153 bp, Homo sapiens
  misc_feature (18)..(18): n is a, c, g, or t
  misc_feature (29)..(29): n is a, c, g, or t
  misc_feature (59)..(59): n is a, c, g, or t
  misc_feature (73)..(74): n is a, c, g, or t
ggcgcaagacagatggcngtggcctgatncgggcccgttggcggcgtcactgacgcttngctccggtcctcgnnatcccgagcgcggggaggcagaccgctgtgagctgcttgtccccatcctgcggccgtcctggggacacagagccctccgtggtgcccggggattggattggagccaggacctcacttcctcctctgcccctggccctggctcctcccagggacctgggccgaggccctgcatgccggcccatggtctggtccctgcgatgcgcgagttgtgcgtccaggtagagggtcccctcgattggacctggcttccgtgctgcactcgtggtctcctggtgggcagctccttctgatggacgcgtgctgtacgtgactggcgcaaccactcgtgccactcgcacaggagtgagtagtgccagacagggtgaggagtactgagagtcctgtgccccagaaacacctgaagcgagggtgaaactgtgagagtggacggtcaccttcaatcgcggcttccagcaggaggtcttcctaggcaaggacctgggtggctttgatgaggacgcggagacgcggccggagccggacggaagctgcatggtcagtctttgtccaacggtggattgtcgaaccactgaacggaagatcagtgcccaaggacgatgcatggctggatcatggacgaagacggcgagcacttccaggaggccatggcacgacagcaagacacaacttccgcgccgtgggacctgaacggggacggtcacgtgtctcgcagacgagtataagggtgaacgtattggcgagtacagggcataacgaagaaggaggttgccgagcccattcaggctcaaggaggaatcaaaggggaccaaggaacccagggaagcccgggaaaaaccgaagagcacggggacacaaggggaacacccccgatttaaacccatcgcacacacagacgacaacctactgatacccaaaacgaaaacaaccaggaaacaccagacaaggggcaagaaaaacacgcgaaacgagaccgaggaaacacaacacagattgccaagaacctacatatctggagtgcacggaacacactgacaataaaagaatctgcctccacaaacaggtgcagcacgacacaacag

SEQ ID NO: 721937 - DNA, 887 bp, Homo sapiens
gggtctggtgggggttacacgcgggtacatcatgcgtatcgaaaagtgttattactagttcgtgggcccatctatcctggacacgggttgatgtacgtccgtggacgattgcaaggtgtacagagttggcagaatctaagattgtcgtaaagagtttatagaatgaagcgcaattcctcgcgaaatgttaggtggagccataagcattccgtgaaaacgcggcttgggttatagagcttaccgtgggtaatccattttgatatgttcgaaaatatgtggagaaatgaacctatcacaaatatgagggacgcaagctatgggcttaccaaggtattgtacgcgatggacgtagcgtgtggagagagttcaacacaagaagcgccatgcgtaatatttatgatcgagacggattgaataaccatatatagagctactatgaatgtgtcaggcatataaaacgaagtcctgctggaacagtccatcttgatccagagatcccttctttggcgggcacgcgtaaacagtcggaagagaatatggttcatgctagttactaggaggatgtgtgacctggaagggatgctcctatagacaatctctgtaacctactgtctttttgtgtacatcttgaaaaactgcccttgtgggatacttcgggcaactggtcggattatttaattctgtccccatgcagggtccctctctactgaaagcgatcataggcctcttttcctgcctgggcagctacgttgatatcgggagataccgggatgttggaattgctctcaaggggtaatctttctggcgagatgtcttttcggggctctgcacatcttactggaactatgaagggcatcgggggcgccatggcgggccttgggtcacgg

SEQ ID NO: 721938 - DNA, 1551 bp, Homo sapiens
  misc_feature (18)..(18): n is a, c, g, or t
  misc_feature (29)..(29): n is a, c, g, or t
  misc_feature (59)..(59): n is a, c, g, or t
  misc_feature (73)..(74): n is a, c, g, or t
ggcgcaagacagatggcngtggcctgatncgggcccgttggcggcgtcactgacgcttngctccggtcctcgnnatcccgagcgcggggaggcagaccggtgactgaggggcccgggacggacgctgtgggtcgcggggtcaatgtgctacgccggtcggacggactagggcgggtctggaggccgtcgccgactcccgacttgggctggggcattcgtccggttcgctctgccttgagcccttgtgcagagagctccgccgctagcggggctcccgggggcaagtgatcaggtcgcgatcgatcgctggacctccccggtgcgtcgggatgtctggtctcctatctggtcaaaaactatcgaatggcagcgggataacggagtgcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctggccctggctcctcccagggacctgggccgaggccctgcatgccggcccatggtctggtccctgcgatgcgcgagttgtgcgtccaggtagagggtcccctcgattggacctggcttccgtgctgcactcgtggtctcctggtgggcagctccttctgatggacgcgtgctgtacgtgactggcgcaaccactcgtgccactcgcacaggagtgagtagtgccagacagggtgaggagtactgagagtcctgtgccccagaaacacctgaagcgagggtgaaactgtgagagtggacggtcaccttcaatcgcggcttccagcaggaggtcttcctaggcaaggacctgggtggctttgatgaggacgcggagacgcggccggagccggacggaagctgcatggtcagtctttgtccaacggtggattgtcgaaccactgaacggaagatcagtgcccaaggacgatgcatggctggatcatggacgaagacggcgagcacttccaggaggccatggcacgacagcaagacacaacttccgcgccgtgggacctgaacggggacggtcacgtgtctcgcagacgagtataagggtgaacgtattggcgagtacagggcataacgaagaaggaggttgccgagcccattcaggctcaaggaggaatcaaaggggaccaaggaacccagggaagcccgggaaaaaccgaagagcacggggacacaaggggaacacccccgatttaaacccatcgcacacacagacgacaacctactgatacccaaaacgaaaacaaccaggaaacaccagacaaggggcaagaaaaacacgcgaaacgagaccgaggaaacacaacacagattgccaagaacctacatatctggagtgcacggaacacactgacaataaaagaatctgcctccacaaacaggtgcagcacgacacaacag

SEQ ID NO: 721939 - DNA, 520 bp, Homo sapiens
agtagctccttcaaaagattcctttcggtcctaccaacctaacaacagcactctcttcacgtaatctgagcaagcgagggatatcgtgcaaagtatgagtcaaagtgcaaatttatgtgaaaatcttttgaacttattcatacttggtttgtagcatttcagaagccacagatattacttactagctgacgtctatttcttttccaggtttctgctttccttttggaattcatgttctggaaaggtgaaatcactggggaggctgtggttcagattcctataaaattctgtcctatgtgctttttttcagtcctgtgcaaagaccaaagtcagaaagtttcacatggccctatggggaagaaacaaggtgatagatggatgagtatacttggaggtagaacagaacattacgttctgctccttacagcatccattatagctctacagccaaagtacactgctccttcttttatgactaggaaaatcctgtaattgcagataaattttttactccccaatc

SEQ ID NO: 721940 - DNA, 1274 bp, Homo sapiens
  misc_feature (943)..(943): n is a, c, g, or t
  misc_feature (1274)..(1274): n is a, c, g, or t
acgcgggtccgcgcggctgcgccgacggacgcccgggacggcctttcgcccgacggcgggctgcgggctgctggggtctggtgcggacgggccaacctttcgggacataacccatggcatgtgaggcattaaaaacatcgataagatcaatttcatatatcacaggcgaatatcatcatcatcatcgaaataccatattacacattatatatcagaactagatattagatatcccaacaatccaaactcacgtagaacaagagcttggagatctcgcataataatattccactagatttggacaatcaacaacatcccatgcaatctattaaaggcgccatcccacaatgcatccatatcttccatccccatgcaatgacatggagacattccaagcggactcggtcctgaaatttttcacacttttctcccttatgaagcaacttttcacagccagggtctatttcttccacggggtcatcatttttgcgtggcctttcacaactgggctccaatccccagcacttgtctcatagctgctcaagggtgcggcctcttcttcaccttggccttcacttccttatccttgtgcggccaaccccaacttttgcctcctgccccgccccctcgttgcccctcttcttgtctcgctttcttgcaccctttcctctttcaccaacgctcattggtcgctacgtaccttggcccggtcccccccttttctctccgctcctctccttttcttagcgatccctgtgcttgccctccccttccctgtcttagccttttggccccgtcggtgttcttttcccactttctgcgggctttcccactatggtgcctcctttcttgggctggcttgggccacgttccctaccttcccccacatttcggttcctgggctcctcttccctctctcggggtctgcttggcgctacgcctncttttctccgcaggctcttgtggcctttctccaatgcctctctcgcaatctcttctgttgttccccctttcgttcgtcgtgcctattttctcccacaactgtttcccgtaggttccttcctttgcgcgtagcgcgcggtcttcgccgacatcttcgtcttcatttggctcttccgccccttgctcggctttccccctctgcggctcttttctccttctcctatcctcctctcttccactccttcctccattgtggcgcccccttctcgcgctttcgcttttgcttcacttttctccatttccggcttttcttctcccgccctcgcgcttgn

SEQ ID NO: 721941 - DNA, 323 bp, Homo sapiens
gtggcgccatctcggctcactgcaagctccgcctcccgggttcacgctattgtcctgcctcagcctcctaagtagctgggactacacacgcccaccaccacaccaggctaattttttgcatttttttttagtagagatggggtttcaccgtgttagccaggatggtctccatcttctgacctcatgatctgcccatctcggcctcccagagtgctgggattacaggcaggagcaccgcgcccagctgacaactgtttcctacatctgaaaatgtcactgtcaaatcagagcacttgagtagaagtttatcatggagtggaggg

SEQ ID NO: 721942 - DNA, 991 bp, Homo sapiens
  misc_feature (2)..(2): n is a, c, g, or t
  misc_feature (120)..(120): n is a, c, g, or t
  misc_feature (160)..(160): n is a, c, g, or t
  misc_feature (170)..(170): n is a, c, g, or t
  misc_feature (179)..(179): n is a, c, g, or t
  misc_feature (206)..(206): n is a, c, g, or t
  misc_feature (221)..(221): n is a, c, g, or t
  misc_feature (230)..(230): n is a, c, g, or t
  misc_feature (232)..(232): n is a, c, g, or t
  misc_feature (235)..(235): n is a, c, g, or t
  misc_feature (244)..(244): n is a, c, g, or t
  misc_feature (330)..(330): n is a, c, g, or t
  misc_feature (376)..(376): n is a, c, g, or t
  misc_feature (402)..(402): n is a, c, g, or t
  misc_feature (404)..(404): n is a, c, g, or t
  misc_feature (417)..(417): n is a, c, g, or t
  misc_feature (420)..(420): n is a, c, g, or t
  misc_feature (434)..(434): n is a, c, g, or t
  misc_feature (446)..(446): n is a, c, g, or t
  misc_feature (448)..(448): n is a, c, g, or t
  misc_feature (451)..(451): n is a, c, g, or t
  misc_feature (458)..(458): n is a, c, g, or t
  misc_feature (476)..(476): n is a, c, g, or t
  misc_feature (498)..(498): n is a, c, g, or t
  misc_feature (548)..(548): n is a, c, g, or t
  misc_feature (564)..(564): n is a, c, g, or t
  misc_feature (610)..(610): n is a, c, g, or t
  misc_feature (639)..(639): n is a, c, g, or t
  misc_feature (646)..(646): n is a, c, g, or t
  misc_feature (651)..(652): n is a, c, g, or t
  misc_feature (658)..(658): n is a, c, g, or t
  misc_feature (662)..(662): n is a, c, g, or t
  misc_feature (666)..(666): n is a, c, g, or t
  misc_feature (697)..(697): n is a, c, g, or t
  misc_feature (700)..(700): n is a, c, g, or t
  misc_feature (709)..(709): n is a, c, g, or t
  misc_feature (719)..(719): n is a, c, g, or t
  misc_feature (726)..(726): n is a, c, g, or t
  misc_feature (746)..(746): n is a, c, g, or t
  misc_feature (758)..(758): n is a, c, g, or t
  misc_feature (767)..(767): n is a, c, g, or t
  misc_feature (787)..(787): n is a, c, g, or t
  misc_feature (812)..(812): n is a, c, g, or t
  misc_feature (836)..(836): n is a, c, g, or t
  misc_feature (869)..(869): n is a, c, g, or t
  misc_feature (875)..(875): n is a, c, g, or t
  misc_feature (885)..(885): n is a, c, g, or t
  misc_feature (894)..(894): n is a, c, g, or t
  misc_feature (904)..(904): n is a, c, g, or t
  misc_feature (915)..(916): n is a, c, g, or t
  misc_feature (930)..(930): n is a, c, g, or t
  misc_feature (990)..(990): n is a, c, g, or t
tnaaataatatggctatatttataataatataataattatctaaagcaaatatcatcattggctctgaaatgcgtgtaaagatgttattcttaagttaaaaaatacgtagtaagaatgtncaagaaagaaaaaaatataaaaacaagtgtgctgagtgtngggagtgggngagggatancctaccatattgtgacggagttcaaanagaaaacatgccgcnacagtgctncngcnttatcagcnccctggaaaataaaccagtgaccctgggagtgcagtgaccatttggttaacaggacagacttcctgagggacagagagagtgattnactgccttgccctgctctaactgctctcttcacaccaatgcctttnctttcctttaagaggggtttcatccngnggacaaaagagtnggntttatttgtgaagnaaagcagagaananccngattgangtgttcaatgatttagtngaggatgcgtggggatcaaacnttgtgaaaaggtcaatgaagccagtgagcagagactatgagtggcttgcngagaaaaaattcgganaagatgtgtgtgaaaaagacaaaaagaataagcggtgaaaaatccnagggattactgttacccagacaatcaaangcgaganaggtnncccccnattnaatncatttacttgtggagttagcaaaaaggaggnttnaagaaagantttggtttcnaacagtnttcgtggtcaaagggcacantcagaaggtctnctcctcttntaggaactggaacacggatnataagtttttttttgagtggccctntgcacacatcatcctgtagatctnatgggccagaatgccaagaaggattgggctctntgtgcngggagcaganttttgttcnaattccagancttaagccatnngttttgttccaaantcaccctgaaagttattagccgagggaacgccaccaatcattccaggtacagggattatna

SEQ ID NO: 721943 - DNA, 833 bp, Homo sapiens
gttatgcggtactgactctcttattaacggcgctacgaacaccacctggaacacagctgtgacttgataaacaagtgaaacattctttggtgtggtgaggggaaaacaaatttctcaaaggacacgcaccatggtgtatgagaggacactggagcccagccagcatctgacatgctgaattcaaagtgcaggtgaaagtaggacaactgattcacaagctgggatgcctgtgttgttgtttgccagtgtgcgtgtgtgtgttttcctggcacccttcattcattccccagcacagttgacatcaggttggaagcagtgagttctgagggagactgctagaggacccaacttggagaatcaacgatctgcgatgaagataatgaagataaagacaatgtcaatgtcagcgtccaaaatcataaggaccctttaagaagcttccagagcagaagtgactgtgcaagaagggccaataaagtctaggcaatgcacgaccaggcgcggtcgctcacgcctgtaatcccagcactttgggaggccgaggtggttggattacctgaggttaggagtttgagaccagcctgaccaacatagtttcaccccatctctactaaaaaaaaacaaaaacaaaacaaaagttagccaggtgtggtgctgcacacctgtaatcccagctactctggaagctgaggcaggagaatcgcttgaacccaggaggcggaggtggcagtgagctgagattgcaccgctgcactccagcctgggcgacagagtgagactctgtctcaaaaataaataaataaataaataaataataaagtccgatgcgaacg

SEQ ID NO: 721944 - DNA, 925 bp, Homo sapiens
ctctgggttttctctctgggtccctctctctgtgcccccttcgttccttgcagtgggtgctcttcctttggtggctctctcctctcctgagggtctctcctgtcttcgtgtggccccgtctgtgctctgtcccgaaagtgttgactgtctatttggggcgctgtgcggctggcttttcttccatggggaacggggtccttactcctgtgtgtatcagtgggccgcccccactgtgttttagatcgccccgtgctcgtcccctgtgagtgtttcgcgctctgccgctctcccgtgttgcagcgctccctgcgtaggacccccccgccttttgtctcccgccttgggttagtggcgtcacgttcgcgcagattgtccccctggggtttatattgcccacagggtacaaattgtgccttgtccctcgggcaagctaaaacttgtctcgcgcaagatcttcagcgcacggggtgctgcaggttgtgcagagaggacgtacccgctgtttgtgaacacgggatgcgatggccccgcgctgatgtgtgggcgagcaaaaaagcaattggggcgccaatttttagaatcaagggtatatcctgttatggccgccccagtataccagaaggtcttggtatgcccctagcgactgaaaccacccctttgggtcgtccggtgtaccagagcttcgcctcttgtaggcgagaatggttccccccggtagtgcgctcctatgtccccccctccctcaacagttgtggtataaccccgcgacgctgttatgcaaacgggtgtggaaacgcaacaggtccggcaccaaataggagccgaaccgtgcaagagctcgggcgcttttcacgcgccactggcggataccttcaatcttgcctaacaagagttctcgtcaaactttaacaataaaaaaaaacca

SEQ ID NO: 721945 - DNA, 540 bp, Homo sapiens
atactagagggtcatagccaaccgactaaccgaataacacggcgggcactattaacgaggagcattcatataccgagggcaacacacacccgctgtccgaaaagtccttcggtacaggataatcctgtgtataacctcagaagttttataactacgaaaagattttccatgagcctatcttaccactccagccatagcgccgtaccccacaattgaggagggcactggacaagaacaggcactcaccccgctaaatccactagaagtcccagtcctaaacacatccgatattactcgcataaggagtatcaatcacctgagactcaccatagtctaatagaaaacaaccgaaaccaaataatacaagcaatgaaaataacaatggtactgaatctctatttaacccacctacaagacctcagagtactacgagtctccctatacaccataagcgacggaatctacggatcaacataataagtagccacaggctaacacggaacttcaagtaaataaagactcaacataactcaatatctg

SEQ ID NO: 721946 - DNA, 122 bp, Homo sapiens
taaccctgaaatgaggtctgtaccgccgcggacacgggtgtattttctgtgcgagaggcttaccccggggaaatattgattttttgagtggcccctttgactcctggggccagggaacccac

SEQ ID NO: 721947 - DNA, 260 bp, Homo sapiens
  misc_feature (203)..(203): n is a, c, g, or t
tcctaggtatatgtcgtgcctaccatggtgaccatcggatcgacggggaatgcaagaagaccacgacgccaactaagaatctgaacccactgccgatgagagccaggatgatggcgtccttgtagcagctgttgctgaagcggttgtagctgcccaggtctgtgaaggcccccatgccaatggcgtaagaaaagaaaatctgngtccccgcatctatccacacctttcccgtggatttaacccccttccagacacagaag

SEQ ID NO: 721948 - DNA, 445 bp, Homo sapiens
tctgacggattgaatgtatgctaatcttccgacctgccgacaccaggacgcccctgacatgaagaaaaaatagacagcacagtaccgacacctgcgctggcagatcttcgcacggtattaactacggttacgccgggtactacctgctgagcaagaacttctccctggccatgccgtccctgatcgacgagggttacacccgtggacagttgggcctggcgatgtcggagattgcaattgcctccggcctgtccaacgttcctcatgggactggtgtccgaacgctccaacccgcgctacttcctgcccttcggactcctggtgtccgacggggtgatgttccttttcggtttcgcaccttgggctacgtccagcgtgcccatgcatgtcattttgctagtcatccacggttgggcccagggaatgggctggacgccaagtgggc

SEQ ID NO: 721949 - DNA, 1095 bp, Homo sapiens
taaaaaccctcatcaataaatggaaacttacaaaaattttcaaaccacttttacaaaatgccagtatcagccgggggcttcgaaacccaaagtgtatgttgggtatgtaacagtgaacattattaagtgggcggatgaaagcaaatacgtgaggaaacgttgagccaatatatgcacgtgaagtccgtggaaccctgtggctcacaaacaccatgttgacccgtaaatgcctgtcgaaaattgggtgacgaaggggaagacttcgaaagtactctggagggctttgtacggaggtgtgtaaaataagaagacccaggtaaacattttgtacatacggcatgtggtttagaacttattggtgttccagagttgttctccatattaagacctattgtggagacgcctacaggtgtgatttggacaaccctcctgaagtgtgcgagaataaacagacggaagatggtgatcacacgcgcacggtggcgaccacacaagggggacaatttaacccaggcagcgtaaatgacccgcaatgggagagcaccacaagacgccaccccaacaatggcgagagggagtacagggacataggccctcgtaccagcgcgcaccaaaagggggtctcaaaaaaaaaaagttcttgtgtgagtaggaacagaaacatattttcgtaggacagttattctaagatgtagatgaattatagccccaggttatcgaaaggcgccctttgtgtgtgaccaaacacatgttagtatcgtatgatttagaacccctgtgcgatatttgatcgttactccgctctagtggatcacacccccacgtttcggcccgaaaaattgccgtgaccacacaaggggagaatacctggcacgtcaccaacgagagaaccaacagcaaggcccaacaaggggcgatagggcactggcgcccatcagtcacagaggcggacgcacacaacagagagccgccgtaaaataggagaagatactcaaacaaccacaaaagacaactagtaagcacaccatatgtaacatacacaccagcggcgaatcgagaaggctcacgaacaagctgtgcaacagaacgacagag

SEQ ID NO: 721950 - DNA, 192 bp, Homo sapiens
  misc_feature (81)..(81): n is a, c, g, or t
tcattgctctttgcaccagtgcacatggacgacgctgagcaccaagagtttcattcttctggacacacttggtgcattgcntgtaacactgactagcatggctgtgggaggcagcagcctctactgggctgatcctccaccatgctcataagctgcatctgtgctgtgacaccaccttggccatgtgccaca

SEQ ID NO: 721951 - DNA, 90 bp, Homo sapiens
gccgttggaagtggttgtattcagaaaactggtggatagaggaaataaaaataataaaagagaaaaagaataagaagagtctgaacttag

SEQ ID NO: 721952 - DNA, 365 bp, Homo sapiens
  misc_feature (114)..(114): n is a, c, g, or t
  misc_feature (138)..(138): n is a, c, g, or t
  misc_feature (210)..(210): n is a, c, g, or t
  misc_feature (237)..(237): n is a, c, g, or t
  misc_feature (249)..(249): n is a, c, g, or t
  misc_feature (274)..(274): n is a, c, g, or t
  misc_feature (276)..(276): n is a, c, g, or t
  misc_feature (316)..(316): n is a, c, g, or t
  misc_feature (341)..(341): n is a, c, g, or t
  misc_feature (354)..(354): n is a, c, g, or t
tcagcaactgaaggccgccctgcacatgaagactgagctcttttccagctcatgccccaggtggaatcatgctgaatgagacaggcccagggttaccagcgctttctcctctanaatcgctcacccacatcctcccgnaaagtgtgtggaggaattcaagtccctgacttcctgccctggactccaaagccttcttattgactcctaggnatcaagaggcctgtgagctgtccaatnactgacctgtancttcatctaagtccccagatgggtncnatgggagctgagttgttggagggagaagtggagacttccngctccagctcccactcaagataatnaagataatttttnaatcctcaaaa

SEQ ID NO: 721953 - DNA, 347 bp, Homo sapiens
  misc_feature (138)..(138): n is a, c, g, or t
cctcctgtgagtcctttttcctgtacaaaacctgcctggggtgggtgggggtttgccattccctcccccaggacttccctgccccttttttcccctgtaacctgtttattaaccaaacctgtcctgagttcatggccnaaacctttaataagaaaaaccaaagaaaaagacagtggaaaaaaaagacccaggggcctgcccccctgcggggactttcctgtttcaaccttgtgaaagaactgggtttggttttggttttggttttttttttttttttggttgtttgttttttaacacttcctgtgctgtgcccatttataagaggaaataaaattaagctgaaatga

SEQ ID NO: 721954 - DNA, 481 bp, Homo sapiens
atgcgtggtacgcccggagactgtacttccaggcagaccctgatttgtattccagatcagcagctagtgctggcttgaggccactattcagctcgttcgtcatccttcaccgaatagagctgttggacttgctgtattaatcataatcttatgtataggcttcactaaaataagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaagtgggcgccatgccacgctgctgggagtggtctaagagggcagcacgtctgccaaggtcc

SEQ ID NO: 721955 - DNA, 137 bp, Homo sapiens
cacgagggtttagggagataacaatacctaagattgtctgaggttccatctttctcatatttcctaatgaaggattctcacttctgagcagatttgcattagagttctgttttgtttctgttttcagtgtctagtgt

SEQ ID NO: 721956 - DNA, 237 bp, Homo sapiens
ctgtgtaagaattctctttgtgcatcccctgtcattttcccctatccacttctctctctcgtcgctaccaacaccaccctctacactgctaattgacctgataggatgccttctttaccatttgcctacaccctgattcccaaaacctatttgctttcacctggactgacccttacaccctccaagccacggtcaacccacaagccacggtcaacccacaagccacggtcaacccac

SEQ ID NO: 721957 - DNA, 392 bp, Homo sapiens
tccccacactgggttcgagttcgaggagcccagggtgattgacctgttgtcctggcgcagccgcaacctcacgggagggtgctggaggcgttccgggagccgctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggagcccagcccggcagggaagaggccagcgtgaaggacctgggctc

SEQ ID NO: 721958 - DNA, 183 bp, Homo sapiens
atcataggatgtatttcttagctcagattcctttatctcagaatatcatttcttcttcatctaatagcatatctagtcaaccatcatttctctccctactctataaaatatagttctcatggattacgtcttacatttctgtccgttcactacacagtcaacaaagtgatcattcaaaaagat

SEQ ID NO: 721959 - DNA, 1051 bp, Homo sapiens
agacagtgtgctcggatcgaactacttttacctctgcgtctcctctgacttaagcagttcatcttcgacgtctacgggactcgtgaggcgtagccacgatcaggcaggcctgcgatcggtaggagaggagaatcagcgacatggtgacgagagctaagatttgccggtgacaaagcgtccgctcagcagcccagtatgctacccgtggttaggtccagacctctcaagccattaagagactctcaagtagggtagtggacgagttagagggacacaattattctagctaccgctcagggtgtctgccatgaaggttctcgtgcagctgaagtggcctgtttcagtctgtgcatggctatgcacatatactccacgagtatggagtcttagagcgatcaggtacaactgagaaagtcggagatagatggcttgtgagcaaaaaatcgtcggacgagcgacgaccatgtcctgatcacattggaaacgtagcggacttctttgggccacgcagtggggtgagcaacacgaacgtgggctagccatgagacacgattcgaccgcacacttattagaacgctcggttgaccaagaatcgatgaggaaaactgaagcatcgaaatacttggttgatagacgagacattcaagacgacacaccctgcgtcttcaatagtacggaagagattaatgctttgtgtccgttggttagtaccaatgcatataaatctcttgagccagtctcgcatagagtaagacgtttaaagagtatctcatgatagtacgaacgagaatttacctcgaaacaggttgcccaatctaacgaagggggcataaggggggcgtgccgccgcactagaaatatcttcgccgtctggaggctgggcgtgtgcagggggaccatgaccccgatttatcgtgcgaatgaaagaggtgcctccacatgaagcgaagggtaaaaaagatacaagcaaggcacgggccgcagccggggaaaacaggggcgaattgggggaaaagctgggctagggccacccctggaagaggcgagccag

SEQ ID NO: 721960 - DNA, 292 bp, Homo sapiens
tatatacaccaacaaacaatggtcaccagtaactactactaatcaacgcccataatcatacaaaggcccccgcaccaataggatcctcccggaatcaaccctggaccccttctctcttcataaatatattcaggcttctctacacatattaaaggtttaccaacaacacacaaccccaatcatactcttttcacccacaggcaccaattccttacctccatcggcttaacccacacttaaaacatctcaccaaggaccttcaaccccttgacccccggtgctgtggatcggg

SEQ ID NO: 721961 - DNA, 573 bp, Homo sapiens
  misc_feature (516)..(516): n is a, c, g, or t
ggcggggctcactgacagcggtggtcgggtgtgggtgtggagtttcccagctggcccctcgggtgcgacccttgtgagcgtttctgctccggtcgccagtcgttacctcgctcctcgggccatgaccacaagcaccagcttcaagggagtcgatcccaacagcaggaatagctcccgagtgtagcggtctccaggtggtggatccaattcacatcaggtttgatgaaccaagagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagacggtgatattcatgacaatgtggacacagacttgccaggcagcctggggccagagtgaagagaagcccgtgctgctgcgcctgtgccagcccggntggcccggcccagtgccatccagaagaatccccttggggagtcagctcgtctgggta

SEQ ID NO: 721962 - DNA, 464 bp, Homo sapiens
cctgtacagaaagactcagttctttttctcatttatggcttgcatgttacagctcaataagggggaaagagctctgtttaggtcatccataggaatgtcaaaaatacctgcgagattaaattggtcatcagaattttgcttgatgagcatgaaacacaacaaaggattttaatgatatcattgaagctttgtagaaacctgctgaaccattcctgatctaaaaagaacactcttttttagatttattcagctgaatctctcttgaataatagtgccagatgattactcaatatgagggaatagagaaggagagggggtgtcagctgctgggattacaggcgtgagccacgggcacctgacccggagcttttcattcaaagacttctggtggccagatcttgatctgaaccttcctttctctagtcctttatgtaacctggactccatacatgccaaccaaaatg

SEQ ID NO: 721963 - DNA, 2296 bp, Homo sapiens
tattttagttagcgaaaggacataatcatcaatgtttataatctggagtgcgttatcatggtttatagcaattagttcatttgcatttatgtttttatattcatcagcaaaattgcaatgggtatttggattgattggaattagtcagatacttttatggctactaatatggcgtttttcacgttcagacaagaacggtagcgattaaaatatttcggcagacatgtgcgtacagtttatagcgtccgctttgttagcatgtattagacgttaacgaacgattcgcttacatcaaatttgaacgatacggttgctacatggtataattttgttagaagaattgtggtttggagtcttatcttcaatccagagcttgtcgtctgtcaacgatgagctttttttgtgcaaaaaaatagccccgtcctgtcaaacgaggcacttgtattagcgacgattgtcgaaatacttttgcaacaagattaatactaagccagcaaaaatctgccaaagtgtggcttggagctgttgcattagaaggattgcggtttgcatggagtctcacctcccttctgggcgtctaatctcaacgccacgagaaatagtataccatgactttaaaatggcttagaacgcaaataagagccgtttaagagtatttaagtttgcggtggtatcttcgtatcggtggcgcgaccaaagggaagcagacgacacacagcaggacactccaagtgtccagtgtgctggggtgccgttaagaaatgacgaccagtcattttaggcatctcgtccttgccgatatggagataccacctctaggcgaaatgaggagagctctgctcgacgattggagactttttgacgggaggcgatcagcgccagaaaaaaccggctgttactaacagccgaacagcccgctagaggtttcctttaggtaaccgcacaaccaaaaaagcagtcagaatgacaagccaaataactagtaattcgcccgtaaaatggaaacgtagaactcgtcatgacacttgtggtaaaataacattattcgccttgcaaaaaacgatgtactttgacaatttaagcacaaaaaaacacaacctcgacaatttagagttagagaggtcgtgttttgagattagtgagactatggatagttcattaagtattataacatactcaatgagtgtacatagtctccagaaaaatggagaacccatgaaacaagaaaaacagcagtttataaaaacggattggacgattgacatgataaatcgtcggcaatttgagaaatatgccattgatattctcacagctactaaggatattcatcgcggtggatgggtagaacgaattgataataaggcttggcagtatgtcagagtttatgaaaatggcgacattgaagttttaattacacttcagataataagattccacaaatattttgatacaccagtttggttacagtttaacccgaatcatcttttacccgcagattatgtgcaacttgatcatgtgatgaaatatgttgatcactcacatttaactcgcgccgatttagcaaatgatatttataacatcaacttgcaacgttacgattttggattgtttggagtaactagagatatctatcgtagtttatctggtgatttagaaacacggtattggggacgccgaaaaagtgagcgccaaattcgtctttatgacaaaatgcgcgagatgaaaaaacatggcaaagcagatgatattccagacggtattactgattggtggcgtttagaatttcaatttagaggtggcaaggttgagtcatggcaagaagaagtaatggacaaaatgcagtcgttccatgttcttgctgttgatgataatgatgatttaagtgaaatagataaagccattttagcacgtgttaatgccgataaatttgattttaaaagagtcggtaaacgttatgctgcaaaaattcggaaaatggtacgtgaaaacgttggttttgatacgaccgttgcagaattatctctcaaaacattcaacgaacaaaaagatgagttgcagagacaactagatagcatgcttgcaaaatataatatcggtgcacaaacagaagaaatgacagcatattttgaggaagagcttaaacaaacaggtaatcttgatttttctgttgttgagagtgaatctgcgttagagcgtaatgtgatacgaaatattgctaaaacttggcgtgaagaaaatagtttaacgcacagaactaatactaatagttgatgcgtattttttatttttctaatat

SEQ ID NO: 721964 - DNA, 361 bp, Homo sapiens
  misc_feature (24)..(24): n is a, c, g, or t
tcagaagctgcttaaacattcccntgagcttaaagaattgcactgcactctggcaatgaatcagcgttcctattgctccacatcctcaacagcatttggtgttgtcagttttctggattttggccattgtagtagatgagaaaattgagaaacggagagatgaaaacatttgcctaaagtcaaccagttataaatggcagaggcaggatttgaatgacagctgtacaacttcagagcccctccctttatttcacaacactgaagtgctttggggcgggcatgctggtcaatgtataggggtggtttatttatttattttctaactaagttactgcaggcagccgtggcttagttagaaaaa

SEQ ID NO: 721965 - DNA, 125 bp, Homo sapiens
tatgagactctcttatctttatataattctgcaaaaggagatttaagctttgcagttcaaaatacgataagctcattttaatgactgaaatctatactatacactcagaaggcaattgctttttg

SEQ ID NO: 721966 - DNA, 220 bp, Homo sapiens
aggtggaatgaggtttttgagccaagatagtgccactgcttccattctgggtgagagagtgagacgctgtctcaaaaaaaaaaaaaaagggccaggttcgggtggctcacactcacacttgtaatcccagcatttgggaaggccagggcgggcagatcacgagtccaagagatcgagaccagccttggccattgtggtgaaattggggactcctctagag

SEQ ID NO: 721967 - DNA, 115 bp, Homo sapiens
  misc_feature (24)..(24): n is a, c, g, or t
  misc_feature (28)..(28): n is a, c, g, or t
  misc_feature (95)..(95): n is a, c, g, or t
gaagaacaggcgccggctcagtcnagcncagcagttaggaaactgactgtcgctctctccggcctcggcgctgcttcggacgccccggcaccggnccccgttgctttgtagcatt

SEQ ID NO: 721968 - DNA, 323 bp, Homo sapiens
tgtgggacatcatactaggatcagttttgcaggtcgtaacgccatttaccaacgatcaattgtaggtaaatgaagggcagcatcagtagaaaaattgtgaaaatatgttgcagtgggcagctcagcagagaatgggctagctgccatgaggccagggctgggggaaagttttatagggtcctgctgcagggtgctccgtgtggaatgaggtcattgtgcccgcaggttgttagtgattagctgtttctaacaattgttcatacaataattgttcattattgttctcaacttggggccctccccaagctggggacccttcctta

SEQ ID NO: 721969 - DNA, 735 bp, Homo sapiens
tcttggagtatgaccccagtctgttataaactgcttaagtttgtataatttgtacttattatcgtgtgttaatggtgtgtgctccctctccctctcttcccctttgcctgacctttagtctttcacttccaatttggtgggacatgatattttgaggaactaaccggaccttttaaagaagcaaaaacacaagactgaatttcctgtgcttacttgtgcatatacagactggatatacaacatttgtctttatattaaacgagcacattgttccccaaagagggacctgtgtttctgggaacttatatgaccgtgaccctttgggctcggttgtatccactacacgttggggaatttactcgccgtacactatgtcacaagggttgttgtttggagacacaggccttggttaagaaccgactaccggggaattgtgggacgaacgaataatctgggggaacgcgcattgggaaaaaagaacgctgaacattggggttaaggtctcctatgggaagaaaagttctaggtgagataacgcatttcgtgggtgttagtggcaacaaaaattgggggcattgggggacaacattttgggaacaaacttgttgggatgatcctaccacgagggtctttgttttaacaaagatggggaatacatagaggacattggaacatattttatatgggggagaaagggggttacacaaaaaggaatttttaaaacccaataatggt

SEQ ID NO: 721970 - DNA, 234 bp, Homo sapiens
cttttggggtctttgctgctaaaaattttatttcttgaaactagcgccaaagcatccagacaattaaaattacattattgatggtattactctcataacaggctggatctagacatagaaacaaccaattctctctcattggagatgtgaatcatacagtcacgtgatttcccacaatttgctggtctcccattggactctgatattctgttctctctctctctctagcaaaga

SEQ ID NO: 721971 - DNA, 479 bp, Homo sapiens
  misc_feature (479)..(479): n is a, c, g, or t
acacaacgaggggacgtaccggaggcaggttctgttccgctgccgtcgccatgacccggcgtaaccaacgggggcttgtccgccaaaagaatatgaaaaagcccagccgctcggttaagggaaagccgcccagatgacgggctttttgctgccgcccgcaagcagagggacttggagatcatgcagcacaagcctaaaaaggcaaaccatacgaggaacccaagtccctttggggcttcctgtccaacccttttgcccttcgcctgtgttgctggagccagtcccaccacgcttgcgtttcctccttgtatgctcacaggtccccacccatggcattcccttttccctgagtttgcagcgggtcccttttgtgctccctttcccttaggtagccttttttcccctgggccacttccggcggtgagggggttaccccttcccactggtttttatttcctgggcgctcccccgttttcccn

SEQ ID NO: 721972 - DNA, 187 bp, Homo sapiens
acgattcaccggcaggatgcttcaattgcaaaatcatgaatatttttaagttcaaaactaatactgtcacttaatatgtatgtatgcatatgttttatctttattttctagaaatgcatctacttgttccggagatttcacctggcagcaccatatcctacctccagtctactgttcccgggggtac

SEQ ID NO: 721973 - DNA, 345 bp, Homo sapiens
gtgtggtacatttacatgctcatggaatacactgcgtcaatcgggatgcattttaccatgctgcatggaatcgcactgcattcagtgatgctgcatggaatggcactaccttcaatcgagatgctttgggccatgctgcataaaatccactgcatttaatctgggatgcattgggccacgctccatggaatcaactgcattcaatcaagctgcatggaatccactgcattcaatcgggatgcattttaccacgctgtatggggtatactgtattcaatcacgctgcatggaattcactgcattcaattcggatccattgtgccaaaatgcatggaatccactgag

SEQ ID NO: 721974 - DNA, 306 bp, Homo sapiens
aaaaaaaagtgtttggcagttcccctctcacttgctgtctctcctgctatcatgaaagatatgccttgcttccccttcactttctgccatgattgtaaatttcctgaggcctccccagctatgtagaactgtgagtcaattaaaacttttttcttcataaattactcattctcaggcagttctttataacagtgtgaaaaagactaatatactgcatgattccacttatatgaggtagttaaaatagttaaattaataaaatcaaagagtagaatggtggttgcgggggctggatcactagtgcgg

SEQ ID NO: 721975 - DNA, 383 bp, Homo sapiens
gtcgacaggcacaggactatgtgttgtgggagaccaagctgaaaaagacatggtctttggcacaaagaccctactgtctaatggtaagtttgaaaacaagaggtttttgaaggtgtgatgtgtgggaaatgcccaggctgagatttctagtacaattaatattctcaaaggtagtttcatccaattctctgataaaagagccatggtaacaatgaaccacagcaaattgttcttattctctaccactcttaaactccaggggtcttcctttcttctggcctaataggactctttcgttcatgccacacggtattttatatttagtcaaaatttatcttaggcttctcaaatgattacctgttgcttgatttcttgagtactta

SEQ ID NO: 721976 - DNA, 562 bp, Homo sapiens
acgtatagctgctgactagaagagggcggcccagtaaagctaaggcctctctcccagatgcgagtggggagggaacgtcccggagcgagtggggagggaacgtcccggaggcgagtggggagggagtgtcccggagccaagacaggagcctgggcgtgcaccaggagtacaggaggaggaaggaggcagcttcagaatcgaaggagtgacagggagcgatccccaccccaactatgcaaagagacacacaaaagccaggccagccacccagccaaggagctctggaccctgcctctccctgagctgttctttgccaactgcaggctccacctgaagagaagccatcacaatgaagctactgcaagagagaccgatggatccagggatgaggccaccagcaacaggcagcgacacacaacctcaaaaaagttctctcacagaaagctcaaggaacagatacaagacttcagagaagggataccagaaaaaaggtggcacatgagctaggagagctcaggagaagaaaggatgatcccgaggagaggcttccgaggggagccga

SEQ ID NO: 721977 - DNA, 201 bp, Homo sapiens
ggcaagggtcgggttcgggctctctgctcagctgggccccagatgtggcctgcggtgatcctcttgcccgcctgggctaaatcctccgagttctgattggtggattgggtctgatgtgccgtgatattacccctaatatcacagggatgtgtcctgcccatttgaagttagtgtttcagacaatcgaagataaaacaacat

SEQ ID NO: 721978 - DNA, 717 bp, Homo sapiens
taggtgaaatacaggaaaactacatttgttattcctcagtttttaatgaccttttcagcatcaattgttaatcagattattttaggttttcgtaaataattttttggcctctttcaaaaggttaacaattaagcatactttctgcagtggttgatggatttttttctgaggtacagcatttaatactaagttccaaaaatgtgtctataatgtgatcctaatgatgatgaacttatatgttgatcagtacagtaagggagtggaatcgagaatagttcgtgcgtgcgggggtaaaacttaaaagtttactatttcttattgggtaaatagattttaagccaattctagtaagaaattaataaaactaccttatttgtatttcacttaaggtggaggaccttaactaaaggaccatatttattcattattttaatattataagggaagtaaaaaaaagtgaggtatagtctaaatggtgcatataggaaatactgacagtgtttagcaacattgcagcccttttgagatttcatgtcggtaatgctaaatgtgaataaggatggaatggtgaacatgtggttagtcttttattttaagaagacttggaattgatagatttggagatgagttttgaagggctgttggttcatgtctataggtctgtgattgtccttttcaaagcatttctgaagttattcaaatgggtatagtaaggga

SEQ ID NO: 721979 - DNA, 739 bp, Homo sapiens
agcgggttgtccggccgggggaggcggaggtcgctcgctcgctcgctcggctcgctgactcgccggagcgctctgtggtcggtcggtcggctatggtcggtcgcgagagcgggctctgtggaagggggctgaggctatgtcgtcggtggcacgcccggatggtgccggcagggccgggcagtaacgggacgtcgccgcggagcttcttcccccggatacagtgcggcccgagcggaggccgcggctgccgccctccgatcttgaacgagccatgcagcgtgcgcggagcccgtcccccgccgtgcgcaccggtcaccgacgcgtgagctggccagctccagaccagacccggcccggcgcggcctgatctaacccgaggccaggcagggcaatagctgagcccctctgggagcacggtagctccttgccccaaagtagcatgaaggctattggagaactcaagtcttggtaaggccatcaactcacagttgactgtggtagaccggtagatgcccacatcattggcatggattgatgagctactcatgtacagatggcaggagacgacaaactacaatgttcactgcatgtcatgccaggagggcctagccccagagtgctggacggcacttgctccaacccagagcttcaggagtgagccccagtcagactcagcaaaagccgaggcggtgaggaggaaggtgcccctctagtgacaagttgcaggcgtggagagccc

SEQ ID NO: 721980 - DNA, 186 bp, Homo sapiens
cagaaatcagctttggtccttcagctgcttgggcttctggaacttggggtgggtgcctgctcctgcatcaccttctccacgacgctcttgtctgtggcttaggggaaccagcactcctcgtccagcagggccagaattgccgggcggcctgctggcttctcaatgaggtcgatgcagggccttcag

SEQ ID NO: 721981 - DNA, 460 bp, Homo sapiens
tgagctctttgtgacgagatttgtaaatccgagcaattttatttctacaaaacgaagaaagaaagaaaagaagctgattttcttgtaattttgcgaagcatacatgtttaaaatgtatttaaaaatgactttgttacgatcagatgcatcgccgctcccctcctgaacattttatagcattatacatgccagattaatcatataatttaatatattttattttattagctattagtgttgtttttaccctttatactcaatcagtgatattttaaatgacggaaaaaatttttgtcttgtttaagcttttaaataaccactgtgtagttcagactagtgtccgctagcatcatcttgctcttcgcattcttctgtatcacgcagtgtcattataagggaaatgtgctgttgttgaatcctgctctgtgctttggaataaatcagacttgttttgtaatta

SEQ ID NO: 721982 - DNA, 352 bp, Homo sapiens
atactgatacttttctagtctgccctgcctgtctcgttcatagtagagagtggtgggggatgatacctagttaaagttgtcattcagttttctagtaaatattgtgtgtggtctttggttttgctatgttgcttttggtaggatatggctaaaatcagtgccatagccagcatgtggttactttaaaaattatgtctgacaaaatattagatggttagatgaacaggtaaaatattaaaagtagctttaaaaacttggatttaaaatatggagaatatcttgatatatgctttttctatttacatcttcattttggtgaaggaggtattgggattggtgacccgagctcgaa

SEQ ID NO: 721983 - DNA, 356 bp, Homo sapiens
aaaactggataaaaaagggggccctttccctgcccccgtttttcactcaaaaggggtttttttttgcccccgtttggcaaagttttttgttaagcccccccccccccgcccccgttttccagggggggtactatttttggggtcaagggggcaggtttaggacccctgaacccttttttttcccccctcccctcccaggaaatggggcaggggcccacggggagggggctggtttttaactttttaggggtcccggtaacccccaactctcctttttttttccaggggccggggtaaaaggacctcatgggtttccccctcctaaaaaaaagggggttttgggggaaaaaaaggga

SEQ ID NO: 721984 - DNA, 616 bp, Homo sapiens
cctgattcaggttgcagttactgaactgtccttcttgaagaaggtctcatacagagtctaaactatcctgataactacagtgacaaggctaactgtgactggatttttcaagcctccaaacatcacctaattaagctttcatttcagagtctggaaatagaagaaagtggagactgcacttccgattatgtgacagtgcacagcgatgtagaaaggaagaaggaaatagctcggctgtgtggctatgatgtccccacccctgtgctgagcccctccagcatcatgctcatcagcttccattcagatgaaaacgggacctgcaggggctttcaggctatagtctccttcattcctaaagcagtatacccagatttaaacatctccatatcagaggatgagtcaatgtttctggagacatgagatgtgccaaatggagaaaccaatgtttctggccaaggggcaccagtgactgtcagtaaaccaccagaagctagaggagaggcttggggcagactcctcgtcacagccctcagacagagccaaccctgctgacaccttgatcttggacttctagcctccagaactatgagacaataaatttctgttgttaaaagcc

SEQ ID NO: 721985 - DNA, 169 bp, Homo sapiens
caaaagaatattaatggttaaacagtgaccatgcaaaagcccatgaacaattaaacaagtagcagatgtggtattttatcaacggcagctatgaagacactaaagggactgtatctgcaatcagaggattattgggaaacaaaatgctttttaaaagacatacgtcaat

SEQ ID NO: 721986 - DNA, 559 bp, Homo sapiens
gtgcctgctggaggtcctgtggggggacatcctgccctgggagaaggggaggatgcataaccacaagctggagaatggccaaattgccctggactacctacggcaccgacaggtgaagctggtgaacatgaggaatgatgacatcgttgacggcgaccccaaggtgacccttggtcttatctggacaatcattttgctcttccagatctcagatatccaagtgagtgggcagtcggaggacatgacagacagagacaaactgctgctgcggtcacagccaatggcggaggtgtaccagggcctgccaggcgacaacttcacgcacacctggagagacggtcgcctcttcaatgccatcatccacacgggacaagcccctgatcatggacatgaacgaggtgtaccggcagatcaacctggagaacctggaccaggccttctctgtggcggatcgggacctgcgagtgacgccggtcctggaccctgaggacggggatgtccctcagcccgacgagaagttcatgattacctacgtctggtcgctgaatgacgccatgcc

SEQ ID NO: 721987 - DNA, 120 bp, Homo sapiens
cgcgaggtgcgtcattcacgctcggaaactgcaggagctgtcctcaaggcggatgaggccagcgagctggcatgcccacgcccaagggaggatgtgtctaggcccagctagcagactcag

SEQ ID NO: 721988 - DNA, 1449 bp, Homo sapiens
agcggggtgggaacgggtagtcccccgagccggattcgcaggccgggtggagaccaactctggggtctgaaggtgggagagtggcgatcctctggcgttctgctgatgtgcttgactgacgcctgtacccagcgtccacgtgcgaagagtgtgatagctttccgttccgcgtctgtgaaagcccagggcatcaggcgaatcacatggcgagccgtagattgtgagcaagtcagacttcgcagcaccgtggcacgtaacgtagaagaaaggcttgcaagagaactagcatcctgatgtacatggtgcccctcgtacttttcatcttacctcgcttgccgatggggcaagtaccaagtacaatcccacacgaagagacggcataggaccatgcactgaaactgctgactagaagttctcgactagaggaggaaggcaaacactttcctcgtggatcagagccatttgctgtgcaccgtcaacctcgtatatcactaggctgagcagagtacggcgcgaaacgcagccagaggcgtctgcaactggcgtgggcacacgcatacacggcttgaccgcatggcactatacgagcccgcaacacctacaagcaaccatgtcgatcctcacacgtctgcaggtttccatccacaggaaaacacatggacggggccccatacgccgggccacacacccctaggcccgactagctgaaatacgctcatggagacagtggcactacagggaaagcagctgacgtcggaggcccgtgggcaccaccaaggaaatggcatggagcaccggcgtcacagatcgagggccgtgacaacgtcaagctagctacgggcacgatgaaggcgaacttggcactgtgacatctcagtataagaccaagacgctgctagccgcaagaaccgagtaccgtacaccggacaggcagcaagagcacagccaaaatacgtaactacaatcacaagggagtgtagcgtacacacagaaaacttggaagagagagacagcggaaagcagagacaggaaagggagtgaaacagagatgggaatagacaattcgagaagttaaggatgaaaggtggaacaaaatgggccagtggaaattccacaacggagagatgtaaggtgaaacaggaaattacagtggggtgaatatgggataagggacccccccccacccctcctctcctcctcccctccccccccacctctactactctcacacctactcctactcaccctctttcctccaccatcacttcctgcatccccaccattcacattcccagctcctacacttctgaccactcttcctccgcgcttccctgacgctacctctcacccattcttacctaagctccatcaccctcatctcctctcctccattccaacttcctcattctctttaacctacgaactattaccctcacccaccactgacgc

SEQ ID NO: 721989 - DNA, 764 bp, Homo sapiens
cctgtgttataaaagccgcccctttttcggtgggggaaccctgggtccacgagagcgccgaagaaagtcgggtgcgagagtgagatgggtatgacaaagggagccaagaggcaatttcctctgtgcgccagaaagtttatacggaattagtgcgcgccagaaaagcacagctctctatgtcagcggcgataagatctatttaagcagggtgggagatatccacccccccgcagcggggtgtgattgtctctacggcgccgcccacagatccctctcgctttccatagggggtacaagaaatcatgtgttgagagtggcccgccccccccacttaaacccgggctgtacactcttcttggggcacacacgacctggtttcccccggagattacctctcattggcgccaacactggcgcgcccacctgttggagcgcccctgcgcgccaatattccccgcccctggggatacaaatattttgctaaaaatacattgttatcctctgggggcccccccctgttgaatgccgcttttatgtgtctatacacaccttagatgcttttgagagcggttcacccaccaccacgctggtggatgtctgtagggatgtccaccgtgcgagcaggccctcgacaggtggttcctcccaacaccttgaaaatattcttcttaagctacctccccttatattgagaagaagctccttcgcggacccccggtatcgggcaaactcgacccgcgaaggaaaaaccggcctcataacaa

SEQ ID NO: 721990 - DNA, 232 bp, Homo sapiens
gcgtgccgtacagttgcgactggacgaaatgcgccgtcgcgacgtcgcgggcgtgcggttcgatcaccgtccacaattcgcgcgcagccgcgatgtcgtcgttcgagatgttgaacaggcgcaggcgttcttgcagatcgatcgtccggctcacgctttccggtgccggcagcttcctggtccccacgattcgcttcccctgttcgctggcgttcgcaactggtacggcggg

SEQ ID NO: 721991 - DNA, 917 bp, Homo sapiens
ccatgatgtcgcatgttgctagccacaggagcccgcagttcaacctatgggtcccctcaggccgctactttgtggagcccccaattgtaacgcaaaaaaaattttcttgccgcccagaattcccgcttcccctttccggggccttttggccaccacggggtcttttacagggaccggtggtttttgagaaccgcagaaaattctttcctctaagaaaaagagggtaatcccctctgtagagcaatggcaaacggtaaaacacaattcctcgccgcgtaattgttacgaaggtctttaaagccacacaggggtttaacccaatatttgagatcctcatagcaggttccctcggaggcaggcgacaaacttaaaaaggcttttctaaacacccgcgggggtaacgaatacacctttcctcctcagggggcataagaaaaggcttattgaaaagcacgacattgtggggacacaggtagctccctcgtgctccccgcgctgttgataacccccactagacaagagggccacactccctctgtaaagtggacaaccaggaaggcggacactctctaccacgcgcttctaagaagatcatgtttaataaaggtcgtgtcgggtcaataaaacatatttttaaagcggcccattttttaaagaggagagatatcccggcaggaggtgagttattaacagcccccttgtgtacatccccgcccgccgcgaggatacaatcgctctccaattattgaacccctaagttgttaagccgcctagttgttaagccaccagtcgcatcatatttcggaaagaagattattgtggggatgtgcgggagtcacaccacaactccgggcaaagaaaacaaagaagttgaagggcaaccggaaaccaagggtccgggagcggccaaaataaca

SEQ ID NO: 721992 - DNA, 479 bp, Homo sapiens
catttttatccttttggagtctcaacccatcaggttcagaccagtaggaaccaggctgggtcaggcttttaatttccctatggtgggggacaaaatgaaccctggcttttgttccctttgcccctgaaagatctagtcctgtcctgtgatggcttcccccaaccctgttggaagtttgggttattcccataactgtatgtgttgagtggccgtgaggctatggacctagcctggaatttaaatggggagctattttttaatcttgttggtaaaagctcaaaggtttgtgctacctctgtgaggtatatactaaaatgaatgtaaaataagggttggattccctgctttaaggaactggtagttttgtttgggtgattagacaaagttttttagacctttaaactgtatttaccagtgtgaaaaaagtcctttatggagatttattccttatggaaataaaacaatgcctcagcccctta

SEQ ID NO: 721993 - DNA, 384 bp, Homo sapiens
tgtaaggggaaatccctatgttatcgttccagtgctggctagtcgatccaggacgccttgcacgactgatcctgtacagggtgatgaagtgccctgggttgacagcacacttagttagagttattggtgttaatctattcatgatgctctaagctgaaggcttagaaggctaagaccaaggtgtcagcaggttctgcgtctggtgaggacccacctgttgtttcatagatgaaacctgtttgctgtgacttcacatggcgtgaaagggcacgacagctcacacagacctttcttatgaggacgccagttccattcatgaggggactgcctgcattctcttgcccctttaaaggtcctgccctgctattatcgccactttgatga

SEQ ID NO: 721994 - DNA, 787 bp, Homo sapiens
  misc_feature (632)..(632): n is a, c, g, or t
agtgagccgagatcgcaccactgcgttccagcctgagcgacagggcaagactcagtctcaaaaaaaaaaaaaaggaaaaaaaaaagaaaaaaaattgttgacccattggtgaattacttttgttttatccatttctcagggggagagtaatggcttgtggaaaaaacatttacattggtaacacgggcgctatcagtttggggcttcttggttatatgtccagggtttaggtttacaaacccaatttaagtatggaagggattatatatgggggtcagggtgcttccacaaaaatagaccttattgagaccaaaaattgaccttagggctatttagacggacaggcatgaaacttccacgttagttctcagtctataagggcacttaccgggtctcgggtgtgggtatgaccaatagaaacaccttatagttggcttgggacctcattttgggaaaattattcgtgcctttctaatggtcctggcataggttaacaatggataaatttgacattcttggaacctataccagatggtgggtgtccgagggaccggcacacggtctggacacacacgtcagggtgcacgtattggtctgagtgaatgaggaaacctgaaaaacgggggacgtgncacgggaagccacgtggccaggatccgacaatggccgaagcagaataaacggtgacgcaactaagtggatttacctcacaataaggtcctgctgaaacagacgtacccactgtaaagggagccactggtatgacagggggggccttaggtgatgc

SEQ ID NO: 721995 - DNA, 159 bp, Homo sapiens
gtacaacatcaaaagaacttagtggatgtataggtacgacattatagaaacaggtacaggaaaccccgaacatgcatgcacatgccttggaagaccagaggaagtcaccccacggctatggcgcaattagcaccgaggcttagcttacattatcactgt

SEQ ID NO: 721996 - DNA, 301 bp, Homo sapiens
atgtgaacttgaaagcctttttagtaggactctttgctactacagaaatgctcatgatgtcttaaaactgaaaaactttataaatagcatatgtcctattgttttaaaattttctttatgaacctgataaagcgcaatgtttttggagaaaatattctttaaagtcaaaagttagtttggtaactcttagcctccagatttctctctaacctaatggtttttgttttgatctcgaaggaagtattaatattagtacaatgtcagggtcttagttggatactttctccgcgatcgaagtgtg

SEQ ID NO: 721997 - DNA, 186 bp, Homo sapiens
tggggaaaaaaaccaaatgggggggttttttttggttttaaacccgaaaccccttttttttttttgttccggtggaaaaaaagggggaaacccaaaaaaggaacggggttttttttttgttttttgggccccccccttgaacccttaattgttttttggggttttaataaaaggccctttaaccca

SEQ ID NO: 721998 - DNA, 468 bp, Homo sapiens
agaggatcccgtccatttactccatggccttcttctaaggagtgtaggttcctgtcttagtctgtttgtgtgctataaaggaatacctgaggctgagtaatttataaagataaaaggtttatttggctaatgactctgaatggttggaaagttcaaggttgggcatctgcatctggtgagggcctcaggctgcctctactcatggaggaaggtgaaggagaactggagtgtgcagagattacatggcaagagagtaagcaagagagaaaggagggaggtcaaggatggtttctaaccaccagctctggaggaactcactcacccctgagggagggcattcatctattcataaggatctggccctgcaacctaaacaccacccattaagccccactccaacattggtgatcacatttcaacttgaggtcaggcttggcggtgctcacctgtagtcccagctactacaga

SEQ ID NO: 721999 - DNA, 513 bp, Homo sapiens
ttcatgtggaacagtgtccacttagaaacgggtggatcatacagacccatccaagagtgtgcgactaaaatcataccgacgtgctccagtctctaattgcgctgaacattccagataagtcattgcagctcaactagttgacgtatgggtgctaaaagatgcagactacaaaccacagaggaatcttttattccagcgtgacaattaatttgctggccctcggagagtggaaatggctgtgatgtcaacatagcaatagtgagctacaagaagataatttataactgaatgatgtgtgttatcaccatcccactcccgtctggtgtcggcgcgcctgttatcggtgacatcgatggggaatatcgacatgacagtcgacgaaataccctggagtggtgcctgcctgtgattgatgccaaaaataagagtggcagcctggagtttagcattgctgtgcatcccaatgacttcttccctgtacaagtatcctttgtctccaagccaagcttgaac

SEQ ID NO: 722000 - DNA, 1039 bp, Homo sapiens
tgggattccaagtccccgggggggcttaattttttctttacaacatccgggtcgggggctctcctgggctcttttgggcccggtatgccggaaaagccggggcgtgggcacggggccatacgggagactagcgagggcttggaaattctctctcttcctcagtggatgactcgagctttctccttcttatagacgttccgggaggggcatgaccgggtccgggtcagtggggttggccagttccagtctcttcagcagaactggtctcccttctggggggccgagggctctccgggggaagaggcatgagttcgggagcgggtaatcccttcaagccgctgcacgtgggcctgcaggggactccggggcactggttcccggcctcctcggatccacagaattgccgagggtcggggccacctcctggtgaactggccggcacaccctgagctcctccaggctgaacgccgcggccggcgcgcacctatcggggggtaccgaaccggggggcacgtgccacgacggggccggatgggcccgacgcggtgcccgcacccgattgcggcgcgcctggagctttgccggtgccataacgtcctcgcgaacctaccgggcccgggctgtggttgaacccacgtgggccaacgccgccgttcgccagtcccttggtcagaacctcgggggctcaaagaccagtgccatacccaggcaggagccgccatggctggcataacgggccctagcggcttggcgactcacaaggtgcacccgctttcaaagggcccggacccccagtgggcgctgcgaacccccccctgggggcctccaggcccgagaactcttcccagtatcggggtccctatccggcgccaggcgcttacagagcctcggtggccctgggacagaacgctgctgcctgcagcaccaacaactggcggccacatcaatccccgtgtagcgttaaaccccccggccgtatcgtccttgattcgttgcccaaagggcactcatcttgtcggttgcggaaaccggcggaccg

SEQ ID NO: 722001 - DNA, 474 bp, Homo sapiens
aggtataaagaggtcacagtcgaaggcacacaagaagctgcccctggaagacccacgaggctgcgcaaggtggcctgtataggggcatggcatcctgctcgtgtagccttctctgtggcatgcgctgggcagaaagtgctaccatcagcgcactgagatcaacaagaagatttataagataggccagggctaccttatcaaggacggcacgctgatcaagaacaatgcctccactgactatgacctatctgacaagagcatcaaccctctgagtggcttagtccactatggtgaagtgaccaatgactttgtcatgctgcaaaggctgtgtggtgggacacaagaagcgggtgctcaccctccgaaagtccttgcttggtgcagacgacagcgacagggctctggagcagattgaccttaagttcattgacaccacctccacgttaggacattggcgcttccagaccatggagg

SEQ ID NO: 722002 - DNA, 319 bp, Homo sapiens
ggaaaacatggaaaatgcatccttaacaactgagcctctggtcatcttaagaaatttctatcatttgcaaaagctttcagaggacattgtgtatccgtaataatgtccaagaagtcagagactggaaatgttagatctcttagtctaatatagacaagaaggtcaaacaggagtgaatgttataacagttgaaaaatatatttgaatagcaaataacaaaatcctttaaaaatttaatcaagaagaccgctattctttcaccctgttaaaaatgtaaatcagttttcaaaagaacaaacattatattaacaaaaaaaaa

SEQ ID NO: 722003 - DNA, 388 bp, Homo sapiens
caccagcctcggcctcccaaagtgctgggattacaggtgtgagccactgcacctggcctattattatttttaaattttctgttataaattgatcattcttgggtgtttctcacagagggtgatttgtcagggtcacaggacaatagtggagggaagtgtcagcagataaacaagtgaacaaaggtctctggtattcctaggcagaggaccctgcggccttccgcagtgtacgtagtccctgagtaacttgagactagggagtggtgatgactctcaaggagcatggtgccttcaagcatctgtttaacaaagcacatcttgcactggccttaatccatttaaccctgagtggacccagcacatgtttcagagagcacagggttggggg

SEQ ID NO: 722004 - DNA, 232 bp, Homo sapiens
taagatccatgggaggattacgcatacccacgatcactctatcgagaccccaagtcgtgatgtggaggaagagccacctgcaagatgagacacagagaccacaagactgcactgtgaacctaggcactccgacgaccgaatgccaccggcactgtagagtctctagacagggaccccccacccaatcgagactgccaaagttctccgacagatcgaagtgatgggggaatcc

SEQ ID NO: 722005 - DNA, 467 bp, Homo sapiens
cgctttcggcatccgtatcacctcaccagtatgtctcaggctgaatttgacaaagccgctgaggaggtgaagcgcctcaagactcagccaactgatgaagagatgctgttcatctacagtcacttcaaacaagctactgtgggcgatgtaaatacagatcggccggggctcttggacctcaagggcaaagccaagtgggactcgtggaacaagctgaaagggacttccaaggaaagtgccatgaagacctatgtggaaaaggtagacgagctaaagaagaaatacggaatataaatcaccagatttggtggccagccacacgtgtgacctgtgaggacataatgccttggttttttctaatgtagatgatatggctgtgatacattagggccagcgttaacctctgctcctcctccctctgtagtttttacctacaatcaattaaaagtacatttgttactctaaaa

SEQ ID NO: 722006 - DNA, 113 bp, Homo sapiens
ctccacccaggcgtcaatcatcttgccgagcacgtgggtgggatgctcaatctgctgaccagtacgcagcttcgggtccgaaccgatcgggttaaagtaccgcaagctcaatg

SEQ ID NO: 722007 - DNA, 469 bp, Homo sapiens
  misc_feature (385)..(385): n is a, c, g, or t
tggaattaaaagttcctgaccttggccgggcgtggtggcttatgcggtaatcccagcactttgggaggctgaggcgggcggatcacctgaggtcagcagtttgagaccagcctggccaacatggtgaaaccttgtctctactaaaaatacagaaattagccaggcatggtggtggacacctgtagtcgtagctactcaggaggccgaggcatgagaatcacttgaagtcgagaggcggaggttgcagtgagctgagatcgcgccactgcactccagcctgggcgagcagagcgagatgccatcttcaaagaaaaaacaaaaagttcctgacctttccacacaggtccttcgtggtccgcggattccagagtggttcttagctttnttatttaattttcacacagtttttccttatttttaagttattgcaaagggttctgttgccggggattgtgaggtttttaccacc

SEQ ID NO: 722008 - DNA, 101 bp, Homo sapiens
agagcatatgacggcgaacgacagcacatagcacgtgtctgtggactggaaaaggtcacctgcaagaacgggcagggcaactgctacaagagcaactccag

SEQ ID NO: 722009 - DNA, 135 bp, Homo sapiens
tcccaagcatgagacactgtctgttatctagaagactatgaagactatctatgctaacctgaattaaaatgtacttgtttgatctactgaatatgctcactatcttacaactgtacaattacctacatacctatg

SEQ ID NO: 722010 - DNA, 1426 bp, Homo sapiens
taaattactttgactttttaatcagtaaggcaaatgccctccaagaatgggggcgggcctgtgttcttaattcaggttgaaggcctctccactatatttccacccacagtataaccaccctctcccacacaggcagggcctctccctctcctctcatgtgtgtggcaacacagaaagttcaggacacgtgggggcgtggaacaacacaacttctttatacaactgtgaaagagggccgagagaacaagaaacgtggttagaccaccctctcccgagggggaggttcgagaggaccgagagagaggtgtgggtggcccacaagaagagtttccaccgagaacagcgccccaagagagaggcccctatttccacaccaaagtgtgtgtccgtgtggagatatctgtgggccgtgcttgtggagagcgccacaaagaggggcgccgtgtgtggcccctcattcacgcgctgtgagacctctgggagaaagtgcctgtggagacccctctctgtgggcccccttttctctcatcacacactgcggggacagagagagagagaagagtgtttttctactcccctgttgagagagtgggaagagcggggcacaagtgtgagagagggcgcgcgcgtgatgagacgaccacagagaagagcagaagagaacaacagcgagaagggcgtgttgtgaagagagtcgtgtggggcgaggaaattctctaacacgcccccgtgtggtgctcccgggtggagcgcgtctgtgtggaggaaacgcgccaaccctgttgtgctgagaacacccccacataagaggagaagagtcttttcctccacaactgtggtggggcaacaacaggcgtgacactgtgtgttggtggcgcccccctacttcacccctgtggggcgccattaaggtggtggtcccccctgatgtggtgccgtagaggaccccccccacctgttgaggcgcccagttgatatattcacagagaaggccccccacagaaggaaaaaccaagtggggtgggggccccccaacagttgttgggggggggaggacaaccaccccgcccctgattaatggttttcccccccaccccctattgaagggggtggcaaaccccacaactatcacgatacaacaggcagcgcaccaaggcctgcgtgggagtagtcgtgacgaccacgacgataagttgggcggagtgtcggcacccacggagcgtccacatgccgacaaccacgggcggtggtctccaacaaaccatccccctatgtgagcgacccccgcggtcatgttggggtgggggccccccaaagagagccagttatgcgcagtaggagggagctaatacatcgcccctcgccactgttggtaagtcgttgatgtttgcttgacccccaacacaaaaatagggggggcgacatc

SEQ ID NO: 722011 - DNA, 262 bp, Homo sapiens
gtacgctctatgtgcatgaccgacttgaggacgagcgaagaccagtggggggtgcccacgtgcctgtaccctccggggcagcgccagtccatcatcgtggccgccagtctcggtcgagatggagaagtgggttgaggacatccagactgccattgacctggcgtaaaagagcagcagccccgcccatgagttcctggccagcagcccccgcttacaacaagtcccctgatgaagccaccgcggctgaacaggagtcagagga

SEQ ID NO: 722012 - DNA, 330 bp, Homo sapiens
  misc_feature (129)..(129): n is a, c, g, or t
  misc_feature (202)..(202): n is a, c, g, or t
cctgctggagcggctgcctcaagcggtaacggaatattggcaggccttggcgcatggatcgtggcacacacgtcaggaacgctgggctgaatcatacgccgcagcttttgccgagcaggctttcatggnacggcaactggatgagatttccattgcgggaatgaccctggtccagcaattggtggatgcccccgacaccgangcgcgccagcgcgccgggggcagttgggccagcgtgcgggtaagccaattgatgtggccaggcttgcctgcagtcgcgattcccggggcacagcatatttatcgagacggcgaccccgagggtgcgcc

SEQ ID NO: 722013 - DNA, 132 bp, Homo sapiens
cgtcggggctgctgccttgctctagaggagatggctggggccacttccacagggtgaagtggcagcggctctgcaaggggagcctggccaccaggggctgggggatgcgctctctggaacctttgtgcttgc

SEQ ID NO: 722014 - DNA, 876 bp, Homo sapiens
ccattcacacttggacgacctatcacatcatatcctcattctcttccgcacagaacctcgtctaaccccggtttatactatagcgcttcccctcacgacccactatttttgataaccccccaattttataagacataaatatttcctgccgtccaataattccgggtttcccactacccccggaaactggtggaaaccaagcaacaccaaatgtgctgtacatatcaccacactcatttgtctttaccgcacaaccaggccatgtgccaatccaagctaccaggtccgacttgcagaactcctttcaacctgtccagttttaactacctaggatttccccgtcgtcaaccccccctcttcccaaaaaagactgtccacccacgcaacattgccacctcccttcctttactaggcggtccacaccccctatatcagcactgggtaattcccaccacccccttccttgttcatgtaattctttgatgtgctagaacccctgtcatcaaacaccacaaagcgtgagccaacctcttatacatctttctaccccttcacctccacagaagtttgtagtccccagcaatgcttgtggcatctcccagcgcagtattggtcttcgcggcgcctcccgtgacagaagaacagcactccttccatctcggtgtgtcgaatcaacctcggtggaaagaacaatggatgtgggctcccgcgtctatgtcttgttcacccccgactgccccgaatgctctcgaccccgccgccataccggtgtttaaaccagacacccccttctgttggtttttgccccaacgaggtttatatacgggcaccctgtttttcaccaaccacaaaaaaaaaatttacagaccacataac

SEQ ID NO: 722015 - DNA, 390 bp, Homo sapiens
ctcatacttgctaataacatcgataccgtgcgactcctcaacgcagtgaggtgcaacttgaagctcatactctacctttcacaacacagaagaaatcagggcagcttaaaagactactacggcagtcacttgactttggactccacacctccaggcccgcgtggactttgagtgttgatctaaacaaccatatttgatgtccccatagaccctatctcggcatccatctcatccccacttatgcttattttgcacacatcccacgccgcccgtctttacaaaaatatcattccgatttgaagcactcttagcggccacagctgagactcagatcacaatagaacacattttctggaccaaggcacatccttcagttgctgagaattacaa

SEQ ID NO: 722016 - DNA, 366 bp, Homo sapiens
aagcatcagcagcggttcacagtcgggtcagccagccccatggaactcctatcctacttcaatgcagccggtggcagacaccaggacggaggtgagggccgatgactacctgcacgtggctctagacctgctggagaggaacgctgcggtccctgtggcgaaggccattcaatgtcactgatgtgcagacgcccgcccacctgaatgtgtagtccaagtcaagcggatgcgccctaccaggacgtgggggtgacttgcccggaagccaggatcgaaatacccgcaccatcaccgggatgtgcaacaacatacgcaggcccacgctgcgggcctccaaccgagcctttgtgcactggctgccggcgg

SEQ ID NO: 722017 - DNA, 119 bp, Homo sapiens
tccgtacgtgcggtagacacagctcatcgcttactggagtccgatgcccagaccacagaatcactacgggttatacctgagatgtggccgacgagggactcgaagcacagatacaccaa

SEQ ID NO: 722018 - DNA, 346 bp, Homo sapiens
  misc_feature (1)..(1): n is a, c, g, or t
ngtacatttttgggggggacaaaaaatcagactatagcaatgaatatttagaaattaagcagttttggccaggtatggtggttcatgcctgtaatcccagcagtttgggaggctgaggcgggtggatcatgaggtcaagagattgagaccatcctggccaacatggtaaaaccccgtgcctgctaaaagtacagaaattagctgggcgtggtggtgcatgcctgtagtcccagctactcaggaggctgaggcaggagaatcgcctgagcctgggaggtggaggttgcagggagctaagattgcaccactgcactctagtctgggtgacagaacgagactccatctc

SEQ ID NO: 722019 - DNA, 150 bp, Homo sapiens
cggcccccttctggtgcaaatgaataaagagttgaggtttctgtaaggtataatttagatatccccgtggcagagtggagcggggaaactcatggtctctggggcagaaattatgccttggcggggccgccctgccaaccccaagcccag

SEQ ID NO: 722020 - DNA, 169 bp, Homo sapiens
attgcgtcaagcatgcaggtgtgcaaggcatctttgcatcagttgcagcacacattcatgcaacagttcctcagaagtgggttatgatgctatggctggagattttgtgcatatggtggaaaacggaatcattgacccaacacaggttgtgagaactgctttattggat

SEQ ID NO: 722021 - DNA, 112 bp, Homo sapiens
gttacatagtgttcatgatgtatatgcacaatttcttatccagtccacgtgagggcatctaggtgattccatgtcttgttatgtgaatagtacgtgcatgaaccacaccagg

SEQ ID NO: 722022 - DNA, 158 bp, Homo sapiens
gcttgatcttgacgcccagcattcggagcatccttctcccggcgcaggtcctccatctttttctctttctccttcagcagcctcttcttctcttctgcatatttagctttaattacagtgtcttgggctgttatcacctgtttttgcttgttccgctg

SEQ ID NO: 722023 - DNA, 268 bp, Homo sapiens
tcagacgcgcactactctgcactacatccgacacgtacaaccgcttcgagaagcgccactagaacatgtctgtacacctgtccccctgtcttcagggaccgtccagcatctggtgacactcgtcacacgtgtggcgacgtgccggtcctctgtagcaaggacagtcgcgctgtcacacgtgtctccaagttcaccaaagtctgcccggtaccaagaaagccagttccagaagtttctgagagctggtacatcgtgcccgcctccccac

SEQ ID NO: 722024 - DNA, 1118 bp, Homo sapiens
gtcatggcacacaacccagcacagcaaggcagtcacaccaagattcccctcttcccgcggcctcgccatggagaccacggacagacttgcgcgcgtccaatgtgtattcctccatcatatgctgaccttggcaaagctgccagagcatattttcaaccaaaggatacggtacggggtgggtgaaactggcatgtgaacaacacagtcttgcagtggccgtgcgcactattcaacgtccggttcatctaactacagacactggtacagtcacttgggaccttggagaaccaaatacaaacgttggtgtgagtatggcctggaactttcacagaaacagtgcgaacaacgtggataccaactactggaaaccagacaatcgcaactggacagaccagattggctcaaggcttcgacacactggaccaatttcgactactacccgttctacaccaaaatcaccagggcaccaatgcacacacgctgggtacacacttccaacgttcctttcttttaccaagcacgcgcacacacgtggtaatacaaaccctttggcgcacggacaacggatagcactataggcaaaatacggctgggatacctgcaaatccaatggcgtacacgctggacctaaggcgtcactgcaaggcatgggccatgtaggctggggagttacaccacagtattggacccctttcgtggcaccagttggcccaaactccaacagctctggacgcgtgataatacacttttggcaaacagggcgtcacacgggcgaactgcggggcattcacacagcctaaacaacactcaactgttgccccgacactggcgacccgaccattcgggcagcgcctccactttataatccaaaacaacgtatgggttcacgccatttttgacccacctccgagataccccctgtgcactctggaaatacagggtacccaacgttgtactccacggtagtcgcggacctggacgggcaaccaactcccacggtagatccccgtgggcactcgcacttctgtcgcaacagtcataacctcccgagcaacagtagcagacacaacaacaccaccctgtagcccgacgtagtagcgtacacctgtgcgtgagcg

SEQ ID NO: 722025 - DNA, 126 bp, Homo sapiens
  misc_feature (83)..(83): n is a, c, g, or t
ggcactaagttgagtccaaatcgatttcctgcaccgaggggttaaaattcagccacagagtagagggcgttaggagttttttnggggggtaatttaccttcaatccaaagctcttacaaaacctcc

SEQ ID NO: 722026 - DNA, 249 bp, Homo sapiens
gcgacactagaagacccctctgcatcgctaatccttcggggaatctagatttgtataggtagagagatcagaggaagatcttaactcaactaggtataaaaaaaacataggtataaatatcaggctaggcaaagtgtatctccaaaaatggttcgtaagatataaataggtattattaaattttttatacttgctttttagcatgttaaagtttttgagatatcctgtgggaaataaacctatttaagg

SEQ ID NO: 722027 - DNA, 229 bp, Homo sapiens
ctcgaaggaaatcggaatattccgaaattatagaaagagctgatattgtgaatatacatttagggcataggtttctcagaatggcctcctgccatccacagggttaagcactgattcaatctcggtttcgtactgtttggtatataccttgaaagcatatacacctgtaacctaattttataactaaattaattatctaaatgtacgtaactgcattataaccatatag

SEQ ID NO: 722028 - DNA, 264 bp, Homo sapiens
agtacatcgagagagctcacacttccccgatgaggtcacataatacaggctgactgcgattggtgcaaaagcggatgccaaccggaagggctcatgccaccaggccacaaacaacacaacagcatctccaggggcccaaaatgcctgtccaggggacacattctcagggaaccccttaagcaccagagattgttgccagtctcgacatccagcacgcagagcacagggaattgcttttggaaaacccatgtattctccccaagt

SEQ ID NO: 722029 - DNA, 899 bp, Homo sapiens
gggcctatctggccttcgctgcctcgacgtgcgcggatcgctctgtccctcatcggtggtgctgcggcgggccggggcggcgcggtgtcggcgcgctcgtgctgcccgagaggcgggcgcgcgcggctcctgcggaggcggggcgggtcgcggcgtggtggtgctgaccagaagccgcatggagaagctgcgagaggagagcgccgcgcgtgtcgtcctcacctcgctactcgattgactacccgccggccgcgggtctacttcctcaaagggggatatgagactttctactcggaatatcctgagtgttgcgtggatgtaaaaccatttcacaagagaagatgagagtgagagagccctcatcagccagtgtggaaaaccagtggtaaatgtcaggctacaggacagacttataaacaggttggcccagttgaaatccttcccttcctctagcttggaagtgactaccatgcatccaagtgcgagttcctcgccaactggacatcacagccctgctgaatgtctcccgacggaactacgaggctgatgaccactaaataaaaatggatcctgtggaagacagccacacggtgacattagactccactttcaagaagcaatagacttaaattgactgtgtcaggcaacaaagggagggaaggtcctggatacactgatgacgctgagatctccagaacccaacatctggcatggttacctatgaaacaaagagttcgcataaaaaggctcaataatcaagaagagaaatgctcgccattagtcatggcagtctgaaacattaaacggtcaacaacaactcttgcaaagaaagctacagaaaaaaaagctaatggcaaaacaacagagaggaaaaaaaaaaggaaaacaaaaaccaaaat

SEQ ID NO: 722030 - DNA, 104 bp, Homo sapiens
ttgctctagacggatcccttagtcaccacctcaatcactgctaagctctcttcatgtctatctgtaccacagtctcccatcttagactgtggtacagatagaca

SEQ ID NO: 722031 - DNA, 165 bp, Homo sapiens
tcgcttgggaggaggggactgtggtgcttctgatgaggcagtggagacaacaaacccccacttcatgctggtcctcagtccttccatcctgccagcccgacccctgttccacaacagcaggcccaagcctgtctttatgggtgaggagaacaaaatcttggaacc

SEQ ID NO: 722032 - DNA, 540 bp, Homo sapiens
  misc_feature (46)..(46): n is a, c, g, or t
  misc_feature (70)..(70): n is a, c, g, or t
  misc_feature (93)..(93): n is a, c, g, or t
  misc_feature (136)..(136): n is a, c, g, or t
  misc_feature (146)..(146): n is a, c, g, or t
  misc_feature (164)..(164): n is a, c, g, or t
  misc_feature (194)..(194): n is a, c, g, or t
  misc_feature (205)..(205): n is a, c, g, or t
  misc_feature (210)..(210): n is a, c, g, or t
  misc_feature (226)..(227): n is a, c, g, or t
  misc_feature (232)..(232): n is a, c, g, or t
  misc_feature (234)..(234): n is a, c, g, or t
  misc_feature (242)..(242): n is a, c, g, or t
  misc_feature (276)..(276): n is a, c, g, or t
  misc_feature (290)..(290): n is a, c, g, or t
  misc_feature (339)..(339): n is a, c, g, or t
  misc_feature (364)..(364): n is a, c, g, or t
  misc_feature (368)..(368): n is a, c, g, or t
  misc_feature (394)..(394): n is a, c, g, or t
  misc_feature (402)..(402): n is a, c, g, or t
  misc_feature (409)..(409): n is a, c, g, or t
  misc_feature (439)..(439): n is a, c, g, or t
  misc_feature (444)..(444): n is a, c, g, or t
  misc_feature (476)..(476): n is a, c, g, or t
  misc_feature (538)..(538): n is a, c, g, or t
tgacacccaccgcaactttttgtttcatatcacgaacagcaaagcnacccaaaggtggatagtttgagangctctcaacacacatgggcttgntaggtaccatatcaacaatggcggcatccccagacttcaaganttttgggccntcttccagcttttttccngaacggcgatcaatcttttccttcagctcngcaaacttgcntgccntgtgagccgtgtggcnntccantncaggggcntagccggcgcttatttggcctggatggttcgggntaatctcctgagcngtgaagccagctgcttccattggtgggtcatttttgctgttcccagcancgttgccacgacgaacatccttganaganacattcttgacattgaagcccacatngtccccangaagagnttcactcaaagcttcatggtgcatttcganagaanttacttccgttgtaacgttgactggagcaaangtgaccaccataccgggtttgagcacaccagtatccactcggccaacaggcacagtgacaanac

SEQ ID NO: 722033 - DNA, 307 bp, Homo sapiens
gacgtctacagcagtctgagttacaatagcaagccagcttgggaagagcaggtagaagaggatccaggatgggaacagcagggcaaggttggaggaggagaagtttgatgccttggtaacctggaaggaaggactttgtgactggggtagggagtgagagagaggagagcagatgaacacaggtgcacgacggccacgatcacgggcgtggcgacgcgacggacgacgcagatgacaccagacggtgccgaacggccacgatcagggtaccctggaaggacacgggaccttggtgacctggggggta

SEQ ID NO: 722034 - DNA, 575 bp, Homo sapiens
caggctgcggtaatgtgaaccctccaggctgctttgcagtgcgctttcccaggctcggggcagctttgctgggttcgcatctatcccttggagctctgtgagttcaggatgcctgtcagtcacacaggggagctgcaggttgtggtggtttcatcacttgctgctgtgtgacctaggcctgtccatctctttggtggtcaatttcgtcatctgacaagtgaggggaatgagcttgactcagtaggttcactgtttcgcgcagctgggagagaggagtataagatcaggggagggcttggtgaagtcaagaggcagggacagggccaggcgcagtggcccacacctgtaatcccagcacttggggaggccaaggcgggtggatcacctgaggtcaggagtttgagactagcctgggcaacatgatgaaacccccgtctctactaaatatacaaaaaaagccaggcgtggtggtgggtgcctgtaatcccagctactcaggaggcgaaggcaggagaatcgcttgaacccgggaggtggaggttgcattgagccgagatcaagccactgcactccag

SEQ ID NO: 722035 - DNA, 274 bp, Homo sapiens
aaaaaaagggggttttcccgggtggggggggggggttttaaacccccccccccgggggggccccccccccgggcccccccaagggtgggggtgtaaacaaaaacccccccccgggggtttttttttttttttttttcccggggggggtcaaaaggggggggtttttttgggggcccccccccctttccccccaaaagggggggcccctttttcccccctttttttcccccggggggggttttttaaccccaaaaaaaattgcccctggggggga

SEQ ID NO: 722036 - DNA, 410 bp, Homo sapiens
  misc_feature (13)..(13): n is a, c, g, or t
  misc_feature (58)..(58): n is a, c, g, or t
tgctggcttcccntgcgcaaccaggggtaccaagtgtttgcgcagggaggccccgccntgggacgccccttttagggacccaccctttaaacaactgcttttaggggcagtatttaaaacttttcagccctcggggcccccctcggagggtgccctttggtcaggcctccctagcacctcccccttaccaaattttccctgggccccctttttagcccccccctccccatgggagggggggccccaatttaaggccttccccgtcaaaagggggttgtggccaaaaccccctttccaactgccctcccccccccgtttcagtgggccctgtggcccggggcttttccccaccccccggggggtttgtgggggggggcgtgtgcgtttccataaagtttgtcccctttcca

SEQ ID NO: 722037 - DNA, 295 bp, Homo sapiens
  misc_feature (17)..(17): n is a, c, g, or t
  misc_feature (23)..(24): n is a, c, g, or t
  misc_feature (31)..(31): n is a, c, g, or t
  misc_feature (123)..(123): n is a, c, g, or t
  misc_feature (159)..(159): n is a, c, g, or t
gagcctccacgcccggntaattnnatatttnaagtagagacggggtttcgccatgttggtcaggctggtctcaaactcccgacctcaggtaatccgcccgccttggcctccaaaagttctggnattacaggcatgcacctccacgcctggctaattttntattttaagtagagacggggtctcgctatgttggtcaggctgatctggaactcccaacctcaggtgatccacctgcctcggcctccccaggttaaggcattctaacctacaggttgagataggaggttggcacaag

SEQ ID NO: 722038 - DNA, 482 bp, Homo sapiens
ggtacgactgcagcaaaccactctggagcacgtttaggaatgtaacacacctgcacatcctgtgcatatatccctcaacttaaaagttggaaataaaaaaataaaaatgaattggctttccatttacccctttgattgcccttacccctatccatatgtaaagcagcagcagggtggtgattctgaatgtttcacgggagcagttaaaaagacacaatgtgggccgggtgcggtggttcacgcctgtaatcccagcactttgggagactgaggcgggtggatcacctgaggtcaggagttcgagaccagcctgaccaacatggtgaaacttcgtctctactaaaaaatacaaaaaaacgaccaggcgcagtggctcatgcctgtaatcccagcactttgggaggccgaggtgagcggatcacgaggtcaggagatggagaccatcctggctaatatggtgaaacccatctctactaaaaata

SEQ ID NO: 722039 - DNA, 822 bp, Homo sapiens
cgcggtggctcacgcctgtaatcccagctctcagggaggctaagaggcgggaggatagcttgagcccaggagttcgagaacctgcctgggcaatatagcgagaaccccgttctccagaaaaaggaaacacaacacaaaaaaaccaaagggacaacaaaaaaaaaacaaaaaacaaaaaaaaacactgtgtgtgtggggcgcgcgcccgcgcgcccccccgagaagaaaggtttcttagaacccccattggggtgtgtggggcggcgcggggcccccagagatggtgaaagggagaacccggggcgccaacaagcggggttcccaaggggacaactcgggcggccagcagacggaacgggggtgggagagtctccccacccaaattaaaaaaagagcgccggggggggagacaaccaccgggcgcgcgtgtcgcgagaaacaaacctccccaagagagggcgagtctccgagggagcacccatacagcgagggcatacatcacaaaaacgggggcgtcccacaacgacgagcacgtcggatattatcaaaacattaaaccccgcggagcaggggggggggaaccaacagcacaggaaagcgaagacacagaacaaagaaagagagcagacaagtgagacgagacaaacgcacaccgacaaccaccaatcacatgaacagacaaacgaagcaacacaacgtagacaccacaaacgaagaaccgaacaagcccaaacccacaacaagcacaacaaccagagcaactccacaacacagaacgccaaccagcacacacgcacagacacgaccatcaacaacaaccac

SEQ ID NO: 722040 - DNA, 130 bp, Homo sapiens
gaagcccagggccacaggaggcctctgggcgaaggcagaggctaacatgacgcatcggaccgaccttgaccgctgacctgaccatctttgagctgacctgcggcactatcatcactgcttcacctgctcc

SEQ ID NO: 722041 - DNA, 479 bp, Homo sapiens
aagtctaagtgactctaagatctcgatcagtgcattgtgttctacctggactgtgtgggtgacaaagacaaaacttttgaagactatacttcagggatcatttctgcagtaataccatttgaccagcatccattgctgggtatatacccaaaggattataaaatcatgctgctataaagacacatgcacacatatatttatagtggcactattcacaatcgcaaagacttggaaccaacccaagtgtccatcaatgatagactggattaagaaaatgtggcacatatacaccatggaatactatgcagccataaaaaaggatgagttcatgtccttagtagggacacggatgaagctggaaaccatcattctgagacacctatcacaaggacagaaaaccaaacactacgtgttctcactcataggtgggacttgaccaatgagcacacttggacacaatggcacgtggatcgggtacc

SEQ ID NO: 722042 - DNA, 451 bp, Homo sapiens
ctttctacacagtgacattgttctcaagagtaacatgtgagagtgccaggcgaaggattattctttcctcccacagagagccaacaaccgaaagccaacacaaagccctcattctattttactatagtcaactgttgttgttgttgcatataatatttatacaaagaaatgtatgttatatataaaggcagagtctaggcaactttattttgaactgtacatacccatgtgcataccagcacccagacggagcccaaatatatatatatatatttagcacccaagacacctctttcaagccatgtgcccacctcaggaaatcaccatcttgactttgaacaatgtcaatgagccattctgttttcctgttatttatttatttatttatttattcattcattcattcactttgcattctaatttcagccctccttcctccctccgtcgacgc

SEQ ID NO: 722043 - DNA, 492 bp, Homo sapiens
gaaatcttcctgaagacattcctcatttaacagctacttcctgaacaccactgtgcttagaatgttgaattattgaattcttacatatttacttcgatgagcaatatcacaatcatgaaaactgtatcattgcctggggaaatagaatgtgtttgttggaacttaagtggttctcttaaatgtaagaaataatacctttagcatctatacagttgattatgtattttaatgtatgagttatttccaaaagaaggtatcatattaaccatgaataacttttatttttttaaaaaattgaaatatcaaagcatttctttattcatttgatatttggtgcttattttggttcacacacttttctaggggcacaagaaggaaattaatgtcatttaggaaaatgtcactttatttttgtttcatttacctaaattcagacatccaaaaaatatgtaagatatctaaagacaaaatctcacagaagatgtgcaagtc

SEQ ID NO: 722044 - DNA, 600 bp, Homo sapiens
ggcgtgagtcaccgtacctggcccaccccactttgtttgtttttcttgttttaaatggttgtttatttatttatttatttatttttcgagacggagtctcgctgtgttgcccaggctggagtgcaatggtgccatctccgctcactgcaacctccatctctcaggttcaggcgatttcctgcctcagcctcctgagtagctgggcttacaggcacccgccctcacgcccggctaactttgtgttttggtagagatggggtttcgccgtgttggccaggctggtctcaaactcctgacctcaggtgatccacctgccttgtcctctcaaagtgatgggattacaggcataagccaccgcgcccagcctaacctttttttttcatttatatttttcagcacgccacttaaaattttttttaaattctgattaagtatatataacattaaatgtaccatcttaaccatttttcagcacacagttcagtagtgttaaatgcattcatactgttgtgccaacaaacctctgggaccttttcatcttcccaaactgaaactctgtacttatcaaacaaatccccattcccccctgcctgaacccct

SEQ ID NO: 722045 - DNA, 122 bp, Homo sapiens
  misc_feature (3)..(3): n is a, c, g, or t
  misc_feature (61)..(61): n is a, c, g, or t
  misc_feature (81)..(82): n is a, c, g, or t
  misc_feature (93)..(93): n is a, c, g, or t
gcncctcgggctcggctcgggctccgggatgtccgcactgtgcaccctcccggggccccanggccacctgggcctcccccnnccacccaccgncccccccctctcagtcctcaggacctctc

SEQ ID NO: 722046 - DNA, 224 bp, Homo sapiens
ctagggtgcaaccataagctcagtgtagcctcaaactccgtgggcacgatcctcctgcctcagacctaccaagtagttgggactacatggcacacagccatcatgcctgactaataatatttacatatactttttaaagagacagggtttcactatgttgcccaagctggtctcaaactcctggcctcaagtgatccgcctgccttggactcctaaaatgccag

SEQ ID NO: 722047 - DNA, 295 bp, Homo sapiens
tataggaggtgagtggtaatggacttgtctggaattagatgatccagacatttatgatgtgtcacataactattctggattataaattgtacactttacagacacatgattggccaggctgcggtggctcataactgtactcccagcagttcgggaggcagagggaggaggatcactggaggccaggagttcaagactagcctggccaacatagtgagacccggactcaactgaaaaaaaaaaaaggtcggccggcggtggggccaagcactggtattcccagcaactcgaaagc

SEQ ID NO: 722048 - DNA, 593 bp, Homo sapiens
atcgggactgccgctgttatcacttccatgggaacgatggacaggacacacccgtgctgcgtgagctcccagagccggtggtggctacgtttcatccgcatctacccactacagctggaatagcagccatagtgcatgcgcctaggaggtgctagagatgctactgtggcccctgtctacagctactacgcacagaatgaggtggtggccaccgataacctggattaccggcaccacagctacaaggacatgcgccagctcatgaaggtggtgaacgaggagtgccccaacatcacccgcacttacagcctaggcaagagctcacgaggactcaagatctatgccatgaagatctcagacaatcctagggagcatgaactggggaagaccgagtaccgctacaatgctgggatccatggcaacgagatagctagggccgagagctgtagctagctgctcatgcagtacctgtgccgagagtaccgcgatgggaacccacgtgtgcgcagcctggtacgagacaaacgcatccacctagtgccctcactgaaccctgatggatacaacgtggcagcgcaacatggctcagagta

SEQ ID NO: 722049 - DNA, 83 bp, Homo sapiens
gcctgtattgaggctcttatgtgttgtgtctacctacatactcgtttctctttagaacaataaacattgtcaaacgacaaaaa

SEQ ID NO: 722050 - DNA, 266 bp, Homo sapiens
aaaaaaaggtggggggcgggctccgtcccccccagccttttggtgcccttggttaaaaaagccggccaactgggggcctcccggttgcccttccattcccccagaatgacctgatgaggaaattttcaataggatgcaaagatcaatgccaaaattgttatatatgaacatataactggggtcgtcaaaaagcaaattaaaaaaaaattgggcgttagaaggtgtcatttaaaacagccttttaataaagttgtttccaagctgga

SEQ ID NO: 722051 - DNA, 206 bp, Homo sapiens
gcttgttgtgacgctgcacctcgcgttgacctgagcctgcattctgaactgcgatgcgtgacatgtatgagaagatggcagagaagaaccgcaaggatgccgaggaatggttcttcaccaacgacagagacagctgaacctgcgaggtggccaccaagcagctgagctggtgcagagctggcaacgagcggagatctctggagctc

SEQ ID NO: 722052 - DNA, 258 bp, Homo sapiens
ttgtttcatatcttacaatcaggctctgttaaaatatatagaaaggaaccatttctttgaacttcttctagtccttcctagatcttaatcaatatggttagtaaaacaaagggtgtttagatcaattcataaccttcctgaataagtgcattactgaaaagcctgttggccaaagcaaactcacgcaaaacaagcttaaaaaaaaccccaagtttgtttcaatttaaagcattggtagtttttgtaataactacgctt

SEQ ID NO: 722053 - DNA, 763 bp, Homo sapiens
tagagcaaaaacaaacgaaaacatatgctagtacgaggctcggtgtctgtggtgtgcagatggtctcgtgcggttactatagccaagatgcctgaggaaacccagacccaagaacaaccgatggaggaggaggaggtatgagacgtatcgcctaacaggcagaaattgcccagtatgatgtcatatgatacatacaatactttctactcgaacaaagagatctttctgagagagctcatttcaaattcatcagatgcatatggacaacaatccggtatgaaagcttgacagatcccagtaaattatgactctgggaaagagctgcatataaaccttataccgaacaaacaagatcgaactctcactattgtggatactggaatttggaatgaccaatggtctgacttgatcaataaccttgtgtactatacgcacaagtctgggaccaaagcgttcatggaagcttatgcaggctggtgcagatatctctatgatttggacagtacggtgtaggttattataactgcttatatggtatgcttgagaaagtaactgtgatacaccaaacatacacgatgatgagcagtacgcttgaagagatcatcagcaggtggatcatacacagtgaaggacacagacacaggtgacacctaatgaggacgtggaacaacaagtatcctacacttgaaggaagagcaactgagtaatgaaggaccgaataatacgtgaaatgtgagacaaatcacagcaaggaacccaaaac

SEQ ID NO: 722054 - DNA, 269 bp, Homo sapiens
  misc_feature (63)..(63): n is a, c, g, or t
cagggctgattacaggccttgcacagaataattagccaaacaatctcattctttacattattnaaacagtaatagcttgagacaacaatctggtatttctagagaatgtgcaagtcaaattgtaaagacttgttctgaatgtcctcagtttcttcctgtaccacacaatggtgttaattctcgagaactcgtacctaatcaattatggcaaatggatgttactcatgtttctgattttggaaaattaaaatatgtacatgtgactattg

SEQ ID NO: 722055 - DNA, 1233 bp, Homo sapiens
tggggaggaggggagtgtcaggttaaatggtcccagtcctcgggcgctgtccagcgcttgcaaggccccagggccggggtcggctcactctcgggggtggcgggccgtgacccggccttcattcaggggccttctccgggggagggccggtcccggtcggtccttcggggcaccagcttccacggtccagcttccatgttgccccatggtaagagggcccagggggcaacggcccaagagagcgaggctggggcgggccaagcaaacggggcgcccggggcccaaggtgccgggggcccccacaagggtcaagcgtggaaggggtcctcggaagcggccggccagaggcccaaggggtgtaaagagagggcggctggggccccaaacaccaggcaacaggggcgcggccacatgcaggagaaagacacgccataatgcgcgggggattcccgagaacccatgtgatacactctctgtgcatttgagaggggagagatagagccccgagatatagctcacgaaagtgccccgagagagagggccccaaattggtggggggaaacaccccgagtgagagagagagaaagaggggcgtcgatacatgcgagtaggcggcacatataagagcagggaagagggaaaacccccgagggggcgtttccgcgcaaaaaggaaaactcaaaagatcttgcgggaaaccaactgtggggggggggccggcgaagaagaaatgccccccctggaggacagacaaggggaaaacccagcggttgtgcaccgttgggagacgcaacaaaggaggaccccctcgggggggtggcggggcccccacctgtgacatccacgggggaggcgcccgggcataaaaaaagcggcggagcaatagataacggcgagaacctctttcccggggagaaaagtgggagaaaaacacacgtggaggacaaaaagctggataaacgaggggcgccgcccggaaagggaccccacaacacaacaacgatgaagaagagggggccccaacaagcggtggggagctacaacaagaaaaacatcatcccccctgtgggggaacaaagatggtgttggccccccccagaatgggtttgtcacacacacaaagaagtgcgccgtggtggggggaaaacactccgagtggaggattatgaacgacacgcggcaggagggtgcgtccaccaaagcagagaagaaaaacgattgcgtcccccaaat

SEQ ID NO: 722056 - DNA, 420 bp, Homo sapiens
  misc_feature (35)..(35): n is a, c, g, or t
  misc_feature (167)..(167): n is a, c, g, or t
  misc_feature (389)..(389): n is a, c, g, or t
ggcacgaggttgctgattcccttagggagcggcanacgggaagagtggttcttttactgtgcccccgcccccaccctcagcctaggggtatgtttctcccagcctcttgtccaacttcacaccccatttatatgctgttgagaacccagtctccagggagccagagnccccactcccagtctctctcagctaagctctctaagctggcctgggttctgagctacatggaaggcagagttctcaagcccttgttttatagtttcccccgaaaccccttgtaagggtctgagacaatacaaagtcagactcttgagacaagcacatctcagcctgaatctctcaacaacctcatttggcaagcaagaactgactgactgtgctgtgagtcntggagacactccatgcatggccctgctcttt

SEQ ID NO: 722057 - DNA, 847 bp, Homo sapiens
gtgcgaggctgtgtgttgtgcccctccgttgcgcggattcctaccatgcaggggcacacttccccgcgtttgtgagaagaccaggtcttctacaaattatggccccggggcctgtttcaaacgatccaggtacaccgacggtgtgcctcactgtggtgttcgcccgccgccatgacagacctctagcaacgaggtggtcccccaaagccgcggttaacagacaccggggtgtttataccaagccacctctcggattgtcctaaccttgaataaactgcccgaagattagtgcaaccaccaagcgggcccctccgcgtatttgtccaccgggggtgacacctaagatccagtactgtgaccctgttctcgtctatcgaattggtgacgggtacaccccccccaaccgtgagaagaagtatcggtggtgcgagcaaacacgccgagcaagcgtacggatatattttcgcgcgacgccgcaagaaagcagtaattctagatagagacaagtgagtatttctatttctttccggtagggtaacaaaccaaggtacagggctaccacttgtgccatggcttttaaaccccctatagagcagataataataatggacatttgttattctgtggtagccagctgtgcgcgcgacagttacaaaatagcctctcgatggggaacgccctctgttgggaagacgacatccgctcaaccttatagggtaacagggaggggcacgacccaccgtgcccggtgaaaaggacgtggtcgcccccactttcgtgacatgagataccgcctgcgtgccgagaaatcgacgtacaacatgactccccggccaaaacatagaca

SEQ ID NO: 722058 - DNA, 430 bp, Homo sapiens
acacctagttgctagcacactaaggaaagcacttattagcactgaataaagtaaaatggcaagcacttttactaatcgacaaaaacaccttctcatgcattatcagaaagcttttataatacaaggaggcatattgctcagtcagaaggagttctataagacaagcacttactaagttagcgactcacagaacaaccagtataaagatgaattaaagtgcccaaattggagaggcatggcaggtgtacgagaaaggacaagctaaagaaaacatttcctgataataccaacctttcttacatcatctactgcatttgacagaaattacccttttagggtcaaaacccgtgacactttcataccttgtacactgtcgtgtcaatctccacttcgtctatagtacaaatactgtctttgtcctttgatcaca

SEQ ID NO: 722059 - DNA, 127 bp, Homo sapiens
atccatccagcctatccatccatccatccatccatccatccatgcatccatccatccatccatccatgcatccatccatccatccatccatccatccatccatccatccatgcaagaagggaggtcg

SEQ ID NO: 722060 - DNA, 354 bp, Homo sapiens
ccctggaattacaaaagttgtcttttgaatcttttaacagacaaagaagtaaatattgtattgccaacacagtccattgttccaagaacttttgagcttaaaccaggaatggctctgtttttgtgtgctataggccgcatagatttgctgtagggaaatcagacatcttggtttacagacgtggcttccaacatactccctgtgcatatcacctccttggacagggcatacgctctgtatcagaagcatgcatgttatacgttacttcagattccaatgggtggtgaactgaatggcaggatttactactcttgttgctgaagacattatgttaggttgggtttcagtaaccct

SEQ ID NO: 722061 - DNA, 295 bp, Homo sapiens
ggggagggccctttaaaaaatttttttccccaaagggggttggccccccagagggggtccccttcccccccaggggggggccttttttttttggttaatttttggaaaaggcccctggtcccctttgtttggtcccccgcttgggggcccccatatgggaataaggggggccccagggttccccccccgggccccttttttttttccccaaacttccctttttttttccctttttgggtttggttttgttttcccctttttcccccccccccccctttaccccctggttaccgga

SEQ ID NO: 722062 - DNA, 326 bp, Homo sapiens
tgggtcatcatgacccatgcccgcaccatgggggctgcgataccagagactgaacagacaggtcctgcgagcgaggacatggacatagggctatcaacctgttccacggaaagcagacaatttcattagtagatgtctttctgacctcccaacagttctgttcagcctcagacttcgtgagctccacaatgtctccaagggttgagccgtagaaaggggtccaatggcatccagggggtgcaggaagcccgtagtatacctgaaacacctccatctggggcagcaccagctcattcatctttttgtcctgagcccttgcaatgtcg

SEQ ID NO: 722063 - DNA, 189 bp, Homo sapiens
cgctctcaccacccctctggcacagccatgggcacagtcacacactccggtgcagttgggccgtagcggcccagtcacacacctcacaggcgttcatggaagcctcgtgcagtggcactccccgctgcccagtcgaacctgtcctaggcatctgccctatggccttgagcacaccccccctagaccccc

SEQ ID NO: 722064 - DNA, 326 bp, Homo sapiens
acaaagatgctggaaagatcatgtatggacaagcatcatgacccagacaggttagtgaacctagcagttacaaggaggaaaagttaaactaaatagcagaagttacttattctttcaagaggtcagcctggttctgggaacacaacattgtctcgaattctgcttggtcagaagtcgtgatggcattgtgttcagcactgatgactattttcaccatcaagatgggtccaggtatcatgttaatcaactatggtgatgcccataactggaaccagaacagtggtaagttaagggctaagtgtcccaggatagggcggatatattga

SEQ ID NO: 722065 - DNA, 294 bp, Homo sapiens
cgagctcgttacccctaattggttcttcgatgacgtcagcactacgttgccagtccacacatttcccccctttggcagtcagttaagtgccttttcccagtgagtgacttcaaatgtgacttcagtatccctctcaacatttgcctctaacaatcatgtctagcactgtgcctggtacatagtaaacactgaatacatttttatggagtgaataaacttggcacgcaagatggaatctattttcgatctctgccgtatgtcaaagtaaataaccgtcatcgaagaaccaattag

SEQ ID NO: 722066 - DNA, 569 bp, Homo sapiens
  misc_feature (26)..(26): n is a, c, g, or t
ggacttgttcttgctgagcactctgnctgccatgatggctctgggctggtttcacaacgtccggcgtaaagtgttcctagaggcttcagtagcagcattgactgtgttgcgccatgttgggactggacaggtctaagctgttgaggtactctggccaggtcattaaccagtcccttcttcaggaaaagccgaaggatgttgttcatgccattgtgctgggtcttcgctgtggcactgctgtataagctggaggtggaggggcaggactccatgatagtactgatgatacacatcactgcctgaagcctggcatgtttctctgtactctcagccatagccagtgcccgtccaagggctgcttttacttcattcactagggccacctggggcatctgtgccactccctgcagcagccaggcttgcgaggaacaggcgggccaaggcaggggtgtccttgtcttctgcattctgggtatgtgggagcaggtggtccagaacaaaagctatcacactgcagtcctctttgatccagtcagactgcgcacaggtgtatctgtagtttgcatcac

SEQ ID NO: 722067 - DNA, 263 bp, Homo sapiens
aggcgcgaatctgtcattctacacagcagtcccttcccacatgctagtagggaagggaaagcatgatagggaggtccactttgtggagtcaaagcttgatgggaatgttgagcagtcacaacgcttctcagaaaaggcacggcaccccagacatgcagtcccggcgaacaggctggctcagcagatctgcacgatcggatgtctctgagcccttcttcgggaaggaggaccacagtagaagtggggcttggaacccaggccag

SEQ ID NO: 722068 - DNA, 131 bp, Homo sapiens
  misc_feature (31)..(31): n is a, c, g, or t
  misc_feature (64)..(64): n is a, c, g, or t
  misc_feature (70)..(70): n is a, c, g, or t
  misc_feature (101)..(101): n is a, c, g, or t
  misc_feature (108)..(109): n is a, c, g, or t
  misc_feature (119)..(119): n is a, c, g, or t
  misc_feature (122)..(122): n is a, c, g, or t
  misc_feature (130)..(130): n is a, c, g, or t
gtatccttgaccgcacgacaaggagtaatgngcggacctgaacccgcgacgaggggttgggggncaagangcctgggtcggaccttaaggatttgggagtntagaaannaaatgggggnganagagaccna

SEQ ID NO: 722069 - DNA, 454 bp, Homo sapiens
cggatgggtgatgtctgagggcctcacgaaggagtacgaccgctggcgggaggagcacgcaaagcggcgggctgcagtagagggtcccagggacaagaaggaagagtaaggggcctccttcctccccgtgcctgcagctggcttccaccgggcacgtgcctgctgcttccggagagcccggcctctccctccagtacttcggttggtgcccttctgcttcccccattcccttccacagctcatagctcgtcatctcggccctggtccacactctccaagcacatgagaggggaccggatggctacacgtacagaaggcgtgggctgtcatccggctgggccgggccaggccgggcacagccttggcttccacgcctgagcgtggagagcacgagttagtggtagtcgggctggggggggggctgacttcgtgtgggtgggaggggtacggagct

SEQ ID NO: 722070 - DNA, 918 bp, Homo sapiens
cggccacaaaaacagaacacctgggcacgctagcctgtggtcaatttgacataacagtggtctgtacgtctccttaatgaagcaacaatgcaccataaatgtccgggattagttgaaaaacgtcatccccatttagtaaggcagtcacagtgtcaaaaatgaggatgtgtctacctattcttttcaaacattggggtgcagacccagatcctggagggatatcttccgttattagattactgttcatccacttatgctgttttgtggtcaaaagtcttgttcatttagttttgccaacaactgctttgaatacgaaactcgatcttgtcagtcgataataatacaggtatgggtatactccactagtagttgccgtttcttaactataatccaataatggtgaaaatttcgtttccggagaaaggggctgatatgaatgcttcagataattatcaagagagacagcccttatttgcttgctgatcagtggtgaaccaccatgtttagtaaaagcttcttttttcagcaaggtgtggaattatgttacgaagatagatacccacaattcagctgcgagccatggaaagaagaaacatgctaaattagacaccttattctggcactacatgcgacttaaggaagatatggaacccatttctagccagttctgccgcttccttgaattggacacaatgtactttggaagcaccgtttagtgaactatgatcatatttcttgcggacttacccagttgagagaagaaagtttgttaaattggatgggactttttttttttcacgttagaagacatgaagtaattttaaaagatcaacatctatattgtgaaccattcagctgaaaagataaatttgtgttcaatatataggcagtataaaatttgtgtcaaatgtgaaatac

SEQ ID NO: 722071 - DNA, 206 bp, Homo sapiens
tggggtaattagcacttaattttaattaaaatcaacagttcaaaaaaagaatgaccaaaaaagaaaaagaaagagaacaaaaaattaataaaaggaagagggaggaaaaagcagcaagaggcaacgtggtaaaaagaattacttggcaagaagaaaagccaaaagaaaaaatactcaagcagagtggttaaaaaataaaaaaaagg

SEQ ID NO: 722072 - DNA, 1090 bp, Homo sapiens
  misc_feature (326)..(326): n is a, c, g, or t
  misc_feature (1090)..(1090): n is a, c, g, or t
agcgggttcttcttctggcttgccaccatgccttccactgctgaggcatgacccggtagacactatcacgggcgcccagcgattagtccacttgtcctaccggcctctgtatggcgatgctcctgcacaagcgccccgagactgaccgcctgtatgtgttgcgtgcgtctgctgtcatacgaccggattcaatcttatctgataaaactagccattccatagctacattctgtggcacaacgtccgagtgatggacacgcgattagccactttacaaggaagcgaacgcttgagctttcctgccgcaattgtcacacctatgaccnaagttgattgtggcgttctgggtcgcgtgcacaccaggacttcgcggttgagcctgctgcctaggggcactgacgacttggggcctggttctccagtccattgtttgctcggtgcgggttcagtgcgctacgtacccaggttcctgggagcaggggaggatccttccctccatagtcgaccccttgctctgtgccgttgtagcgcggcccgtcttgttactttgcacggctcggggagcgtaggctcgatgggagagatgagtttaccgcacgttgctctgcgggtgcgcgtgccttggtgttcccgtttggattgggcttctccgaatggggcgcggcggattagccggggacccgttttacagctttaacatgttggcattatccttaacgttttccatttacaccttttgggagtgcctagcggagaaggttggattcgtttacacggcctttgctatcgccattttcacgaggggcccgccaataagggggtggggcccttccgtttacaccattctcaggaagaggggcgggtggcgccccctcggtgtcacccccacgggcttttgttaggttgctccgcgccgtaattaaagaggggagcgcggggatgaacacctttgtccagaggaccgttggggggcgcatacaggtcaaatcgcggggccttttaggggttgccccccctttaggtgtgaagaggggttttggttatttcccccgaggccttcacgggggttttccactcatatgtacattgn

SEQ ID NO: 722073 - DNA, 122 bp, Homo sapiens
ggatttcaaggatgcaatgacctatgatcatgccactgaagtccagcctggggtaatacaccttccgggaggtgatgaccaatcctaaagctgtacagtagcagagaggaaggtacctctga

SEQ ID NO: 722074 - DNA, 1205 bp, Homo sapiens
tactaacaacaaaagtttatggggaaagtaaattaaaacaaaacaaacaacaacagtagggccaaggggggcaaaagcaatcctggtgtaggcttaagggcgaaggtttaaagtgggagagatgagaatttaagaaaaagatgagatggcaaggatgtgtaatttggtgtgtaaaatataagattatgagaaaaaattatcaatttgggcgttcaataatcttaaaagaagagatagttttctcaagagcgcgtgtgcaccacacggggagaaaaaagagggcgctcgagtgcactcttatagaggcgccacgcttataacacacaaacaacagaaaacccagcgagggggggcgaaaagtgcacagaacaataaatactccgagatatattctcactatatagaggagagtgggttaacacggaggacacaattatttaaaagacagcaccttgtggagatctttatattacacggggggggggacacgagcaaaagagcgccctattaaaactaacaccacaaaacatgagagagggcaaaaagatgtgtgctacaccaacacacacacgagtgggatatatattataaaaaaccaacaaaaaaaaaaaacaaaaaaaaagagagggggggggccgcgcgccaaaaaaaataaccccccgggggcggtcgcccaaaaaaactttatggcggcgtaccccgcgcgcatatttgcgtgtgcaaaacaaaaggggggggcccccaaaaaaagagagaaaaagccgcaaaaaattaataagcgacacaaaacgccgaggaggcagcaacgagatacaccaaaaaagaggctcgaaacggggagcaaacacagctgggcgctacgcgggggggaaccaagggggagaacacaggagacccccctaaacacaacggagggggggaggacacccacacagtgggggccaacaacacctccccaccacaaagacgaatacttaaacacgccccacacagcagcaacaacataacaaccttgcaacggaggggtacaaagggggggggggacaaccaaagcgcgcagcaaatatcgtgcaccacgcgaacagactagaagagaacgaaaaatgtgggggcacaaaagaggagaagcaacacaataactagacgaagagaaccacacacttcatacacggggagagaacacacagtcagcgctcgcgcggggg

SEQ ID NO: 722075 - DNA, 279 bp, Homo sapiens
  misc_feature (89)..(89): n is a, c, g, or t
gagtacgcagtcgttgtcttggtcacctgcatccatagccatgtgcttgtcctgtgctccacgttcccagggcaggtgggagccacagncaccccactatgccgcaggcgcctacccaccttcaggcagcctatggggcgcagggccccatctgtccctcgggagcaccccacctctgtgtgtgatgtagctttctctccctcagccttaagggtccgatttgccatcgaaaaagacaacctctacttttttcttttgtattttgataaacacttaagc

SEQ ID NO: 722076 - DNA, 151 bp, Homo sapiens
caggtcctggctagctgcattgggaattggacccctgatctcccacgccatgattcctgtggacggagatcggcagtgcctgcagctactacaaccgggagaatggagaatccatgcgagactggatctcggccgaggaaacactcattat

SEQ ID NO: 722077 - DNA, 247 bp, Homo sapiens
agctaaagaatattatagtagtcatgagtgaggttggcttagatgtgttttcaggtgataattaatggttagcatcctaatgtagagttgcctcaggtcttcctgcgatttgttaggggcggcctagagtctcatcaacattgctcaagttgattcaagagaaaggagggtggtagttataagataagtgacagaccaaatattagaatcattttaaccattatttattgctccaaagcctgttagg

SEQ ID NO: 722078 - DNA, 123 bp, Homo sapiens
gttataatacacagcggatggtcggaagcttatgtagtagcccgggtggaggcgtgccagaaggtgcttagcagcatggtccaggcgctccgcaggacataggaacgggcaggtgcgctcttg

SEQ ID NO: 722079 - DNA, 839 bp, Homo sapiens
  misc_feature (839)..(839): n is a, c, g, or t
ctgaggtagaagaatagctggaacccaggaggcagagattgcagtcagccgagattgcaccactgcactccagcctgggagacagagcaagactgactcaaaagaaaaaaaatgacagaagcctgtctcctccgggcagtctgataatcaggcttcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacatttctgcccccaccagaaactccaggggtccgcccgttatgccgtggccaccacgcccctttggatcaccagcagtcacagacaacaggcaggcgaaaactgaagaccccaaactcagccccagcggacccttccagagcaaaaggaggcccccgggcgagggccacctgtctggcaggcatgtccggaggtcaaacagggcggggcccaccgttcccagctgggccacgacctggcccgtccacagatgggctttgagaatgggttggttcaccgatgggggggtgtgggtttgggccaaatggtcttgggcccgaccctctctgtaagggattttggtttcccttgtggcccctgggctcgtcttaaccctcccaatttctgtcgn

SEQ ID NO: 722080 - DNA, 106 bp, Homo sapiens
ctccatgttgaccaagcctctacaggggcctcccgcgtcccccgggacccccacggcggcggcagaggcaaggatcgggaagcttcgaggccgagtatcgacttgg

SEQ ID NO: 722081 - DNA, 151 bp, Homo sapiens
cctgggttttttgttttttggaggggtgaaccgggggttgtttgcggggaaaaaataaaaaaaagcaggggccgggtttggtttatttttgtatttaccccccttccgcccaggcccccgcccctttggtcaataaacattccgccctcca

SEQ ID NO: 722082 - DNA, 387 bp, Homo sapiens
  misc_feature (219)..(219): n is a, c, g, or t
  misc_feature (223)..(223): n is a, c, g, or t
  misc_feature (240)..(240): n is a, c, g, or t
  misc_feature (270)..(270): n is a, c, g, or t
  misc_feature (273)..(273): n is a, c, g, or t
  misc_feature (279)..(279): n is a, c, g, or t
  misc_feature (311)..(311): n is a, c, g, or t
  misc_feature (318)..(318): n is a, c, g, or t
  misc_feature (328)..(328): n is a, c, g, or t
  misc_feature (345)..(345): n is a, c, g, or t
  misc_feature (373)..(373): n is a, c, g, or t
gcgccccttcgcagccgcattgatccctggagctttgtgtcagctgggccacggctctctcccctgccatcaccacagcctgcaccccgccgagcaccctggaccttgttcccggactcagaccccttctgggactccccacctgccaaccccttccagggggcccccaggactgcagggcacagaccaaagacatgggtgcccaggccccgtgggtgncggnaagcggggccttgagtnggccaggccacttcccccgagttccagctnttnttaggnaggagtcacagcataacactggaacagggagntggggtnagccttttgnagatgccttcagttttncccaggggaccccacccccttttgggtncaagggaacattaa

SEQ ID NO: 722083 - DNA, 487 bp, Homo sapiens
  misc_feature (84)..(84): n is a, c, g, or t
  misc_feature (300)..(300): n is a, c, g, or t
cgcttccccaaagctcagtgtcccatttggagcgctccctaactccatataatgcgcggccccaacacggcaaaaagctcatgnctgtgcgcattgtcaagcatgcctttgagatcaacacctgctcccaggcgaaaaccctttgcaggttttggttaaccccatcatcaacagtggtccccgggaggactccccacccattgggggccccgggatttttaaaaaacaggctgtggatgtgtcccccctgccccgtgtgaaccaggccatttggtttttgggcccaggcgcttttgaggntcccttccggaacattaaaaccctttttgagggcctggcaaatgagctcatcaatgctgccaagggctccccgaactcctttgcccttaaaaaaaagggcgagctggggggggtggccaagtcccccccctttttttcccccctgttgcccaataaacctgtttgccctttggggcggtccccccca

SEQ ID NO: 722084 - DNA, 509 bp, Homo sapiens
agcgagcagccgagctggtggatcgccgagcgcgagtgagggagccggagccgccgccgcgccgcctccgctcccctccgcgaacagtgagcccgggccggggccctggactgccgcccagccgtccctcgggctgtcaggccgcgagggtagcgcgccgcgagcgagcgagggggagggagagcgagcgagcgcctgggatggaggcggctggacctgagctgggcgccgcgctgtgtggcgtgaggggaagcctgcttgaccgaagaaactaacgcaaaccacacagcgagaggcagagagagacacccgaacacgcgagccgggggcacagacccacaacccacgcgaacagaaggaaacaacagaacagcagcccgccacaagcgcagcaacggaccaggaggaagaccggccaacacagccacccgggccaaaggacgagagacgagacgagagaagaacgaacgacagcgggagggcaaacggagcgcagccaccgcaaggag

SEQ ID NO: 722085 - DNA, 179 bp, Homo sapiens
tacagcttccaactgagtgtattttaaagagacagtgaaggtggggcatggtggctcatgcctgtaatcccaagactttgggaggcagaggagggcggatcacctgaggtcaggagttcaagaccagcctgaccaacatggagaaaccccgtctctactaaaaatacaaaaaaattagc

SEQ ID NO: 722086 - DNA, 184 bp, Homo sapiens
  misc_feature (3)..(3): n is a, c, g, or t
gangggcacatccgaccgtgaggagtgcaggcaggaggcagaggcgggtcactagtcaccatcaggacagctcagacagaagagacgtcagccagttagtgcatgctgtggtgagaatgctcggacgttcagtctgcttagtatcatcaacctcgtgaaaattgctattgagtgagaagagacc

SEQ ID NO: 722087 - DNA, 145 bp, Homo sapiens
cgaatgtgctgatgacagactatcttaaaaacacttccccgggtcacagtggtcccttgctgagattaagctcctatgtacacactgcttggtaaccttagcaacttcacggcatatcagcaaggcaatcagatgcatcctctgt

SEQ ID NO: 722088 - DNA, 977 bp, Homo sapiens
gctggggttcgtgcttgtaagggtgaggcgaagctagaggataccggagatgagtcggtgggcatctgagagaagatacagatgaatacgaactacttatattaaaatatatgaccattaggcttactcatgatattgtgtagagttgagatgtcaaatagtaattttaattgtagccttacaggtaatctcccaaccgtgaagaagtcatgagagagatctaggataaagatagagactgtggagatagggatatacatgcataaatggggtgagcaaaggaaatgacggaaggatgtgatcatgaagcttcgtatggtgggagatcataatactgttggtttagacacgaatcacttgctgccagagaaaggacctcccagagtcccccggagattcaaattaggcacttaggaaaggttcatatgctctaaggatttagaacttagttcgggtgaactttgaactagacttcaaaaagattatagttatcacaaatctgcgtcacgcgttgagggtaacccataagtctggaaacggccgcatgcgtatattataccaagaagatttaccctggggacaggatgacttgcttctcgaccgttggaaaatcctgatggacttcaggggagaaatggcgttccttttggcatgcctagtcccatcgcattgtcttacagtgcgaggactagaccatggcatagactgtaatcgggagtgggtggatcgacatcaatctcgcgcaacgatacaaccgtcggacggcggaagctcgcacgatccgaagtatgaggcggcgcaccactatcccagaacaaagccttcgccacacactggccgccggacccaagaaccatcgtccgcggcccacaagaaggtctctcgcctggactgcctgacaacgcagtgacacaagggggcttcactcaaaccggggaccaacgcgcacacacacggcggagcaccggcaaccggcg

SEQ ID NO: 722089 - DNA, 185 bp, Homo sapiens
tattacgagtatctggaggtcagcaggtgctcaaatgtcgacggaacttgtccaggcaggcatgcaccgcacgtggtgaatacacgtcgaccaggctccatctttacgatctttggaggtcagcacggtgctcaagtatcgacggaacttgtacagggaggcatgcaccgcagtggtgaatacac

SEQ ID NO: 722090 - DNA, 208 bp, Homo sapiens
gctttgggacggcggtccacattacagcttcgatgggaagacgtacaccttccgcgtggactgctactatgtctgcaatggtgaccacaacgattcctacgctcctctggcgagcatgcccccttgctccacagactagcagacctgcctgaagacggtggtgctgctggctgacaagaagaagaatgtggtggtcttcaaggtccga

SEQ ID NO: 722091 - DNA, 234 bp, Homo sapiens
ggtcctccacctcagcctcgcaaagtgctgggattacaggcgagacacccatgcccggcctagtgagccagtcttgcctagtgagttagtctcgtggccaagtgaaccaccagatgcttcctcctcagctccatgaaatacttacgggaagtgtacagaccgatgactggaaagaatcatgataaatgaaaggggaaaaattagacagaaatctgagtacagcaggactccagt

SEQ ID NO: 722092 - DNA, 396 bp, Homo sapiens
cgtcgacgagagacagacagaaacagaaagacatatagagaaagacagggacagagagacagagccaaacagagatggagagacagagagagacacagacagagacagacagtgagacataaaaagagatataagaatgagagagaaagagaaagagagaaataatgaaagagaggaagagaaagagagaaagaatatgagaaaacccaactaaaacagcagggttataaagagagtggctaggtagggttgcagaggaggtgagaagagatagtatgcacaacatgtatctatagagagagtgagaaagagggaaagggagagagacagacagacagacagagacagagagagaacatgaacagaaatatggctggaaactaaaacagtcgacgc

SEQ ID NO: 722093 - DNA, 105 bp, Homo sapiens
tgatctttaagccaggtcttttctaaactctgagtgtatgggtagaaaaagaaagaaatatcctcggcttctgcagtgaattgatttttctaatgctcctggaaa

SEQ ID NO: 722094 - DNA, 162 bp, Homo sapiens
cagtcaggctgtattcgtgagatgatgcgcaattggtacctcgattgcgatgatttatttgatgtcttggaagcaggcaaagcgtagctaaattgacagaaaaggaacctgaaatggttccttttttctttcatggttgtggtcggttttgaaatagagctg

SEQ ID NO: 722095 - DNA, 313 bp, Homo sapiens
cggatcacaaggtcaggagatcgagaccagcctgaccaccatgatgaaatcccgtctctattaaaaatacaaaaattagctgggtgtggtggtgtgcacttgtaatcccagctactcaagaggctgaggcaggataatcgcttgaactcgggaggtggagattgcagtgagccgagatcatgccaccaccgcactccagtctgggtgacagagcgagactcagtctcaataaataaataaataaataaattatttggattgattgttctgttattcctcctgtgaaaagatcaggttccgtaagataactaat

SEQ ID NO: 722096 - DNA, 146 bp, Homo sapiens
tgacaggcgttgcgcgcagtggcgggcggtgtcagcccacagccttagactcagccacaactcgttgcgcgcaccgtaaaccctagcgcccgagatgcttgtggtccagcgccctgaattccctcaatctgtcgggctagtcgggg

SEQ ID NO: 722097 - DNA, 200 bp, Homo sapiens
aaacataaccagacaggacagaccccgcctcagggctcaaaacacagctgctgtaccatctcctgtgggaagagggttgccaagggcggaccaattgatgggaacagggtgatgggccaggggagacaccttataccacgaaaaaagccttgtgcctttgtgcgaggctgggaaccttgctctggcctcgccacacactg

SEQ ID NO: 722098 - DNA, 149 bp, Homo sapiens
gagtcggtacctctcataatgtgtgccatatatgggtgtgtgctgtgttttatgttagtctagtgaaagtcatcttgtaagatttttatagtttgcttatccacagtaatataccaagtgcttagagccaaagtttgtgcttttgggga

SEQ ID NO: 722099 - DNA, 1028 bp, Homo sapiens
  misc_feature (679)..(679): n is a, c, g, or t
  misc_feature (1027)..(1027): n is a, c, g, or t
caaagttcttttactggcacagaacattgaaggctaataggacaagtgtttgagtgtcctctctttaatgctaagatgggtcctgtgttgtctacagtgccctccaaccctcagtttttcagttcccactgcctaatgtctgctcaagcatagtataataggaggtggtagcagtagcaatggccttatcagctgttcacttacatgcttttgcccaagtcaccgttgcccatttgtcagaggtgttgccctactcaacctccactgccctagcttttcccacaccccttgaatagataggtatttccaaagctgcttgctcttctagccagttgagctttgatcctctggacttttgactgctcagtgggttttggtcagcaaagcatggtgcctcttccagtgggaccacataacaatgtctgctccaccgtatatgtgtgggagactctggtgctcacggagacaggtggaaaattgcccctggggacaccaggcacagggcggcttgtagaggataggccttgaatgccagcctgcctccacctccacactacttcctcagagggcttcaagccaaaccaatagcctttttgtgtgaaacatctttgaggtgggaaagggaccactggagctttgctagcataactgaactttcagtgttaatgttctggaaagnagcagggactcagcacagaaattcaatttaaaatggagcctgaaaggagtgggcctcctctatgtgtgacagaaaatagtgctaattctttcaatctgacctctagcacggttgaactcagtagtgaatgcgagcatacggggttttcaccaagggaccagggaaacataccctcactgtgaggtggggtgcgccctcccccgatgtgcctgttcttgtgccacgaggcgttgttataacgcacctagagaagcggccgcaatgttgaccaactgctcgcggagggaatatatcatacaaggttcatcagccagatgcctttcttttaatcgtttaaataatgcaccna

SEQ ID NO: 722100 - DNA, 119 bp, Homo sapiens
ttcgaggaagactgccctgttgcttgtcgcaaattgcaggacggcagcagtaggacacacagacaagattgggagattgaaagaactctgtgagcagtatggcatatggctgtttgtgg

SEQ ID NO: 722101 - DNA, 669 bp, Homo sapiens
acagggtgacagatcttttaaagggtgctaaagatagtgttgtccttgtcttggcccctcccattcacagaggctcaagagctgtttagggcagcgcataggagcctagcggtagctgtcacggttgagaagagaagcaggttttgtacactgggatggagtgtgcgtgacataaaacacctcaactggaagaggctgccgacgcaggccaggtgtaaaattccacacaatgctcacaaccattaaggaaccctcatctatatacatataaaactgagaaagaaataacgcgtaaggcaatgtatggcgtgtatttcagcttgagtccaaagaaataatattctatgagggcttaagctggtttggctaatttaaactttttgaaaagtccactgcatttaaaaaataatgaatttgcttccgttaaagctagattcgcgtaacaatcaggcagctgctgagggtcagtttccctttctgggggtctcagaaaatggacagttttctcgtacggcattttgagataaaaaattgcgtaacaggtaaggatttgctgggtgatagcattccttctgtgaggtcaggaaggaggaggaggaagaagtcagaaatgcattatttatgctagaatcttcatcgtaacatctgatggtactgatccaaggagcg

SEQ ID NO: 722102 - DNA, 360 bp, Homo sapiens
  misc_feature (97)..(97): n is a, c, g, or t
  misc_feature (274)..(274): n is a, c, g, or t
  misc_feature (294)..(294): n is a, c, g, or t
gggggtgaggtaaaatggctgagtggtttgtagagaatagtcaacggtcggcgaacatcagtgggggtgaggtacaatggctgagtgaaatggattntggcgtaggtttggtctagggtgtagcctgagaataggggaaatcagtgaatgaagcctcctatgatggcaaatacagctcctatatgattggacatagctggaagtgagctacaacgtagtacgtgtcgtgtagtacgaggtctagatgatgagttttttatatacatatgccagntacaggccaccctacggtgnaaaagaaaagatagaatccctaagggctccagagcactgcagcagatcatttcataattgcttccg

SEQ ID NO: 722103 - DNA, 952 bp, Homo sapiens
gctccaaacccgcacgcagttgtgctagactgtccttaaatgctactgaggtgggtgtcacctacaagttgtgtattaattaaatatctagctagagatcgtgcttggctgagtatatacagcacacacatcacgatgtatacagtacacatatatgcatcgatcacatataatgtgtagcatacaaacacacgatgtgtgatgtacgatagtaatacgacagtgtagtatactatatcactgtagtgtatatatgtcatatgatacagcatggtgttgtggtaatatagtatagtatagtatgatataatataaggattctacacacctgatagtgtagtggagcaggacatagagagacttctatcacgtgttaacgcccattaatgggttccttgatataaacaattctctacaaggaggatctagtgatcccaacgaggagtgccctacatagatatctcatgaactactcccaataagtcgtgaagacgcagtcagggacctcctcactacagtagtgacacacgactacatattttgcacatcacataaaacgaaagacgagtcctatacatacaggttggtggaagagtccttcgataggtactaaagaacaatgagtccctaggtggagaggtaacggacaaggatagtggcggccggtagcttaaattgacacaaaactcaccctgagtttgtttggagacaaaccgccaagtagacaggcctgactatataaagaaacgaaagataaatttatgtcaaaacacaggaaacgttagggaaatagtaaataccccaccccacttagtatagcaaccccttctatatgaatactaaatcataataaattaagaaaactttagagcacaaggacaaagtaagtaagtggccgaaaactgggaggcagtactatacaaacataggtgcggacatcagagccaactag

SEQ ID NO: 722104 - DNA, 1114 bp, Homo sapiens
agtgagggcctggtggataaacgctgtggcgtggcgctggtggcgcagcgtgcagggcctggagcggaagtgtggaatggtgactgcagagctgccatctgtccctgctgctgcaacttcgagggctgcaccgggagaggcggcatgcagactatggacaagcatgaacctgctggagagcacgctgcggagcccggtccttcttaggatctctgtggaagagtgaagctagcctggatccctcctgtggacctgcccgcggttgagctggctgtccagagcaaccattattgccatgcccagaaggatactggaagtcaccctgaccccgagaagcagagggcccgatcgcaaactctatgtggcctctgccatctgcctggttgttcatgatttggcgaaatcattggtgggtacctggcacagagcctggccatcatgaaccgacgcatgcgcacctgctcacggatatggccagcatgctcatgagcctcttcgccctctgggtgtcttcccgaccagccaccaagacatgaacttcggctggcatcgagccgagatccttggagccttgttgtccgtgctctccatctgggtggtgactggggtgctcatgtacctagccgtgcagcggttgattctggagattatgagatcaaaggggacaccatggtggatcacttcgggcttgcgcttgtgggtgtgaaccttcataatggggtaggcccaccataagtctggactgggcaccagcatggggacacgcgtgaaggaagcagccagagaaaccacagggaccagactgcctcagatccagtagaaatgggggccctttttgaaaacatgttgcaggacaagggcgcagcaaaataatatatatagtacaggccgggaagtaaaagatgttaggaccccccattgtgaagactaactaatagtcaaccggggttgtgcgcaaacttgtacaactatagaaaagttaactggagcccagatggaggccacaagagggggttcaagcagggaaaaatagctccgggagtaaggagcctgcatcgagatattggccacgcgacacggtgtaaaacacacaaggaccaataatgagaacgat

SEQ ID NO: 722105 - DNA, 236 bp, Homo sapiens
ccttcggggggtttttcggttccccaagcaaaagccaattttttccagggggggggaccttgggtcccctttgatattctggggccttggtttttatttttccctttactcatgggggttgggcccccttgggttctttgttgttcccccagaagccggaaaaatttctttccctgggagggggggtttgttccttttttccgggagggtttttgaaactttccccctcaacccta

SEQ ID NO: 722106 - DNA, 155 bp, Homo sapiens
ctgtcacacaacatctggttaaagaactcgaatggaagccaagctgcatgagcaagtggagaagaaaagaaaacatagtccaaacagatcacacaagggaacccaggacaaatgctgactttggcattatctaggtaacccctatatttagtcat

SEQ ID NO: 722107 - DNA, 111 bp, Homo sapiens
ctatctacagcaaggtatttatattactgaacaattgcctgccttatggattcttctctgatctattagggcttcttcatcttcttcctctacatcaaagtcttcaaggtc

SEQ ID NO: 722108 - DNA, 635 bp, Homo sapiens
  misc_feature (588)..(588): n is a, c, g, or t
  misc_feature (609)..(609): n is a, c, g, or t
tcccccgtctcaacatagctaagcctatggcacatacggtataaaagataatcacccaccatagtataccaaactcctcttatcaactgcacactaagtgatatcaatacaactgtgtccgtataaaaatactggaaacaattgatgaatgacaggttagagaaagatatctcgagctcgttactaggatcatgtgcatagagtgagcctgtggatatttaaaatatcacagtaacaagatcatgcttgttcctacagtattgcgggccagacacttaagtgaaagcagaagtgtttgggtgactttcctacttaaaattttggtcatatcatttcaaaacatttgcatctcggctggctgcatatgctttcctattgatcccaaaccaaatcttagaatcacttcatttaaaatactgagcggtattgaatacttcgaagcagaacaggcaatgtgcagccctcatttatgagaaaaccctcaggaaactcccagagcgatgcttggagaagctgtgagttgagctgaagctggagaacttcctccagagcaaagtgcttaagaaagaaagaagaactctaagctgngtctgctaacatcacttcagnttagatcgatcttggcagagagacat

SEQ ID NO: 722109 - DNA, 253 bp, Homo sapiens
ccagagctgtcctcaaagcatccagtgaaccctggaaaaggcttttaaaagggaaaaaattgtccctctgaggcccccgtgggtgacctccaaaaacttcctgcctggaactcatttgtgaactgggacaaaaacaaaggaggctgcctgttgtgatacccccttccctcccccagggcctttttcaaaaaatttgccctgttttttgatcctgttagtccctgtggttcctcaaataaaactgtttgtgcca

SEQ ID NO: 722110 - DNA, 265 bp, Homo sapiens
gagcgtagagatcctaacagctacttaatgatgttaaaaataatcggtacatggacgggcacagtggttcacacctgtaatcccagcactttgggaggccgaggcgggcggatcactggaggtcaggagttcgagaccatcctggccaacatggtgaaacaccatctctactaaaagtacaaaaattagctgggcgtggtggcaggcgcctgtaatcccagctgctcgggaaattgaggcaggagaatcgcttgaacccaggagg

SEQ ID NO: 722111 - DNA, 110 bp, Homo sapiens
ccaagaccgtaagcgccagcgcgaggcgaccttgcaagcatcatatctgggatattcgatcgttgctgaatagctttgcctcagcatattcagggccgctagctactcta

SEQ ID NO: 722112 - DNA, 116 bp, Homo sapiens
ttgtctcttacggcattccattatgtttcattgcacatgtgtcattcatagtgctgccctactgtgctcgtgattgtgtccacatctccaccagcccagcccaccaatcagggcat

SEQ ID NO: 722113 - DNA, 355 bp, Homo sapiens
gttcttctggttctgctcgtgcacatactcaaaatgcctgtcatctccagtggcctatgctttccattgcgacctgtcatcctgaaagaatggcttcacatttgaagagtgagaatgccaccgggcctgtctggaagaccagatctggcctgctatctctgggttgcttcgctttgaccgttaagtgtctccggaatgtataccgtttactaggcttcctctcaaaggtgctggttcttggtaccctgaagccatgtgtagcttgatattctgtccgccctctatctctaacgcgagagcacagcctgataaagtcgtatctagtggatgcgctgtctcctggcgtccacagtcg

SEQ ID NO: 722114 - DNA, 116 bp, Homo sapiens
caagactcgaaggacagaaggtttttgactctctaagtttcggaggtgtgagacaaagggggcagggaagactaaattaaacgtgattcagtaaacgtgaccaacctctggctcac

SEQ ID NO: 722115 - DNA, 121 bp, Homo sapiens
tggcacatgtgctggctctttttatgtgggtttactcaaggctggaggctaatggctgatgccccagtctgacaatcatctaatggaataaacattaacgaagaccctgtaaaaaaaaaaa

SEQ ID NO: 722116 - DNA, 101 bp, Homo sapiens
ctggcacgtttatagggttgtacggtagaaccgctattattcatcatgtgggtaattgaggagtatgctagattttgcgtagctgggtttggtttaatcca

SEQ ID NO: 722117 - DNA, 788 bp, Homo sapiens
tggggaaggatctgcaggcgagattacgatggctgatggctctgctgctgccctgccccctgccttgtgcccccagatgcccaccctggtctggccctgtgtacatgccatgatcaaggctgatccgtaatcttcaacaaccactgggaagcctggtgtctccaagttctaccagccctacagtgaagatacacaacagcaaatcatcagggagactttccattcggtatctaagagacgatgaaaactgctgtaactctccctacacagcgaggactcactcacatcgcgaggactctgaccacacacaactgacttcactagcaccattacttgcaacggttactacttcctcgtctctctgctgctgcgactttcattacagaagacggcgtgagacgttgggcgagtagttgcaggactactaaatttcaacgctacttaagctgcgagacaccagttaagtaacaagatgctattgtgacagacactggtgctgggttgaggcttgggcactttcatgaactgttagtcgcagctgataagaagcaaaggggtatacagcaagtagtatcttttgacaagtaaacactgagtagaatagaggggtgggaaagttggataatttggcgagcaaccaaagattagttgaacacgttgcagccaaatatggttctcacgatcagcagacatttggccgtgccccatcatcgacaactacacgccgttgggcaaacacagcgcttcgtggcaaggcgctgtggggcccatctatgacccagtaggac

SEQ ID NO: 722118 - DNA, 837 bp, Homo sapiens
  misc_feature (3)..(3): n is a, c, g, or t
  misc_feature (87)..(87): n is a, c, g, or t
  misc_feature (97)..(97): n is a, c, g, or t
  misc_feature (210)..(210): n is a, c, g, or t
  misc_feature (237)..(237): n is a, c, g, or t
  misc_feature (239)..(239): n is a, c, g, or t
  misc_feature (253)..(254): n is a, c, g, or t
  misc_feature (262)..(263): n is a, c, g, or t
  misc_feature (265)..(265): n is a, c, g, or t
  misc_feature (275)..(275): n is a, c, g, or t
  misc_feature (287)..(287): n is a, c, g, or t
  misc_feature (294)..(294): n is a, c, g, or t
  misc_feature (303)..(303): n is a, c, g, or t
  misc_feature (307)..(307): n is a, c, g, or t
  misc_feature (312)..(312): n is a, c, g, or t
  misc_feature (316)..(317): n is a, c, g, or t
  misc_feature (324)..(324): n is a, c, g, or t
  misc_feature (336)..(336): n is a, c, g, or t
  misc_feature (339)..(339): n is a, c, g, or t
  misc_feature (394)..(394): n is a, c, g, or t
  misc_feature (417)..(417): n is a, c, g, or t
  misc_feature (433)..(433): n is a, c, g, or t
  misc_feature (437)..(437): n is a, c, g, or t
  misc_feature (439)..(439): n is a, c, g, or t
  misc_feature (458)..(458): n is a, c, g, or t
  misc_feature (465)..(465): n is a, c, g, or t
  misc_feature (480)..(480): n is a, c, g, or t
  misc_feature (485)..(485): n is a, c, g, or t
  misc_feature (490)..(490): n is a, c, g, or t
  misc_feature (492)..(492): n is a, c, g, or t
  misc_feature (497)..(497): n is a, c, g, or t
  misc_feature (536)..(536): n is a, c, g, or t
  misc_feature (554)..(554): n is a, c, g, or t
  misc_feature (585)..(585): n is a, c, g, or t
  misc_feature (597)..(597): n is a, c, g, or t
  misc_feature (645)..(645): n is a, c, g, or t
  misc_feature (810)..(810): n is a, c, g, or t
tgngctttgatgagcttccctgaatgagccaccagtgacaacatcatttctcttgaaaaatgcattgtgaattctatgcaacagtcntaacatggcntattagaaccttacccattaccagtggcaccttcccatgtttccaaagttatttatttctagtagcaatctgcatttcaataagacctaaataaccccaaactctcctatggnatcttttactaatatgaagcataattnanttaacttgaaaagnntaggtaanncntgtcgacaanactttcctaggnatttctntcccacggntcantatantccnntcccagnggcgcaagactntcntcttcactttctgctttgaggaatatcctcttggtcttgtcatataaagcatggntgtacagaatcatcttcagctcntgtgtggcatagcgcngggngnctctatcaaactgccgggngcgagtncatcccagcggggcnaaggnacgangntcgtnggggcacagaactaaatccgcacgggtgggcttccaggnctttccttcctgccagcngggctggtcactgtccactctttgaggaggnggtttgggaatnagagagcacttttgagaatgatccatagcttcaaccttcctgctaggnaacctgagcttttcaaatgttgactccacaaggtcataatataaaagtaatcccttcttttcccataagttcatcactttctgtaaaagttgctcttcatcctctgttgatcctgggctggtaattaaaaaatctacatcatgccccatcttcttaccctccggnaccctcctgtcatggtgacgaaagcat

SEQ ID NO: 722119 - DNA, 767 bp, Homo sapiens
  misc_feature (34)..(34): n is a, c, g, or t
  misc_feature (36)..(36): n is a, c, g, or t
  misc_feature (154)..(154): n is a, c, g, or t
  misc_feature (162)..(162): n is a, c, g, or t
  misc_feature (634)..(634): n is a, c, g, or t
  misc_feature (638)..(638): n is a, c, g, or t
  misc_feature (640)..(640): n is a, c, g, or t
  misc_feature (644)..(644): n is a, c, g, or t
  misc_feature (646)..(647): n is a, c, g, or t
  misc_feature (761)..(761): n is a, c, g, or t
gagatggagtctctctctgttgcccaggttggangncagtgacatggtcccgggtcactgcaacctccacctcctgggttcaagtgattcccttgcctcagcctcctgagtagctgggactacaggtgcatgccaccacgcctggctaattttngtattttnagtacagacggggttttaccatgttggccaggatggtctcgacctcccgaccccgtgatccacccaccttagcctcccaaagtgttgggattgcaggcatgagccaccatgcctggcccatttaacttctatattattttcctgttggtggatttaccagtgcaaactgagcagcttaaaacaccatccagttattatctgtttccatgagccaaggctctgggcagggtttaactgggtcttctattccgggtcacaatactgcaaccagagtgtcagctggggtctcatcagatgctcagtgtcctcttccaagcttattcagtttgtggactgaattcaatttcttgcaattgtagaacgaaggccctcagctcctagagctgccacctccaaagacagttcacagcatggccatttttgtctccttggaggctaagggttgaatctctgaaacttcacctttaaaagnctcncntgantnngtctggcacacctaagatcatcctgctttggatgaactcaaagtcagctgagccaatgtgcttaacaagcaagtgtgaccataatcacatttgcaaattccttccccttggccntatcac

SEQ ID NO: 722120 - DNA, 332 bp, Homo sapiens
  misc_feature (8)..(8): n is a, c, g, or t
agaccatnctgaccaatatggtgaaactccatctctactagaaatacaattagctgggtatggtggtgcacgcctgtagtctcagctacttgggaggctgagaaacaagaaatcgcttgggcccgggaggcggaggtggcagtgagccaagatcaggccactgcactctagcctgggcgacagagcgagactttgtctcaataaataaataaattcttgtaaatattcgatatgcacatatatattttgtttttactttattattattcatagttaatttgtctctgtgcatttgtccccatccttttgtgtgtgtttttgtttctgatcgc

SEQ ID NO: 722121 - DNA, 250 bp, Homo sapiens
  misc_feature (107)..(107): n is a, c, g, or t
  misc_feature (109)..(109): n is a, c, g, or t
  misc_feature (115)..(115): n is a, c, g, or t
  misc_feature (122)..(122): n is a, c, g, or t
  misc_feature (131)..(131): n is a, c, g, or t
  misc_feature (136)..(136): n is a, c, g, or t
  misc_feature (214)..(214): n is a, c, g, or t
tgaaatactatttaaagcctcctcatcccgtgttctccttttcctctctcccggagttggggtgggccggcttcatgccagctacttcctcctccccacttgtccgntnggacgnacctctngaggcgtcnagctncttcccatcgctgtcacaggcggttatgaaattcaccccctttcctggacactcagacctgaattctttttcatctgngaagtaaacagatgggcactttgaaggggcctcacc

SEQ ID NO: 722122 - DNA, 118 bp, Homo sapiens
tcccaacaaatgatggagagattcagaaccaagatggccctgacttaatccttgtttttaaagaaaggatatgtgcgcgaggatgtgtgcgcaggaagtgtgcgcgaggatgtgtgcg

SEQ ID NO: 722123 - DNA, 283 bp, Homo sapiens
  misc_feature (30)..(30): n is a, c, g, or t
tgggttaccacgtttatcgacagaggaagngcccctctagggcgatatggaaagcaaagttttaaaattttctctcctctgcaagaaaatatatttcagaaaatctctatctcaaaaatgaagcaattaagaactgtctggctgtgaggatctggcctcaacttgacttaaagcaacaacttcagttacatatcaagatgtgcgtgagaatgaacctgctctgctcagccaacgtgctgagtgacttgatgtttgtaataaataaataaataaacgggggggg

SEQ ID NO: 722124 - DNA, 104 bp, Homo sapiens
ttatctgaccatcaccaagacgctacttcccgcacttcgacctgagccacggctctgcccagagttaagggccactggctaagaatggtggccgactgcgcttg

SEQ ID NO: 722125 - DNA, 4185 bp, Homo sapiens
acactccctggggcaggcgctcacgcacgctacaaacacacactcctctttcctccctcgcgcgccctctctcatccttcttcacgaagcgctcactcgcaccctttctctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagagacaattaaaatctttattccagtga

SEQ ID NO: 722126 - DNA, 418 bp, Homo sapiens
  misc_feature (35)..(35): n is a, c, g, or t
  misc_feature (53)..(53): n is a, c, g, or t
  misc_feature (85)..(85): n is a, c, g, or t
  misc_feature (94)..(94): n is a, c, g, or t
  misc_feature (106)..(106): n is a, c, g, or t
  misc_feature (128)..(128): n is a, c, g, or t
  misc_feature (132)..(132): n is a, c, g, or t
  misc_feature (145)..(145): n is a, c, g, or t
  misc_feature (154)..(154): n is a, c, g, or t
  misc_feature (222)..(222): n is a, c, g, or t
  misc_feature (411)..(411): n is a, c, g, or t
ccaagttccctcccctcggggtttgccccttgaanaccgtggttgccgttttntggggcccccgtggccctcctcccctgttaanggcctccanagggccctgccntccgggaagggtgaaccagccncccnggctgctgccganagggttccncgttggggtccccaaagtgtgcccggctgctatgaaaaacgttgggaatcttggtttcagttttttantctatgctaggttgtacagacttatttatatcatcgttttgagggactaatggaggcttattgtaacatataatattagtgaaaccatggaattatatgaaaatgatacatgagaaataaggaaactattttgctgattgtaaatttttgtgggaaattttgtgataacttgagaattatacttgtttnaatcaaa

SEQ ID NO: 722127 - DNA, 342 bp, Homo sapiens
agtgatgctgcaggctacctagagtatcccaatcgccacgacaaggagcaactgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactgctccttgtcgtgcgattgggatactctaggtcacctcagcatcacc

SEQ ID NO: 722128 - DNA, 4216 bp, Homo sapiens
acactccctggggcaggcgctcacgcacgctacaaacacacactcctctttcctccctcgcgcgccctctctcatccttcttcacgaagcgctcactcgcaccctttctctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagagacaattaaaatctttattccagtgaaaaaaaaggaaacaagaaagaaacaaaaggg

SEQ ID NO: 722129 - DNA, 529 bp, Homo sapiens
aattataaaatcaatattcttaaattatatgggcataaatctacttagaaacccagatacctatttcttatggctcagaaagtacaagaaagggtgccaaataaagaaactaaaataagaatccattcatatattaactaagcatataaatcctaggaaatctgtgacaccctgaaatgtgccagtgtacggggcgcagagacaagatagaatcatagtccataatctaaagggagctatatgcggtatggacatccaaacatatagtagagatttatttttacctttcccttcctatcacataaaatgcttctagaattaaaggcgtgtaagagatcccagggttccctaaggaaaaactatgtccccgggaggacattctgtaaagacatgtgaatggttcaatactcagactttcaattaactgtatccaggatcccatacacaagggatgctggcatggacgacacactacggaaagagctttaagtataacagagtgacatttagtgctgatcacactcatcag

SEQ ID NO: 722130 - DNA, 781 bp, Homo sapiens
agtctcctttacattgacaggtcctggagggtagtggtgttgaatttaattagtgcaagctacgttaatttgacaagaatccagatcaaactgctatataaacagggaattgcttgcaggaacttcttagtgattaggctggagaagtcgaagagctgaactaaaagatatgctgcagatagtactttttctatttgccccccttataatttgaatggcccagatgaaagagcctgtttttctttaagcaatagtatccttgtggaaagtccttgaaagaacatgttctacgacactgaaacagtctaattagagcatgaatataacaatgatgtcaagatgctgctagattgcaaagaaggcagtttccatttcatggtgaaatatggcaggtaattgttttcgtggcagtgtagcatgagtcccagtttgggaactctgtgtccattacacgtttccttgcagagaaatatcattaatgtgtgatacttactagaatagtgtatcatttgctcaacagaggtagtcatttgaaatgcatattatcaagggcagtggcccattaagtttttacaaaaggattaaggggttatatgagtacccaaaggtgaacagtaagataaaaccaaaggttcccaaatcttatgcctattagtatatgggaatgaaatgatacattcttaatcatgcgagtaggatattcatatttaaaaagaaattcagttagaataaaagtcatcatcaaatgcaagatggggaacaaatgaagagatgtggaaaa

SEQ ID NO: 722131 - DNA, 3616 bp, Homo sapiens
acactccctggggcaggcgctcacgcacgctacaaacacacactcctctttcctccctcgcgcgccctctctcatccttcttcacgaagcgctcactcgcaccctttctctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactgctccttgtcgtgcgattgggatactctaggtcacctcagcatcacc

SEQ ID NO: 722132 - DNA, 424 bp, Homo sapiens
cagctgttgagataaaaaaattcgttgtcatttattcccaaggacagctgtttgtcatttgcattgaaaaagtctccattcaaactgctgtcacatataaaatctatttatataagtctgtatttttctgttgtcttggcctttgtgggcagtagtgtgttttaaccaagcaaactgtccttccaaataatgaagccgaagtcagcctgcctgcttgccatttttcttccccttccatttttctaacctcaggatagttgtaagaatgaattaagatttgtgtttaaggccgggcacagtgtctcaggcctgtaatcccagcactttgggaggcggagacggatgtatcacttgagctcaggagtccaagaccagcctgggcaacatactgagactccgtcttgtataattaaattaaaattta

SEQ ID NO: 722133 - DNA, 911 bp, Homo sapiens
agtgatgctgcaggctacctagagtatcccaatcgccacgacaaggagcaactgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagagacaattaaaatctttattccagtga

SEQ ID NO: 722134 - DNA, 3599 bp, Homo sapiens
  misc_feature (3575)..(3575): n is a, c, g, or t
acactccctggggcaggcgctcacgcacgctacaaacacacactcctctttcctccctcgcgcgccctctctcatccttcttcacgaagcgctcactcgcaccctttctctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactgctgcntgtctgcgattggtaatccagggt

SEQ ID NO: 722135 - DNA, 887 bp, Homo sapiens
ctgaggttcccgccacgacaagagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagagacaattaaaatctttattccagtga

SEQ ID NO: 722136 - DNA, 235 bp, Homo sapiens
tgttttaaccccctgggtcaccagaactacaagcgcacaccataacattccatccatctccggataactaacaaacacagaatctccccaagcaagtttcaaactcctattcctgatgatctggttgcatccgccttaacccatcatgtagacccaaccgtaagcagttcgtgcccgccaaccctgccctccccgggactcgatgagaatacagggtctttcccacacattcggg

SEQ ID NO: 722137 - DNA, 4333 bp, Homo sapiens
  misc_feature (3569)..(3569): n is a, c, g, or t
  misc_feature (3597)..(3597): n is a, c, g, or t
  misc_feature (3649)..(3650): n is a, c, g, or t
  misc_feature (3655)..(3655): n is a, c, g, or t
  misc_feature (3658)..(3658): n is a, c, g, or t
acactccctggggcaggcgctcacgcacgctacaaacacacactcctctttcctccctcgcgcgccctctctcatccttcttcacgaagcgctcactcgcaccctttctctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaaggtagagggagaacctctgccctccncaccttttggtcctagagggagtacccntctcaagcagccaatccactcccatccctaaggctctcatctgactgggaannggcangtnccactccccagcccatcctcttttttccctccagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagagacaattaaaatctttattccagtga

SEQ ID NO: 722138 - DNA, 170 bp, Homo sapiens
taacggtcaagttcagagtttatcgtagaccacagtttaggccggtagacccttaggggtgactggtctttgatatggtggtaaggtgtcaggccgtttaggattcttgaccggtaccaacggtatgcggttaacccagttcaaaagggaacccaaaggcctggattatg

SEQ ID NO: 722139 - DNA, 178 bp, Homo sapiens
tactactgctgcaacaagaccctctggcttcactcttcgaacgtgtactcattcctggcttcccagacggtactttctcttgcctctatcattgcccctcctcaggctccctccctaactattctgtccacacttttccgagttcctctgtgctctaatccttaaccccctttcaaga

SEQ ID NO: 722140 - DNA, 361 bp, Homo sapiens
  misc_feature (2)..(2): n is a, c, g, or t
  misc_feature (23)..(23): n is a, c, g, or t
  misc_feature (75)..(75): n is a, c, g, or t
  misc_feature (80)..(80): n is a, c, g, or t
  misc_feature (88)..(89): n is a, c, g, or t
  misc_feature (142)..(142): n is a, c, g, or t
  misc_feature (145)..(145): n is a, c, g, or t
  misc_feature (153)..(153): n is a, c, g, or t
  misc_feature (243)..(243): n is a, c, g, or t
  misc_feature (272)..(272): n is a, c, g, or t
  misc_feature (274)..(274): n is a, c, g, or t
gntaaaagtaaatggaaaacacnccctacacactagaccccgaacactgggaaacagtactgcatagcaaacccntgggnagaaaacnnaaatgttattgcacatgtaaaatatgaaaacttaactctgctgtgtgttaggnaancctgtaancttttttgacccttaaaagaaattcatttctgaaattcttggttggaagactgtgacaatagcccatgaaattgagtgttatttttcctncttttttaaaaaaatatgtaaagtgcagncntctgtattcctgcatattgtatatacctgtatatgttttcctgagcagttaaataacaataaatatgacgttaatggtgactgtggt

SEQ ID NO: 722141 - DNA, 100 bp, Homo sapiens
gttacttaaagcaagtcatttaccaaatggaaaaggggaggtatttaaggcaattggtaagtggaggtagtcaggagtctctgtgggtctccaatgattt

SEQ ID NO: 722142 - DNA, 206 bp, Homo sapiens
acagctggaggctctggtaatggtggaaataggcaaggatgggatcctccccatgtgaggcttttgaggggacatatcccctgtgtgaatttgtttctccgaaatctggccaaaagtgaaataatacatttctattcttttaagccaccaagtttgtgggcatttgttacagcagccacaggaaaataacattggcccttatcgag

SEQ ID NO: 722143 - DNA, 1492 bp, Homo sapiens
tggttacatgctaaagaaaaatcgccgttaaagcagttttcttatttcactgtacttatttcttttcgctggtggaacccagcatgttcctgcgatggtgccacctcctcagtgaagacccctgcagctctccctgctgtgctgcttctgcagtgatgtgcatgctgacagtttctgagaaccctgtggccttcccctcccatgtgcctcctggggtgttcctggctgtttcagtgctgctgctgtttatcctgtggaatgtgtgcatgtgcgctgcttagtgtgccctatgggtgatgcttgctgctctgtgctgtggctgtgactgcagtgtggtgaatccattgtgaatgcttgactacaatggatagaacacaacaaacaaacattactttaatgtgatgcacttatagccgagaatgaattatattcaagacatgaatgacacaaaagataaatgtggacttaatattgattgaaaatttaaccacaaagaaacaacatatttcatgctcaaaatgcacagtgatgattccaagaaagctttgaaacacgtgggatgttcagccacatggacagtgctatacccaaaaaggcaaaattatacccccactggcaacttttttacaaacaactggaactggcggacatataattattccacctttggcaaactcagcagaagaacggaacttggaccaaatctacctgtaattacaaggttttggaagaacgtgcccgtatggaggaaatttggaccaagagccaatggtttggtccaaagaataaaatccttcccattggattcaggtgtaccaaaaggttgacagcctccggacagcatggtttccctattatttgcacgaaattacgaacaagacttgtgtacaaaaatgccagctctaattcaacccctttttggaaaacagagagaaccggaacaggtatggccttcaaccaaacattggttggggtaaaccggccgatttgaaggtaaagaaccattccataggatacccaggaacttcaactaatcgaattggttaaagtcccttgggaagatggtaacacccgtgcaccaaatggtccatggatgcccccaatttaaacatataccacgggacgctacaagcaattaccagaggggcacaactgtttcagaaaggattactcatcaaggagtgggaagcacaatcacatggttaccgtggacaaacttccctggacaccacattgacgtgtgaaacgaactcccaatgtcagacggacccaacgataaacagcacgacagcctatcacaagagtcccccaaaagagcgaaggcccgaacaaagcttgaccgcctgagtggaaccacatgaacgacacaaacccggaacactggagcaccacaccagcttggggcgcaactgtaagccgctgcgcaccaacaattggacgaacacacagatacgcccgtagaataatcaaaccgccacacagacacggcgac

SEQ ID NO: 722144 - DNA, 303 bp, Homo sapiens
tagtctagaggatccgggggagagggggtctttcttaggtgccaggtgggtcttaaactctggggctcaagcgctcttctggcctcagcctcctaaagtgatgggattaagggtgagggccaccataccgggccttggatatttttagatctacaatttatcaccttttttttttttttttaaaagacagggttgggctcggtggccaagtctagagtggaggcgggggatcatagtccacggcaacctggaactcgggggctcaagcagtcctcccacatcagcctcccaggtagttgagac

SEQ ID NO: 722145 - DNA, 1154 bp, Homo sapiens
atctcaacactgcactccagcctgggcaacagcgtgagactccacctcaagaaaaaaaaacaaaagattctgactaattattcccatggtggaaaagccaccacttcgtgccactttaaattaaccattcagggatctcagagattcttccaaggaggacaatctctgcattcaaggttctttacaccaagggtggtttttaaaggcgaaattattgaaattagggaggcagaaattattgccttgttggccccattagaaacgcgaggctcatattccttgtgttcccatcacataagggccatttttattctcttatcattagtttacacccagaaccttaaggttaaacagtgtggttttttctgtgttctctttatcatactttcttccccatgtgaaaatgggggcatttttcatctcttacaacagctttcaacctccaagttcgaccagggggcaaacctttatttgacccttaggttcctatcaaccccttatgtgttattcattcattgtgccacccatttttgaacgggcacacctaattggtcctaaagctttattccttcataaaactcttttctcagtgtttaagcaagagcttcaattaaacttccggtgcctgggaaacatgtgctatatgatacctctcattaacatttaccttcagccaaagattcccaatttttacctttttggaacccgtggattgccatcgggccaccaaagtttcgtgtccccaattggaaagccccaatgtatttcaccatattaccggtttatggtcacaattaactgtttttaacccagaaaaaactttcttttaatcaaacgcttactctccagggtgtataaacatttgagagtcccgtagcgctgattctaatttctccaaaattttctcgtaaaatttccaagatgttttaaagcggtggacagataacacatgtgggccccagatacccaatttcgcgggtttccctttcactgtattaacgccaacatttgtgggacaacatttagagttttgcccctattcccgggaacgagattaagggccctttagcacatttcaccggccttcatgggaaataaaaaggaagacagtttaaacaactccggaccagtttttacgtgatggggcccttatg

SEQ ID NO: 722146 - DNA, 574 bp, Homo sapiens
cacttcttttctgggccagggtagaggttatgaatttataaatttttctttaagaactagcttcgggtttcattacttttctgttttatgtcatatagttttcacttggatctttaaggtcttttttatatttatttggtgttaaattggctattctttttttagttttaagggggaagctgaagtcacagattggagatctttcttatttttggtttggtaaaataggcatttagtgctatacatttcctcccaagtaccgctttagcataatcccgcaaattctagtacagggggttttcattttcattcagttcaaaatacttggtacattctcttagggaagtgtgtcacggactttacaaatatgtggggattttccaggagtctttctgtgatatcaaatttaattgcattacagtcagaaaacatactttgtatgacttgaatcatttggattttattgagctttcttttatggcccagaatatggactgtctacctatctacattgtcttatatgaatttagccactgcagcttttttttccttttccttagagaaatcttatctg

SEQ ID NO: 722147 - DNA, 332 bp, Homo sapiens
  misc_feature (35)..(35): n is a, c, g, or t
  misc_feature (37)..(37): n is a, c, g, or t
ggatggaggacagcagctacacggatgacactcangnatggaggacagcatctacacggatgacactcagggatggaggacagcatctacacggatgacactcagggatggaggacagcatctacacggatgacactcagggatggaggacagcatctacacggatgacactcagggatggaggacagcatctacacggatgacactcagggatggaggacagcatctacacggatgacactcagggatggaggacagcatctacacggatgacactcagggatggaggacagcatctacacggatgacactcagggatggaggacagcatc

SEQ ID NO: 722148 - DNA, 112 bp, Homo sapiens
gcccaagtgcgcgcgtgcaaatacccctggacgggggagagacgacccgccttgtcggctatgatctctttcactgggcctgcctcaatgaacgtgctgcccagctaccccg

SEQ ID NO: 722149 - DNA, 300 bp, Homo sapiens
aaaaaaggattttaggtttttttggtgaaacaaaagcagatttaaaaagttccaaaaattttaaattttcattcacaaaaaaagtctttcacattttccactttccacgttatgatttaaatacaggaaagttttttgtgctttgttaagagaacggaaaattagaacccttctatatcaacacagtgttgttctgtgctttaaaatccctaaagggggattccttttaatgcaacacccaggggaacctgtttaaacattctgtgtttttttgtagctagagcaattccttttaagcca

SEQ ID NO: 722150 - DNA, 516 bp, Homo sapiens
  misc_feature (482)..(482): n is a, c, g, or t
ccggcccagtgtgacttccaaaaagagactatggtagaatcaagtttctaattctgaattattttgagtgttttgaacttaatttttaataacatgcatgtgctcctccagcagtagaaaggaaaatgaggactgtgtgtacacttgttccatgtgaaagtgcaggggaacagctcatctccagtgggtatggacccactcttaacccacccagtctccaaactgggataatagtcaggaatgacatgttcaaaattactaatgtatgctttagaaaacatttttagaagacttacgcttaacaataaaacccaagcaaatggtgtaatttgattttcttaaaaagtctacatttcacatattaataaagcaatcccaacaaaacagtcttgcatctccagaaagaaggaatgaatattgatgacatcttaattttattcagtcccattacttcttaaaatttgattggaaaaattaagtcnatgtaaccccatgctggttttagggatatggaac

SEQ ID NO: 722151 - DNA, 630 bp, Homo sapiens
  misc_feature (85)..(87): n is a, c, g, or t
  misc_feature (91)..(91): n is a, c, g, or t
  misc_feature (94)..(95): n is a, c, g, or t
  misc_feature (97)..(97): n is a, c, g, or t
ctcagattgccgttagtatgctcctcgactcttgaggataaccattcgatgtgccgctccggcagaaactggccttccatctctnnnagcnccnngntaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaccacctttgtgcacaagccctgggaaaatgtccaaatggtctgtttccagaaaagggtaaccggaagaaccggccagggcactgtgttcagaacgacttcaggatgtgcatatcaaaatgtgccctgagaaaacggttccaggtccccaaccgtgtgcatacggcaccagcccaaaggaaacacctttatgtgggccgtgaaaggaaccggcactcgctttggggacccagcgctaaatctcgaaatcgtgcgcatagcgtgttccgtggggaaatgtgattc

SEQ ID NO: 722152 - DNA, 419 bp, Homo sapiens
  misc_feature (35)..(35): n is a, c, g, or t
  misc_feature (163)..(163): n is a, c, g, or t
  misc_feature (372)..(372): n is a, c, g, or t
  misc_feature (409)..(409): n is a, c, g, or t
caaaccttagcctcctgtaaatgaattaaagccgnggccccatttttaatgttcctcctcccccctgaatttaccttacctgccttcctcttttgcccctttgaagtacatttataatatttggcctatagacttcaaaaatttttccttggctgggccgcgngttgtcacgccctgtaatccccagcactttgggaggcccgagacgggaggataatgagatcaggagatcgagaccgtccctggccaacatggtgaaaccctgtctctactaaaaatgcaaacaattagccgggcgtgttggcgggtgcctgtagtcccagctactcagaaggctgaggcaagagaatggcatgaacacgggaggcgganttcgcgccactgcactccagcctaggcgacagcgaanttccatctca

SEQ ID NO: 722153 - DNA, 203 bp, Homo sapiens
tgaccaaagggaggaaaaaaaggggggctcaggctgcgggccccagtccagcagggccaaaagcactcatttttgacccccaggctatgaggttcctgctgggcattacaaaaagcttttaactgtgatcaggcagtttgctcaaaaacattgaggggcgatttttagttttgttttgaaaaaataaaccgattaccctgcca

SEQ ID NO: 722154 - DNA, 413 bp, Homo sapiens
  misc_feature (85)..(87): n is a, c, g, or t
  misc_feature (91)..(91): n is a, c, g, or t
  misc_feature (94)..(95): n is a, c, g, or t
  misc_feature (97)..(97): n is a, c, g, or t
ctcagattgccgttagtatgctcctcgactcttgaggataaccattcgatgtgccgctccggcagaaactggccttccatctctnnnagcnccnngntaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaagcagtggacaccactccgtgcacgagcgcgtgagtagaggtccagagggggaactgtaagagacgtcatcac

SEQ ID NO: 722155 - DNA, 639 bp, Homo sapiens
  misc_feature (551)..(551): n is a, c, g, or t
  misc_feature (565)..(565): n is a, c, g, or t
cacacaagtaatttagttctattttaaagtcacagtgtgcatgtatatgtctgtatttttgcatgtgtgtaaaaaatacagacatatacatgcacacaagtaatttagttctattttaaagtcacagtgggaattccttagtgaggagggataaaaagttcctgaataagacactgagaacatctagatttattattcaggaattccttagtgaggagggataaaaagttcctgaataagacactgagaacatctagatttattattttctctattttacttcccaacttacagaataaactgtaaattaaagaataactccataggaaataaaagaggtcttacaaacttagtttacaaattccagctacagtagttggagttttacttgatctatgtatttctatgtaccctgtaactaagcttctagccatcttaagtgtaaaccacagatcatttactaaagaacatgattctcaacagttctaggaacagttataaatggtctaaaggtgttctacattttgaggccccaggatatccttttattntatatatctgcaangtagcaaaggatagctatacaccttgacacggcagagatccagtgtaaaaaggtgcttcactagtttgtttgtc

SEQ ID NO: 722156 - DNA, 441 bp, Homo sapiens
aactcaggggcgagctgcagatccaggtcaccacctagaggggaggaacccctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaccagtgaacaccttgtgcacgagccctggtagatgtcagatgtctgttcaggaaagtcactgcaagacggcaggcactctacaagagactcagcatgaatcacagaatgcctg

SEQ ID NO: 722157 - DNA, 424 bp, Homo sapiens
aactcaggggcgagctgcagatccaggtcaccacctagaggggaggaacccctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaagacactgaactcctttgtgcacgagaccctggtagatgtcccgaatgtctgtttccagggaaaggtcttcggcaagatcgggcagggccaccgcct

SEQ ID NO: 722158 - DNA, 519 bp, Homo sapiens
ttcgacggtgtctgggatacatgtgcagaatgtgcaggttggttacataggtatactcatactgaatgggcaaaaactggaagcattccctttgaaaaccggcacaagacaaggatgccttctctcaccactcctatacaacatagtattggaagctctggccagggcaatcaggcaagagaaaaaaataaagggtatttgaataggaaaagatgaagtcaaactgtctctgtctgcagatgacatgactgtatatttagaaaaccctatcgtctcagcccaaaatctcctttagctgagaagcaacttcagcaaagtttcaggatacaaaatcaaggtgcaaaaatcacaagcattcctatacaccaataacagacaaacagccaaatcatgagtgaattcccattcacaatggctacaaagagaataaaatacttaggaatacaccttacaagggatatggagatgaagaaaacataacccttcttcaaggagcccaacctaccaaggtagacagac

SEQ ID NO: 722159 - DNA, 349 bp, Homo sapiens
  misc_feature (82)..(82): n is a, c, g, or t
caggatttgttagtctgatttactgacatgtcaagctttcacagttttccaacccataggaatttttgtacataccactcanaattctgaaaataacaactatttaccacaagtaatggggggaaaagccacacatactattttcatacttttttggagctaccagagggttcaattactttgagggggattacatcctaaagagcaaaaaccaattccaaggacagtaggaaagggaaagcggcagggctgtctcttcaaagagggccaatattcagatcttgttcttcatcccctgctggaagaacgaattcctcctggtcttaccgatgaccaagtcggccactgc

SEQ ID NO: 722160 - DNA, 518 bp, Homo sapiens
gggagggcggcgatcctagaggtatcccggcaaatcgtgaacctgttctaaagatgggtgataggggaggtccatgtgaaggaatgtatttgaacgcccatcaatgctagagattagggttggtctccaaggtcttagctatgtgaagtaatgccgcaataaacatacgtgtgtatgtgtctttatagcagcatgatttatagtcatttgggtatatacccagtaatgggatggctgggtcaaatggtatttctagttctagatccctgaggaatcgccagactgacttccacaatggttgaactagtttacagtcccaccaacagtgtaaaagtgttcctatttctccacattctctccagcacctgtggtttcctgactttttaatgattgccattctaactggtgtgagatgatatctcacagtggttttgatttgcgtttctctgatgggcagtgatgatgagcattttttcatgtgtttcaagggtgcataaatgtcttcttttcagaagtgt

SEQ ID NO: 722161 - DNA, 306 bp, Homo sapiens
gagttgggaccgtcacacatatcgatgatcaggagttaacaacgtgggtatgcgaccggccgcgcgaatgccgaagctgacccgtcgcagccgagtcttgatcggcgtcgcgcttgcggtagtggtgttgttgctggttgggggacggctggtcgatgcatacgtcgactggctctggttcggcgagttgggctaccgctcggtgttcaccaccgtcctggtcacccgcctggtggtgttcctgatcgccggcgcgctcatcggggccatcgtgttcgccgggatggcgctggcctacagcacatg

SEQ ID NO: 722162 - DNA, 453 bp, Homo sapiens
gatcagcatcgagaggaggctgagcacatgatcgtcggtaccccactcgatctcaggccacttgctgcccttctcgtccaaacgccggaccaatggcaaagactcactaccatgagggacatctgcagatgatttgctttggcctcctgggcttcacctgtgccataccagtgaagacaggctgattctggggatgttcgtcgaggaaaatgcgagttttgactactatacagtacccagatgctgtgcgccagcttgtggctaatactcgctgatccctatctgcgaatcagcaaggaaatctcctatggccccaacatgaatgcttgtgttctctgttagaataccaatgatcgtttagtacagcgtagagcccttccgtggtgcgtccaagtgaatggccatgaccataatggtatgactattggattgaggaaacgattgatcactgac

SEQ ID NO: 722163 - DNA, 359 bp, Homo sapiens
gtgatacaggcacactgactgatcgagtgctcatcatattctagggttgaatctgccgtgttgctagtgcaggacagccctttgctatgcctgaataattaccatcttgtacagtgatccggttaagaacgatctatgactcaggagactggattacgtctatactgctagactgccttagtgttcgtaggagggctgatgcgaatgtgacgtgtcacaccactcgggtgcgattacactatgaatcgctcaccaagagtctgggctttcgacggtatattaataacaggcctcggacctgatcagagcagtggctatcccaacatgagacttatatcttgtaacactgcgttgttgtg

SEQ ID NO: 722164 - DNA, 357 bp, Homo sapiens
ggactgtgtacaggctgtaacacagagcccatataactatgtcctctgaggttccattggaatgtaagtgtactgtgcatgatgcattaccgtacaaggattacattggctacaagatccataagtactattatggcctggcgctagaactaagctgacttgacagactcatttttgtgccaaactattcatacatgctgcttattccctagatattacttgtgaattagctaatgtaacatatgtacttgcataaggagttagactgtcatgaaatctattgacatttactgcggtgctttatgaacatgtatgcgcatcattctatggctagtgtacacccctgatacggcactt

SEQ ID NO: 722165 - DNA, 315 bp, Homo sapiens
aggtgactggcccactgtggcctactaatacttctctcagctcggtacatttccgcggtcgcgacgtacgcttattgatggcgccagctgcatgctggacgccatatgcctcctatcgcctataaatattccggagtatacgtagccggctaacgttaacaaccggtacctctagaactatagctagcatgtgcaaattgaaagcgctagatatcgcatcgcgcgcatgatcgtgtcatgcatgatcattgcaactctggcatccatactataggtgcccgggcttataattactctcagagtcgacagtcccat

SEQ ID NO: 722166 - DNA, 235 bp, Homo sapiens
acaacaccctcgaccgcaccctctacggcggccgcatgcccgcacattccgccacccgacaacacggtgtgatgatcggatttgccttgggccgcaacgcaatcgccgcatacctgcatcaaaaacagcagcagcgtaaaaccgcctgaacaccccacaggggatagatctacccgcaggccagtcacatacaactcacccctcacaccgaccacgccagcatcacaatcaccgc

SEQ ID NO: 722167 - DNA, 275 bp, Homo sapiens
cacgaggcgcctccggcgaggagaaaatccgcgagctggcgcagagtctgcggcaagggggcgtgagccttgcattcagcagcctcaagaagcaggtgcgcgaggtgttcgaggccggcggtctgattgccttgctgggcaaggaaaacatattcggctcatttgaaaatcgagtgggtaatggagttcccgaagctgcgggtcaagggcgggcgcagcccggcggagcgcacccttgacgcgcaggatcgggagatacgctggcccatggctgg

SEQ ID NO: 722168 - DNA, 287 bp, Homo sapiens
  misc_feature (121)..(121): n is a, c, g, or t
  misc_feature (123)..(123): n is a, c, g, or t
  misc_feature (125)..(125): n is a, c, g, or t
  misc_feature (128)..(130): n is a, c, g, or t
  misc_feature (156)..(156): n is a, c, g, or t
  misc_feature (183)..(183): n is a, c, g, or t
  misc_feature (200)..(200): n is a, c, g, or t
  misc_feature (204)..(204): n is a, c, g, or t
  misc_feature (206)..(209): n is a, c, g, or t
  misc_feature (211)..(215): n is a, c, g, or t
  misc_feature (217)..(217): n is a, c, g, or t
acctttctagtccacggcatttgaagagagcgaggagaaccattctgggaactctaggctatgaatgtttaaagatctggtcccctttatgagaatgcaagccgatccacatcctgacttngngntcnnnttctgacgaactgcctggaggagggnaatatataaaaataaaattggtgtcanttcttttctgctatccnccangnnnngnnnnnantaaatcctcatgtttctgcttcatattttgaaaaataacaattaaaacagacagctgtactgaaaaaaaa

SEQ ID NO: 722169 - DNA, 107 bp, Homo sapiens
agtgaatcttagagtatcccggcgaagcactacaaaggtcatagtgtgcttctggcaataatgcagtacttgtctggttggtcagtcattgttggaagatagctaat

SEQ ID NO: 722170 - DNA, 330 bp, Homo sapiens
tgcactgaccaactggcaagtgccttcactgacattttcaacctctccatgtctgagtctgtaatatcaacatgtttcaagcagaccaccatagtccctgtgcccaagatcacgatggtaacctgcataaatgactaccgacccatagcactcacttctgtggtcatgaaatgctttgaaaggctggtcatggctcacaaacaccattatcccagaaaccctagactagaggttggccgattaatcgaggttgactagaggttgaccgattaatcggaatggccaattttggtcgacgcggccgcgaatttagtagtagtaggcggccgc

SEQ ID NO: 722171 - DNA, 528 bp, Homo sapiens
  misc_feature (243)..(243): n is a, c, g, or t
  misc_feature (370)..(371): n is a, c, g, or t
aggttgaactttacctttattctgcttcctatacgtttttcaggctgcatttcctatatttttaaaccaatgtgttttaatcagtatattcagcaagttagcattaaattcaatattctaattattgtcatgttctaagattgagcatttcttctttttattaaatgttgaaatatacaagtcattatgttgtacattggtaactaaaaatattgctgaaagtgtaaaggagaaaaattctantttttatatctggcatagaaaagaaagctctaactttgttttcgttgctctttttattatagagaacacgctggttccgcagcgctagaagccattccgagtgtgtttctttataaagacagtagtnnatattctttattcttcgaaggcatgtgtgagaaattgaaagggcaaaacttatattgtctttgtttataaagaaatctgtcttagctccacccactagaagaaaaatactccaagaaattattttctcatttttacgtaatagggcttttttcttca

SEQ ID NO: 722172 - DNA, 314 bp, Homo sapiens
tcatatcggacttttaatcgttgaacaaaccaacctttaatagcggctgcatcttcgggatttcctgttccaacatcgatgtcgtaaaccctattgttgatatggactctagaatatgattgcgctgttatccctacggtaacttgttccgttggtccagtatagcataattgaatatagtatttcgctttgactggtgaactcttagcatgtactgctcgtaggttgggttctgatcctaggtcgtcccgagcgaaatttcttatgcatgttcgttactttagcacctgtgtgattgtttatcctaaagttca

SEQ ID NO: 722173 - DNA, 680 bp, Homo sapiens
  misc_feature (26)..(26): n is a, c, g, or t
  misc_feature (43)..(43): n is a, c, g, or t
  misc_feature (53)..(53): n is a, c, g, or t
  misc_feature (60)..(60): n is a, c, g, or t
  misc_feature (83)..(83): n is a, c, g, or t
  misc_feature (111)..(111): n is a, c, g, or t
gaatttaggttaagagggaggtattnaaaaatgggggtttccnttggggaccnaccttgncatgggggacttcaccctgatancagattccctggggtcccaccccagacntgaatcagaatatcaagaagtgagaccctggaacctacattttaataactattaccctaggtgagtttgatgcacattgaagtctaagaaccaatggctcctaggtaagagtaagggtttttgccacagtcaaactgagtttgaatcctggctctcctatttactagctgtgtgacctcaggcaagttacttaaccactttgagcctggtttcatctgtgaaatcaaagtagtaacacctgtctcataggatagtgttgaggttacaaaggtaatgcatgacaattcacaattgcaaaaatatggaaccagcctaaatgtctatcaaccaatgaatggataaagaaaatgtggtataaatacaccatggaatactactcagccataaaaaggaacaaaataatggcattcacagcaatctggatggagttggagaccattattctaagtgaagtaactcaggaatggaaaaccaagtatggcatattctcacttttaagtgggagctaaccaaacaccacctgttccccaaaactatttaaatgaataaatcaatcattgtacccaaca

SEQ ID NO: 722174 - DNA, 847 bp, Homo sapiens
accacaaacaaaaaccaaacaaaggctagaagccgggttaatcggagaggctggcggcttggtgccagccccctctgcccagcagctgttcctccctatgggatgtatcacccccaggaggaaagccagcctccaggatgcctcatatcgccatacccagggccccggtgccgggccagccatgcacacccccggacagtgagcccccgagggcctaccctggtgcagcaccagtgacctaccctgtgtcagctccagtgccaactccctggatcgagcaggcagccagtgccgatgctacgccaggtatacccggggtctgggactgtcaccccgctgtgaccctcaatccagtttggaagccgaggcaccatcactgatgctcccggctttgaccccctgtgagaatagcgaggtcctgcggaaggcatgaaaggcttcgggacggatgagcaggccatcattgactgctggggagtggctccagccaatgcagcggcagcagatcctactttcccgttcaagacggcttacggcaaggatttgagtcacaaggatctgaaagtctgaacgtgtcagtgaaactttgagaagacaagtcgttggctctgatgaagaccccagtcatcttctgacattatgtgatgatacatcggcacgccgtacaacggggtcggccacttgagtgacggcctggccgtgattgagatcctcgcgttcccgacagacaactgagcacattccgagaattaaacagagcctacaaagccagaattcaaaacgaccctggaagagggccttcgaagcgaaactcagggcattccagcggtcctatgtctcctctagc

SEQ ID NO: 722175 - DNA, 129 bp, Homo sapiens
ccctgcgttatgactctagagtatccccagctcgcttattctcccagcacaaagggcatcaaaagactgttgtgaggggaacgcaaggcgaggggtcattgggatttaccatggtattagaggctgccc

SEQ ID NO: 722176 - DNA, 898 bp, Homo sapiens
  misc_feature (404)..(404): n is a, c, g, or t
  misc_feature (440)..(440): n is a, c, g, or t
agggaaggagctgacaggaaggcgctgtgcagagcctcctccaacctgcgccccatccccaccaggttactgactcaggagtcatttacaaaagggcgtagttctctgtcggagatggagaggcaggaacgctgcgtcatatgaagacatggcccatttgcagagcacatcggcgaggcgagctgtggaactgtccagcggccgtccccattccctggtccgaaagtgatcctacgtctcatccgcatgtatcatggccgagctgccctggcagaagttgccctgtgatccagtcacattcgaatgttcgggggagcctctggcttggcactagtcgctagtccgttgtcacggtctgggtgcatagggagcggggactcagagggcgcagatacggagccaanagctcaggtgcaacagattaccttgtgacacctggncgcgtttcgctccgaccccccaaggacttcggctactctccccatagtaatccccatcacactggtgttgcccagctccccggagtcggagctcaaacgagggggcctggaactatagcctgagagcgctcggggggcttaggcacgaacccagttggcgccatgtagcgaggggcgtatcctttatggcaagtgccgggggtcctcccccgggtgggcaacgcgacccgttattgtggggggacgttggtggtcctgattcgctcattgtacgtgtggggtgccacttgaggggtctttgtgcattggacgcccttgtggcccgtatgggtttgccactttcggagcctcggggccaccccgtattacgaaagttcgcgggcggtttcatggggtggatggcgcctccgccgcgtgctgggtttccggacattcccacctttgctatcggtccctcg

SEQ ID NO: 722177 - DNA, 151 bp, Homo sapiens
tggtcctccagagggagactttcttcctcaggtggggggagaagaaagtgctttattgtctttcccacatatttggagggatgtcatcttcctaatatgaagtttatttggaggcacacagtcatcctcctatggtggaatctaatcccgg

SEQ ID NO: 722178 - DNA, 1075 bp, Homo sapiens
gatgatacagttgcggatgtgtatctgggatatggtgacattaaacagacatagaatgaatgtagctgctcatatctaacactgtgtccattgtctagggctcaaatgcccccgttacccctgtatcgtatgtagggacacttctgatgtgactatcactggtctgtgtgagttctggggaccgtataaagatgtgtctcgtctcactcatactaggcattgtgagtggggttccatgctataccctggggaagtatgagcgttgccaatcgtggtacggtatgttcctgctcgaccgttgacctatccgttgaagggggtactaagcgatctgatcctaggctgattgtatattagcactagacgaaagcttgcatctaaaagaactatcattcaccttggaccacgatggagcgtgtctgtgagaacctggtgtttccctggtccgagttactcgttctctgatggcacggcgctgctttcaaaaaagagttgcatcatcggccactagagaaatcgttgtgagaagatctatattggatggggccatggtgtaaccttatcccatgtgatggggccaggtgattcaagaagccctaagtgaccttcgactgagatcactgatcaaatctagacaggaaggcagtcaagcctctgtgtggttattgtccactagtgttgaagttgactcgctggcggagtcagtgctgaaaggctgcgtgggggtgagaccaggagagcgaggagtttcaggcctccccaagtccttgctggttgcacggaagggcgggccctgggagaaggttgagcttagttcaagattagcacctgcaagtgggcagggcgcttccagacctggggcgaccatgctgctggacctggagaagaccgatgtaggaaaagatcaaggcgcacattggcatggggggtcctaaagttttctggaaaacaaaccaccgggtctgtggggcaaagacaagcctgatcccgatctattgaaagtacaggccatataatataaataaaccattaatgcttcgatgatacaaaatcggatatccttaataactagtcg

SEQ ID NO: 722179 - DNA, 232 bp, Homo sapiens
agcccctagggtttagccttttttcaccggggccctaagaaagatgaagccctggtttttattttaaggccatgaagggtttttttaggtttttcggctttgccaatggggttggggaatttgaaaacctgccgggcttggttggggataattttaggggggggcccgggggataattcccccgggggattttttaaacggggggcccccttttaaaaggatggggcttcca

SEQ ID NO: 722180 - DNA, 1680 bp, Homo sapiens
atcttctctgtcaggacgacgcaggcggggcgccggcggcggcaggaggaatacaggagcgacgacctgattcgttctgttatctagtgttatagtctgctgtgtcgttgtgttggtgcagttcccctgtcctgctttgggagttgctactgtgcccgcacgtacgtgtgtgtgcaccttcgtgtccaccctcgttggtgtcttcgtttgagtgagtagtgatggggctcgctctcttgtttgccacgctgtgagtctgcccacagtggtgatgatttttccccgcggcctccaagaagatgtttgttctgttggtggatgaaccctcctcggcttgggtagaagtatgggtggttgttcctccccaccgggaggtttgctcctgtgtatagttgagcgggatggtgtccacaccgttcgtgtttgtgtgtctccctccccggccttccttcatgtgggaacatcttcttggggacaacggggtgttttccacgagagaacagtcgtgttgtgggggcgtcctattctccctcgctgtgtgtttgtccgctccctcttcgggcgtgttgtgtgcggccctccctcgtggggggtctccaccatgtagggctcttttctttcttacccgccctggggtgttgtcctcaggcgcccggccattggttcgtgagggtcagccgcgtggttcgttaacttgttgtgtttattgggaggtaggcgggttctttctctcccagagcagtgtgggtggttgatttgttgtgggcgcggcacccacgccccgactgtgcccaaccggagttagacaaaactcatggtgggtggtccccccgcacataatggtgggtgttgatcttagtatcatcaaagggctgtatcattgggtggtataacacagtcattgtctagttgtattgtgtagtctgtttatttacatagtgagtggaattaagagtttttttatagaagaaattttttgcgccccacgagaaagggcgggtatttataggagtcatataaggtgtgttatataaaaagttgttagatagattggtagtacatgatataagcgggagtgagaaaagtagagagggagagagattttaagttgagagaagaagtgcctctaaatagttaacgccccccgcggtgtggtgtctccccccctctcctcgtttgttgtagaattttctccccggctcccctggggcccacagtccccgacggctgttttttgttttgtttgttttttttttccctctttgtgcctccagtctgccccggttctttgaggtcttctttttcttcttacctcccatggttcctcccatttatttggggggaaatacccttgacgccacgaataccatgggaaaagagtctcttaccccctttctgcttcgaagttccatttttatccccttccctgtcttggacccaaaacctgtatggaatccacccccccgagctctgttgggaaaaaaggaaaacctgcgtcccttccgctctgctggaaactggagggtgctaggcccctgtgtagtagtgccatagaattttagccttttttcccccccttctctgtatattgggctccgagagtaccctgtgtctctaagtgaatatggcacccttagcctttaccccccaagtatctgtctacctttctccttggtttta

SEQ ID NO: 722181 - DNA, 1012 bp, Homo sapiens
  misc_feature (737)..(737): n is a, c, g, or t
gagcaataagacgaactcgtgctatctgtctcattagcgtctcagaatgttaggagacggtcttgagatactgggtgactcgtcttcaatcttaacctggctcgatccgtccgcctcatctctcacggcattgcgtttcatactgggagcagtatgcttgagggagtttcttcctgtttgctgtggacatgaacagggccagctcattgtggttgagtggagactctgttcatgggccacacgcaatgcagtgcaggctctcacatgcatttcctgtcctccatattattaccgcaacccgaaagattgagacgttagacagccaagtgcaggacctgtaaattttgttaccgtgcgagggaacttcgcatataagtcataacctcgtcttgtggggcctcctagattcgcgattacggagtttgattttcggcgatcaggtaaggtgcgtgtacgcctgaatttcgtccgcgagttgggcgtaagcgaaaccaaggcagtggcagagtgtcccatggaacgttcttacacatgcaaaaatcacttatttcaccggcgttagcgacggaccggggtgctatatctacgggacatactggctacttgacaatctggtggaatggcaataggcgagtaagaattcattggaccacagtccgttcgctaagaattgtccattgcgcccttaggaagatctttgcatgtacgggggccgtatttgagcctctatagtcgcncctgcttcttacctgcccctcctagagacctaacaatactcctgtgaccttcctgggagaactcaactttccttttgatgcagggagtgtgaccgctttaataagaaagatagagtgcgcatcttgagcagaccgccaccaggatgggtgacccgattggtttagctgtgtcgagtaatacttccggaaaggcaagcgtcggggcgactacaagactaagaacccggagcagagggccagaagcagaggtttcggagaacgcctaacaagggctt

SEQ ID NO: 722182 - DNA, 385 bp, Homo sapiens
  misc_feature (130)..(130): n is a, c, g, or t
  misc_feature (274)..(274): n is a, c, g, or t
  misc_feature (278)..(278): n is a, c, g, or t
ccactttcaccagcagggaaaccgaagcctagccaggcttccggtccgtgcttccacctctctgccggttagaagacacctgtgcccagcatcatcagctggttcgttcggtccttcaagtacgtgtatnggccttcgctttgaggtcagcggacagaagaaactggaggtggatggtccctgtgtcatcatctctaatcaccagagcatcctggacatgatgggtctcatggaaatactccctaagcgctgtgtgcagatcgccaagcgtgantaantgttcacagggcctgtgggctccatcatgtaccttgggggtgtctacttcatcaaccgccagcaagccagaactgccatgtctgtgatggccgacctgggcgacctc

SEQ ID NO: 722183 - DNA, 294 bp, Homo sapiens
cggtgccagggaggccgttgtcagacatgccagtgaagagaaatattctgcagcctgtgccgccctatcctgactatagacttctatgtaacaaactgaaaaactgccttccagacagcaagaaaccctcacctaatagcaggagcccgctggcagtgaggctaggaaccagaaaccagaagtcttgcctcccagctcttgtctggaagatagaaacctcagagtgcaaaatctggcgaggggtttcaggagagacgggaggccgggtggcactgaggacaagaaatccccagg

SEQ ID NO: 722184 - DNA, 235 bp, Homo sapiens
atctagaaactcacacattagtcccggctcgactagaaataagcacgttatctggcagtaacacaaagacgcaggactcagtgagagatctagcaccttctacagcaggcccagatcaacaaccacaacactctcacctgccagcttgacaagccataggagtaggtgaaagaatccaccagctcccggagacaagcatgtgttctactcactcaaacagtgtcaccttgggcaa

SEQ ID NO: 722185 - DNA, 142 bp, Homo sapiens
taggcaaatctctcactactcccaggataacggtcttaccttacaggactacagtgagaaacaaaagccatgacaacaagcaaatgtacctctgcaaaacctataaagcactactacaaataccaagcttacaatgcataga

SEQ ID NO: 722186 - DNA, 355 bp, Homo sapiens
gtcctcagccatcgcttggttaatctgtccctgtgcagctgttctgagttgggggagatggattgattggctgctgaggactcctctaatgctctttaccattagcacagcagagctttgcatctgttggcatcagcaggactctctgcttaacggccagattaatagaatgaggaagccgaggaaggtttaaatccctggtgtcagcttcccggctcggcaggctgcccctggggaggcaccaaggaagccctgacttgcagtgatgaatgctcctctggtctccagatggtgactgccagcgaatcaggtgacctagaaatgaaaaaaaaataaaaaaggagttcagtgagtg

SEQ ID NO: 722187 - DNA, 191 bp, Homo sapiens
atgaaccgtgcgactggtcgagttgacccacattcgcccgagcctgggcgagatctaccgagaggcggcccagtcatgacgaacacatcatcggcctggcgtctcgtcgcttcccgcgaggtcgacgtcaagctgcgcgacaaaggattcattatctcgatgatcatcacggtgcttctcatcgtggctat

SEQ ID NO: 722188 - DNA, 1026 bp, Homo sapiens
  misc_feature (60)..(60): n is a, c, g, or t
  misc_feature (333)..(333): n is a, c, g, or t
  misc_feature (688)..(688): n is a, c, g, or t
  misc_feature (920)..(920): n is a, c, g, or t
  misc_feature (933)..(933): n is a, c, g, or t
  misc_feature (937)..(937): n is a, c, g, or t
  misc_feature (943)..(943): n is a, c, g, or t
  misc_feature (954)..(954): n is a, c, g, or t
  misc_feature (958)..(958): n is a, c, g, or t
catccaaccaggcagtccgcctgcacagcgctgtccctgctcatcgggctggaggacagnagacagaaccctaaaaccacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagatgcagagaaactcacntggtggacaagccctttgctgccaagggaggaccagctgcatctgtacagaacatgctattccaacagagtactcatccaagtgccaggaatgcaagaagaccatcatgccaggtacccgcaagatggagtacaagggcagcagctggcatgagacctgcgttcatctgccaccgctgccagcagccaaattggaacctaagagtttcatccccaaagacgaatcagaatttctgtgtgccctgctatgagaaacaacatgccatgcagtgcgttcagtgcaaaaagcccatcaccacgggaggggtcacttaccgggagcaggcctggcacaaggagtgcttcgtgtgcaccgnctgcaggaagcagctgtctgggcagcgcttcacagctcgcgatgactttgcctactgcctgaactgcttctgtgacttgtatgccaagaagtgtgctgggtgcaccaaccccatcagcggacttggtggcgcaagaatacatctcctttggagggacggcagtggcataacgactgctttaactgtaagaagtgctccctctcactggtggggcgtggttcctcacgagagngacgactcctggncccnatgtgngaagcctctgnttcnccgagaagttgtgttgtgtctcccccagtttttgtttctttcccccggacttgcttctgttcttcagc

SEQ ID NO: 722189 - DNA, 1471 bp, Homo sapiens
  misc_feature (587)..(587): n is a, c, g, or t
  misc_feature (1436)..(1436): n is a, c, g, or t
ggcccctttcacttgtgtccatagcccgactgaccgctctgtccgatcgcatcattctaatgcactacgacgacctgttcttcgtcatcgtccgatccctctgcgaaggccatgggctataaggtaggagagagtcctctgtggccagtggactcaggtgtcagagtaagaacatgcccggcgatgtcgaccgatagtcacaggcacccagcgaatgcacttggtctatttacacacgtcctgcctcgctaccaatttgccgccctgcttagctcgtcacagtggtgaatgaccataccgtcatctgtgtaacaagagccctaggtactagtgcgcagctcctgtcacatcttgtaaccgcttattcatcgaacgctccagattgaaatgttgctgagattcgagtagatacctttctcgccgttgctcagtcggtcgatgctagccgacgatagattttgctcgatggaatcgtttaataaccacgaaatcttgcgccttccccccataactccggcgagcgtagattctggttgtcttcctgacagatgcagcgcctacagatgcatgcgtcctttaattctggnagtttgtggcgcctttgtatatggtacacgaaagactcttaagacccttcgtagtgtgcctccatatcccccattggcgcccgaccactgttaggtagatccgaaatatacatagtcccaaagaagcacatacccagacctaagacccacagaccccggctaattacggttgtgtcagcaccaccgggttgcctttttagaaggaaaatttcccccaacgtttgcattgccactggcggggcaccacacccaattttttgccgatttgccttcccacagtaggagagcagagaaccaaactaccggagaggacctcctcccgcacaggggaggactccctatagtagtggcgggggggcgtggaccgagagaggaaaaacaagagagggttctcaaactcgcactcttgtggtgcacccccgctggggtccccacaaactaaggtgtgtgggtggggccccagtgatacccccccaggagcgtataactccggggcgtctacgacacaggccgtgggcctaaggagaattattggcccgtcggccgtttacccgcgtatatagtgtgagaagactcgcgaacatcccaatttccccgaagagaaaagccccgaaggagagaaaaaaacccgcggcggtcccacgaagaccgggggcagcaaacacaccgtggggggggaaaaccgttggtggcaagagaatatatagcgtggatccccccacaaaacaaaacccaacagggcgagggtgtcccgtcgagccccgccacttctgtggagacacacgcgctatccacacaggggtggtgtattgtggaacgaaggaagaattccaccccacagcagcgacngctctgatgaacgaagcagcgaacacaaagatgcc

SEQ ID NO: 722190 - DNA, 1346 bp, Homo sapiens
  misc_feature (653)..(653): n is a, c, g, or t
  misc_feature (1008)..(1008): n is a, c, g, or t
  misc_feature (1240)..(1240): n is a, c, g, or t
  misc_feature (1253)..(1253): n is a, c, g, or t
  misc_feature (1257)..(1257): n is a, c, g, or t
  misc_feature (1263)..(1263): n is a, c, g, or t
  misc_feature (1274)..(1274): n is a, c, g, or t
  misc_feature (1278)..(1278): n is a, c, g, or t
gagtcttctggccccgagagggagaggtggggataggaccttcctttagtcccctccgtagtggaacgaaggattctttatggtcatctgtggtgttcatttcgtaaagaagcatctgcagggtaagaaggaaaaacgtccaccttgcaaatatatcccaggcacatgcctcctgagaagtgaccccctcctccctccgcctcccccggcacgtcctggggcttctccagtctcccgctcctgggaccaggcagagatcccggcgtgggcagacccctgccaccgcgcccaggcctcgtccgaaactcgcgcccgagagcccacgccggaggcgacgctcccgataactactgtgctcccaagacccggagggcacgaagaaaggagccctggcaaacacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagatgcagagaaactcacntggtggacaagccctttgctgccaagggaggaccagctgcatctgtacagaacatgctattccaacagagtactcatccaagtgccaggaatgcaagaagaccatcatgccaggtacccgcaagatggagtacaagggcagcagctggcatgagacctgcgttcatctgccaccgctgccagcagccaaattggaacctaagagtttcatccccaaagacgaatcagaatttctgtgtgccctgctatgagaaacaacatgccatgcagtgcgttcagtgcaaaaagcccatcaccacgggaggggtcacttaccgggagcaggcctggcacaaggagtgcttcgtgtgcaccgnctgcaggaagcagctgtctgggcagcgcttcacagctcgcgatgactttgcctactgcctgaactgcttctgtgacttgtatgccaagaagtgtgctgggtgcaccaaccccatcagcggacttggtggcgcaagaatacatctcctttggagggacggcagtggcataacgactgctttaactgtaagaagtgctccctctcactggtggggcgtggttcctcacgagagngacgactcctggncccnatgtgngaagcctctgnttcnccgagaagttgtgttgtgtctcccccagtttttgtttctttcccccggacttgcttctgttcttcagc

SEQ ID NO: 722191 - DNA, 234 bp, Homo sapiens
aaaaaaaaaaaaaacgctcccactacataaaagctaggaccaagggcctcacggctaaattttaacaaacatttaaagaggcattaataccaatcttactcaaactattctgaaaaatagagaaggagtgaatatttggaaatgcattccatgaggccagtattactgataccaaaaccaaagacacattaaaaaaaacaaaactacagaaaagtatccctgaagatggctagg

SEQ ID NO: 722192 - DNA, 1486 bp, Homo sapiens
  misc_feature (192)..(192): n is a, c, g, or t
  misc_feature (793)..(793): n is a, c, g, or t
  misc_feature (1148)..(1148): n is a, c, g, or t
  misc_feature (1380)..(1380): n is a, c, g, or t
  misc_feature (1393)..(1393): n is a, c, g, or t
  misc_feature (1397)..(1397): n is a, c, g, or t
  misc_feature (1403)..(1403): n is a, c, g, or t
  misc_feature (1414)..(1414): n is a, c, g, or t
  misc_feature (1418)..(1418): n is a, c, g, or t
gagaaggaggagaagtacagctaggagcaggctggagtaaactcggccgaggagggtacgggccgtgaccgccagcccggggcgggggcacggcaaccgcgaggcctgggggcgcccgcccccctgtcgcctcccacagtccgcgtgattgcccagacctgagacctgatgtgctgtgccaatcatccatantatactgtgtcgaacactagcacatctgtgcgaggagtttactccgacgtggtcgggcacgtctgtcgcagcgctccactcggccggcagcggagccgcagccaccagccgcccgcgccctccagccccgtccgggagtccccggcccgctgcggtgccgtgagtacctcctaacccacctgctgccccgcgagggaggccgaggggcttagccaccagggctcggaagtgggggccgaatccggtgcgagacccaaggagaggggagcagagccggagttggggagactgtggctgaaaactgtgtcttcctggagactaggctggcattttgactttggtggttcgctgaaacagccaaggagatcagagatatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagatgcagagaaactcacntggtggacaagccctttgctgccaagggaggaccagctgcatctgtacagaacatgctattccaacagagtactcatccaagtgccaggaatgcaagaagaccatcatgccaggtacccgcaagatggagtacaagggcagcagctggcatgagacctgcgttcatctgccaccgctgccagcagccaaattggaacctaagagtttcatccccaaagacgaatcagaatttctgtgtgccctgctatgagaaacaacatgccatgcagtgcgttcagtgcaaaaagcccatcaccacgggaggggtcacttaccgggagcaggcctggcacaaggagtgcttcgtgtgcaccgnctgcaggaagcagctgtctgggcagcgcttcacagctcgcgatgactttgcctactgcctgaactgcttctgtgacttgtatgccaagaagtgtgctgggtgcaccaaccccatcagcggacttggtggcgcaagaatacatctcctttggagggacggcagtggcataacgactgctttaactgtaagaagtgctccctctcactggtggggcgtggttcctcacgagagngacgactcctggncccnatgtgngaagcctctgnttcnccgagaagttgtgttgtgtctcccccagtttttgtttctttcccccggacttgcttctgttcttcagc

SEQ ID NO: 722193 - DNA, 201 bp, Homo sapiens
aaaagctctcgaagcttgaagagacgtgacctcggatattccgtatagctctacctcgcacttttgtacgtatatactcacgaggaaatctaccttgtagtgctgatttactcatacgtacgctagtgtatctgcatctgcaggatgacgacttcgtttgactttgttatcacctgctaacgcacattactctatagccac

SEQ ID NO: 722194 - DNA, 1300 bp, Homo sapiens
  misc_feature (192)..(192): n is a, c, g, or t
  misc_feature (607)..(607): n is a, c, g, or t
  misc_feature (962)..(962): n is a, c, g, or t
  misc_feature (1194)..(1194): n is a, c, g, or t
  misc_feature (1207)..(1207): n is a, c, g, or t
  misc_feature (1211)..(1211): n is a, c, g, or t
  misc_feature (1217)..(1217): n is a, c, g, or t
  misc_feature (1228)..(1228): n is a, c, g, or t
  misc_feature (1232)..(1232): n is a, c, g, or t
gagaaggaggagaagtacagctaggagcaggctggagtaaactcggccgaggagggtacgggccgtgaccgccagcccggggcgggggcacggcaaccgcgaggcctgggggcgcccgcccccctgtcgcctcccacagtccgcgtgattgcccagacctgagacctgatgtgctgtgccaatcatccatantatactgtgtcgaacactagcacatctgtgcgaggagtttactccgacgtggtcgggcacgtctgtcgcagcgctccactcggccggcagcggagccgcagccaccagccgcccgcgccctccagccccgtccgggagtccccggcccgctgcggtgccgacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagatgcagagaaactcacntggtggacaagccctttgctgccaagggaggaccagctgcatctgtacagaacatgctattccaacagagtactcatccaagtgccaggaatgcaagaagaccatcatgccaggtacccgcaagatggagtacaagggcagcagctggcatgagacctgcgttcatctgccaccgctgccagcagccaaattggaacctaagagtttcatccccaaagacgaatcagaatttctgtgtgccctgctatgagaaacaacatgccatgcagtgcgttcagtgcaaaaagcccatcaccacgggaggggtcacttaccgggagcaggcctggcacaaggagtgcttcgtgtgcaccgnctgcaggaagcagctgtctgggcagcgcttcacagctcgcgatgactttgcctactgcctgaactgcttctgtgacttgtatgccaagaagtgtgctgggtgcaccaaccccatcagcggacttggtggcgcaagaatacatctcctttggagggacggcagtggcataacgactgctttaactgtaagaagtgctccctctcactggtggggcgtggttcctcacgagagngacgactcctggncccnatgtgngaagcctctgnttcnccgagaagttgtgttgtgtctcccccagtttttgtttctttcccccggacttgcttctgttcttcagc

SEQ ID NO: 722195 - DNA, 1601 bp, Homo sapiens
  misc_feature (192)..(192): n is a, c, g, or t
  misc_feature (534)..(534): n is a, c, g, or t
  misc_feature (557)..(558): n is a, c, g, or t
  misc_feature (577)..(577): n is a, c, g, or t
  misc_feature (587)..(587): n is a, c, g, or t
  misc_feature (908)..(908): n is a, c, g, or t
  misc_feature (1263)..(1263): n is a, c, g, or t
  misc_feature (1495)..(1495): n is a, c, g, or t
  misc_feature (1508)..(1508): n is a, c, g, or t
  misc_feature (1512)..(1512): n is a, c, g, or t
  misc_feature (1518)..(1518): n is a, c, g, or t
  misc_feature (1529)..(1529): n is a, c, g, or t
  misc_feature (1533)..(1533): n is a, c, g, or t
gagaaggaggagaagtacagctaggagcaggctggagtaaactcggccgaggagggtacgggccgtgaccgccagcccggggcgggggcacggcaaccgcgaggcctgggggcgcccgcccccctgtcgcctcccacagtccgcgtgattgcccagacctgagacctgatgtgctgtgccaatcatccatantatactgtgtcgaacactagcacatctgtgcgaggagtttactccgacgtggtcgggcacgtctgtcgcagcgctccactcggccggcagcggagccgcagccaccagccgcccgcgccctccagccccgtccgggagtccccggcccgctgcggtgccgtgagtacctcctaacccacctgctgccccgcgagggaggccgaggggcttagccaccagggctcggaagtgggggccgaatccggtgcgagacccaaggagaggggagcagagccggagttggggagactgtggctgaaaactgtgtcttcctggagactaggctggcattttgactttggnacggagtctcgctttgtcgcccnnggctggagtgcagtggcancgatctcagntcactgcaagctctacctcttggttcacgccattctcctgccccagcctcccaagtagctgggactacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagatgcagagaaactcacntggtggacaagccctttgctgccaagggaggaccagctgcatctgtacagaacatgctattccaacagagtactcatccaagtgccaggaatgcaagaagaccatcatgccaggtacccgcaagatggagtacaagggcagcagctggcatgagacctgcgttcatctgccaccgctgccagcagccaaattggaacctaagagtttcatccccaaagacgaatcagaatttctgtgtgccctgctatgagaaacaacatgccatgcagtgcgttcagtgcaaaaagcccatcaccacgggaggggtcacttaccgggagcaggcctggcacaaggagtgcttcgtgtgcaccgnctgcaggaagcagctgtctgggcagcgcttcacagctcgcgatgactttgcctactgcctgaactgcttctgtgacttgtatgccaagaagtgtgctgggtgcaccaaccccatcagcggacttggtggcgcaagaatacatctcctttggagggacggcagtggcataacgactgctttaactgtaagaagtgctccctctcactggtggggcgtggttcctcacgagagngacgactcctggncccnatgtgngaagcctctgnttcnccgagaagttgtgttgtgtctcccccagtttttgtttctttcccccggacttgcttctgttcttcagc

SEQ ID NO: 722196 - DNA, 1555 bp, Homo sapiens
  misc_feature (488)..(488): n is a, c, g, or t
  misc_feature (511)..(512): n is a, c, g, or t
  misc_feature (531)..(531): n is a, c, g, or t
  misc_feature (541)..(541): n is a, c, g, or t
  misc_feature (862)..(862): n is a, c, g, or t
  misc_feature (1217)..(1217): n is a, c, g, or t
  misc_feature (1449)..(1449): n is a, c, g, or t
  misc_feature (1462)..(1462): n is a, c, g, or t
  misc_feature (1466)..(1466): n is a, c, g, or t
  misc_feature (1472)..(1472): n is a, c, g, or t
  misc_feature (1483)..(1483): n is a, c, g, or t
  misc_feature (1487)..(1487): n is a, c, g, or t
gagaaggaggagaagtacagctaggagcaggctggagtaaactcggccgaggagggtacgggccgtgaccgccagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctcctaacccacctgctgccccgcgagggaggccgaggggcttagccaccagggctcggaagtgggggccgaatccggtgcgagacccaaggagaggggagcagagccggagttggggagactgtggctgaaaactgtgtcttcctggagactaggctggcattttgactttggnacggagtctcgctttgtcgcccnnggctggagtgcagtggcancgatctcagntcactgcaagctctacctcttggttcacgccattctcctgccccagcctcccaagtagctgggactacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagatgcagagaaactcacntggtggacaagccctttgctgccaagggaggaccagctgcatctgtacagaacatgctattccaacagagtactcatccaagtgccaggaatgcaagaagaccatcatgccaggtacccgcaagatggagtacaagggcagcagctggcatgagacctgcgttcatctgccaccgctgccagcagccaaattggaacctaagagtttcatccccaaagacgaatcagaatttctgtgtgccctgctatgagaaacaacatgccatgcagtgcgttcagtgcaaaaagcccatcaccacgggaggggtcacttaccgggagcaggcctggcacaaggagtgcttcgtgtgcaccgnctgcaggaagcagctgtctgggcagcgcttcacagctcgcgatgactttgcctactgcctgaactgcttctgtgacttgtatgccaagaagtgtgctgggtgcaccaaccccatcagcggacttggtggcgcaagaatacatctcctttggagggacggcagtggcataacgactgctttaactgtaagaagtgctccctctcactggtggggcgtggttcctcacgagagngacgactcctggncccnatgtgngaagcctctgnttcnccgagaagttgtgttgtgtctcccccagtttttgtttctttcccccggacttgcttctgttcttcagc

SEQ ID NO: 722197 - DNA, 664 bp, Homo sapiens
agcggagcgaggcctcacacccggcgctccaagttaggggctggaggcgtcccggcttcctccctcccggaggcgggaccggccccgccccggccgcgggtcgctccggaggcccctcaccagcgtcgcatagatcctggcctccaccgaggcgcagcgcactcttcagccggccggcaggacatgacacagcacagagcggacaccgcgcagatactcccgcaggactgctacccaccacaaggccatggcgaccagggcgctcagacatccacatatgggccagaagcaacgggcaacaggcgagcggcgtcgagatatacatgacatcgagaccgccaaaagctgagtgggatgacgaccaatccatagaacaggccgtacgcaagtaccaattataaacacaaggacgcagcgggaactggccgcgacgctcgagattgccactaacactgagtacaagggacctcattggggagtgattgtagagaaaccacatagcaagagagagagacaaagaagaacgagacagacagtgtgtgagactactattatgcaagaaaattgtaagccgcagatgcgactttgggtgtgtgcgtggcagacctttcagaagggtgtgatgaatggatgaatgacgccaagggacaaaaggaagggagat

SEQ ID NO: 722198 - DNA, 1300 bp, Homo sapiens
  misc_feature (192)..(192): n is a, c, g, or t
  misc_feature (534)..(534): n is a, c, g, or t
  misc_feature (557)..(558): n is a, c, g, or t
  misc_feature (577)..(577): n is a, c, g, or t
  misc_feature (587)..(587): n is a, c, g, or t
gagaaggaggagaagtacagctaggagcaggctggagtaaactcggccgaggagggtacgggccgtgaccgccagcccggggcgggggcacggcaaccgcgaggcctgggggcgcccgcccccctgtcgcctcccacagtccgcgtgattgcccagacctgagacctgatgtgctgtgccaatcatccatantatactgtgtcgaacactagcacatctgtgcgaggagtttactccgacgtggtcgggcacgtctgtcgcagcgctccactcggccggcagcggagccgcagccaccagccgcccgcgccctccagccccgtccgggagtccccggcccgctgcggtgccgtgagtacctcctaacccacctgctgccccgcgagggaggccgaggggcttagccaccagggctcggaagtgggggccgaatccggtgcgagacccaaggagaggggagcagagccggagttggggagactgtggctgaaaactgtgtcttcctggagactaggctggcattttgactttggnacggagtctcgctttgtcgcccnnggctggagtgcagtggcancgatctcagntcactgcaagctctacctcttggttcacgccattctcctgccccagcctcccaagtagctgggactacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggtacctgctgcgggcctctgcgggtccccggcgctcccctaggaaacacgggtttctctgtggtttgtgctgaagccctgatccaccactgaagtctgtctcttgagccccctctgaggggcgtggaccctgcgtgtagcctttcggaagcttcttccctctagcgaatgtgatctctgcccacaagcactgggtgagggccttgccaggacttttgtgcttagtatctctaagtacattttctgtattctagcaattagtgcccttatctaactacccagctgcctaccaatactggaactttcttaagggtggtgctctcttcctcttgtctgtttgccccgtggtgagtaacgtggagcaggtgctgtgctcagtcaatatttgatgaatgaatgtgtacatgagagaaccagagttggttcctggataaatgggcacataaaagcacaaagtccttgga

SEQ ID NO: 722199 - DNA, 132 bp, Homo sapiens
cgctcacagtgctggtggttgagttgtgcctccgctgcactctggcccaggtatgtcaggatgccagatgctttctcttgcctctctttctcctgtcgcttttcttcctcgtactctttattgcctcaacca

SEQ ID NO: 722200 - DNA, 163 bp, Homo sapiens
  misc_feature (94)..(94): n is a, c, g, or t
gcctcttcctgagcgatacgcgcagtcactcgtcgttgtagccagtggtgagcaccaccggcagccagggatacagggcctcgattgcgtccanaactccaggccgctcatgccgggcatggagatgtcggagaacaccacctgaaagctttccgggttgggg

SEQ ID NO: 722201 - DNA, 193 bp, Homo sapiens
caggacttaagactggtcatcatccacaaatataaaaaaattagccaggttgtggtggcgacatgacccgtattcccagtctacctggccacgcttgagtcagagagcatcgattggtggcccaggaggttcgacattattatattgacgctgtagattgccccatcatgtcactcctacgtcgctgtcttga

SEQ ID NO: 722202 - DNA, 1430 bp, Homo sapiens
  misc_feature (192)..(192): n is a, c, g, or t
  misc_feature (737)..(737): n is a, c, g, or t
  misc_feature (1092)..(1092): n is a, c, g, or t
  misc_feature (1324)..(1324): n is a, c, g, or t
  misc_feature (1337)..(1337): n is a, c, g, or t
  misc_feature (1341)..(1341): n is a, c, g, or t
  misc_feature (1347)..(1347): n is a, c, g, or t
  misc_feature (1358)..(1358): n is a, c, g, or t
  misc_feature (1362)..(1362): n is a, c, g, or t
gagaaggaggagaagtacagctaggagcaggctggagtaaactcggccgaggagggtacgggccgtgaccgccagcccggggcgggggcacggcaaccgcgaggcctgggggcgcccgcccccctgtcgcctcccacagtccgcgtgattgcccagacctgagacctgatgtgctgtgccaatcatccatantatactgtgtcgaacactagcacatctgtgcgaggagtttactccgacgtggtcgggcacgtctgtcgcagcgctccactcggccggcagcggagccgcagccaccagccgcccgcgccctccagccccgtccgggagtccccggcccgctgcggtgccgtgagtacctcctaacccacctgctgccccgcgagggaggccgaggggcttagccaccagggctcggaagtgggggccgaatccggtgcgagacccaaggagaggggagcagagccggagttggggagactacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagatgcagagaaactcacntggtggacaagccctttgctgccaagggaggaccagctgcatctgtacagaacatgctattccaacagagtactcatccaagtgccaggaatgcaagaagaccatcatgccaggtacccgcaagatggagtacaagggcagcagctggcatgagacctgcgttcatctgccaccgctgccagcagccaaattggaacctaagagtttcatccccaaagacgaatcagaatttctgtgtgccctgctatgagaaacaacatgccatgcagtgcgttcagtgcaaaaagcccatcaccacgggaggggtcacttaccgggagcaggcctggcacaaggagtgcttcgtgtgcaccgnctgcaggaagcagctgtctgggcagcgcttcacagctcgcgatgactttgcctactgcctgaactgcttctgtgacttgtatgccaagaagtgtgctgggtgcaccaaccccatcagcggacttggtggcgcaagaatacatctcctttggagggacggcagtggcataacgactgctttaactgtaagaagtgctccctctcactggtggggcgtggttcctcacgagagngacgactcctggncccnatgtgngaagcctctgnttcnccgagaagttgtgttgtgtctcccccagtttttgtttctttcccccggacttgcttctgttcttcagc

SEQ ID NO: 722203 - DNA, 104 bp, Homo sapiens
tcctacctcagcatagctgggacaacagggctcatgccactgcacctagctggcatagaaattttttttttttggagcacactgtctcatcctgtggctcaggt

SEQ ID NO: 722204 - DNA, 1565 bp, Homo sapiens
  misc_feature (192)..(192): n is a, c, g, or t
  misc_feature (735)..(735): n is a, c, g, or t
  misc_feature (755)..(755): n is a, c, g, or t
  misc_feature (757)..(757): n is a, c, g, or t
  misc_feature (800)..(800): n is a, c, g, or t
  misc_feature (872)..(872): n is a, c, g, or t
  misc_feature (1227)..(1227): n is a, c, g, or t
  misc_feature (1459)..(1459): n is a, c, g, or t
  misc_feature (1472)..(1472): n is a, c, g, or t
  misc_feature (1476)..(1476): n is a, c, g, or t
  misc_feature (1482)..(1482): n is a, c, g, or t
  misc_feature (1493)..(1493): n is a, c, g, or t
  misc_feature (1497)..(1497): n is a, c, g, or t
gagaaggaggagaagtacagctaggagcaggctggagtaaactcggccgaggagggtacgggccgtgaccgccagcccggggcgggggcacggcaaccgcgaggcctgggggcgcccgcccccctgtcgcctcccacagtccgcgtgattgcccagacctgagacctgatgtgctgtgccaatcatccatantatactgtgtcgaacactagcacatctgtgcgaggagtttactccgacgtggtcgggcacgtctgtcgcagcgctccactcggccggcagcggagccgcagccaccagccgcccgcgccctccagccccgtccgggagtccccggcccgctgcggtgccgtgagtacctcctaacccacctgctgccccgcgagggaggccgaggggcttagccaccagggctcggaagtgggggccgaatccggtgcgagacccaaggagaggggagcagagccggagttggggagactgtggctgaaaactgtgtcttcctggagactaggctggcattttgactttggacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacaagcattgagagccnagccaccagacttgcccagntncagcccaggcctttttttttactttcctgtttgcccttggacnttacttgtcttacaaggaccggcactggcatgaagcctgtttccactgctcgcagatgcagagaaactcacntggtggacaagccctttgctgccaagggaggaccagctgcatctgtacagaacatgctattccaacagagtactcatccaagtgccaggaatgcaagaagaccatcatgccaggtacccgcaagatggagtacaagggcagcagctggcatgagacctgcgttcatctgccaccgctgccagcagccaaattggaacctaagagtttcatccccaaagacgaatcagaatttctgtgtgccctgctatgagaaacaacatgccatgcagtgcgttcagtgcaaaaagcccatcaccacgggaggggtcacttaccgggagcaggcctggcacaaggagtgcttcgtgtgcaccgnctgcaggaagcagctgtctgggcagcgcttcacagctcgcgatgactttgcctactgcctgaactgcttctgtgacttgtatgccaagaagtgtgctgggtgcaccaaccccatcagcggacttggtggcgcaagaatacatctcctttggagggacggcagtggcataacgactgctttaactgtaagaagtgctccctctcactggtggggcgtggttcctcacgagagngacgactcctggncccnatgtgngaagcctctgnttcnccgagaagttgtgttgtgtctcccccagtttttgtttctttcccccggacttgcttctgttcttcagc

SEQ ID NO: 722205 - DNA, 147 bp, Homo sapiens
atacagccggccctctcttactccagattcatttgcgactggatcctcgtcaaagcagacacagtgacattccataagtgtgtatgccagtgaatatttgaagtacctttgtctagtgttcgccagtatctacatgttaggtttagc

SEQ ID NO: 722206 - DNA, 152 bp, Homo sapiens
actgttgcagacatgctacaagatgttcaaaaagaatggatgcgactctgtacaagtgtcaaagaaagtgaggttgcacgagccagaaatcttctgaaaacaaaaatgttgttgcagcttgatggattcaactccaatttgtgaagatattg

SEQ ID NO: 722207 - DNA, 302 bp, Homo sapiens
ctgagggccccatcccagaccttaattccaggatgacatttctagacacaccctgggccaaaagggaatccactgccttgaaggggagaacccagtcctggcaggattcatcatctgctgacaaaagagcccttggcctttgaactttcagcagtggtagctgggcagtactcgctgtgggccttgggtgagactcaaagacatgctggcttcaggtgagacccagtacattcccaggcttttatggctatagggggagacctccgtcttcttaaaaaagggggggaagaataaaggagctt

SEQ ID NO: 722208 - DNA, 763 bp, Homo sapiens
  misc_feature (212)..(212): n is a, c, g, or t
  misc_feature (214)..(214): n is a, c, g, or t
  misc_feature (220)..(220): n is a, c, g, or t
  misc_feature (598)..(598): n is a, c, g, or t
  misc_feature (629)..(629): n is a, c, g, or t
ggggtgattggtgtttcctcttagaaaagcgcgggaacaatgattgctttccagcgcgtttccgtcacgcttgcagcctctgtcccttctttccccaagttctcttgcccgtccttgctgttctagaagcctctccccttctgctatcctgccgcggccggcgctgcctgctgttctctgatccccagttcattgttggggtgggggtgctngncttacncgcgcgcgcctcctcgggaacactctccccccccatcctcctgttcctccttttcccccccttttttccccctttttgtcctcctcctttttttccttggtccgcttccctcctgcctgtgttccccggccgcctctctcttcttcggtcgtcccccgtcttctcctttttttttgcttccccgacccctcctcccccttcccccgctcccgcggggggggcgcctcgcccgcctctcctcggtcgccccctttctccccgccgcttcccgcctcctccgctttcgggccgccgccggcgcgctcttttctctgtcttcctgcttccctccgtcgcgcctctccttttgcttttgtggtgtacagttgcttcccttcncttctccccccgggttctttgtcctctgtgncttctcctctcctctcccctcccccgcccgctctccttcttttcccctcttcttcctcctctttccttctcttcccccgctctgctcgccgcttcgcctccttcccttcttcccgcgtcctttatatagtaaaa

SEQ ID NO: 722209 - DNA, 231 bp, Homo sapiens
tacagtaagctctacaaacctagcatataaaaaacaaaaaaaaaaacagggaataccagatctttggcaaattaacaaccacaacaaaagggcataaagggaacagagaattgtctaccgggctcagataggacctctatcccaggcaccataataaggaggcgtgcagcgacagagaaacaccccactcttcagagtggtaaggggtataggcccattaggggtatacac

SEQ ID NO: 722210 - DNA, 410 bp, Homo sapiens
  misc_feature (353)..(353): n is a, c, g, or t
tgcgcggtgacgagcggatcatgccgtgcgccgtgctggcccctctgccgtcgatccggacgccgcgtatctcctcctggccctggccatgacccgtgctgctccggctcgtgctagacgtcaacgcgcccccagacaacgctgagaccatgctgctcgagcggctgccgcgattcgtctcggatgcggatgcggatgcggcggcgttcgatgcgtgatggaacgtcgggctcatgggccgctcgcgtagctgcctttccgggtcggggatcccagcaagatgcgagggtatccaaatctgaatggttactttctccggggccagcggggactgtctcaaaaagacggcgcgngcgtgagatctagccctttgccaccatcagtggtggcatcgataaacaccgggtacc

SEQ ID NO: 722211 - DNA, 169 bp, Homo sapiens
ccaatgtaatgggtccatttaaaaaattttattttttaaaagccctttttgcctgttgtaatgggccgggcccctttcccttcatgggaaaaacaggtagtttccttaatataggtttaaaaggttatgttaaaaaaaattataataaaagggaaactttgcttttcca

SEQ ID NO: 722212 - DNA, 864 bp, Homo sapiens
tctcccctgttcctcattatatcattggtattgggcgccggtgtgtcttcatcggacgaggcgaagatcatattgtagggtgtccctgacactcacctccgttgccttgatagacgacctttttcttacggggggtgtccccttctgtttgggtcttgccgccacccgaagttgttttttttttttccaacgagatatttttcttggcgccccattgtgtccccactcaccctctactcgtgtgggatccgcccttctcccccccccctttggtgtgggtgccttcggcgccccccttcccggttgttcgtcactccccccctgctcatttttccactgtagttgtgcgtcccctccttcttggtacacaccatccacgcctgtgtttattcgtccctctcaccgggcagtgtgtactacatacactcaccccggtgggccctcaccctctcttgttgtttatatataggagtcccacccactcctgctccccttcccactctatttattggacccacgtccgcgtggtataccatcattttttttggtggtgttgtgttttttgtacactccctcactacgtacctcagcgatgtttcttggtgtgtcctcctctctcccctcttcttgtggggtatttttccggcgtccaactctttttgtgtggacccaccggctgtctcgccgtgtttgatcgctcccttttgtgggtcccatttttctctcctttgttgtcgttactcccgccccctgtttttttcctcttaccccccaaacaccttggtttaaccccccccccttttgccctttttttaaagggtttttttttttttttttttcccctttttttggggggggtttata

SEQ ID NO: 722213 - DNA, 797 bp, Homo sapiens
  misc_feature (547)..(547): n is a, c, g, or t
  misc_feature (651)..(651): n is a, c, g, or t
ctttcccggtagaatgggcgcccaaatcccatttccaaagcgagatgctccagcactcatacagtctccttcaggcatttctcccgagatccccattcttgatagaagcctgctgtctaaaaaaagagaccctcacagaacacacttgctgcgagatcacaaattttatcacgtgtggggtggacaaaagaaaacgtccaattttaagaagcgcaatttagatcgattacagactgaacatagaaaaataataagacaacttatccttagtggtttgagcacttcctgcctaaatctgagccaggaaaattcacatctctaatgcgttgagagaatgacacatcttgaaaaccttggctctaaatatggtagcttttcaacctattgctctatctatattaaataccataacttcaacttaccttggtttatggttcttttgagacaaaattgaaacctgacgtggttcaggcttggatctgactagcaaggctaagcctttttgggaaagacaatactacattattttttgtgaccatgcaaaatnaaacttataaatatcatgactgcccctgtgattacaaccacattaaaatatctgttacccgacatgtcactatcgggtcaacgtcctttacttttaaagtgccncggcctaatgggtttaatcccttaaaattctaataaactttaataaagaatactttaactagacatgatttggtttaaaatgaaaagaacccaaattggccttttgtgcccaacaaagtttaatttgctatctcaaaattgacctt

SEQ ID NO: 722214 - DNA, 213 bp, Homo sapiens
ggggggtttaaaaaaggggcccccctaatccccctccccaccagaaataggggggggggtttggggtccttaagcgggtttttcacccctgggattacctagggatttttgcctggggtaaaaaggggcccagggaaaaacccggcccccttctttttaggcggggggccaaccgggtaaaaaaaggggggccgggggttggttttttggcca

SEQ ID NO: 722215 - DNA, 229 bp, Homo sapiens
agctttagaggccacaaactccagcaacactttatgtaacgtctattatctgtttcagaagctttttattccttttagacggcatctcggtcgatcacctagcctggagtgcagagaaggcatccctctccaacaacacatacatcacaactacattaggccaggcctgggggtgtgagcctgtaagtccccagactcactctgacaggctccaggcggcaggatcgct

SEQ ID NO: 722216 - DNA, 662 bp, Homo sapiens
  misc_feature (49)..(49): n is a, c, g, or t
  misc_feature (61)..(61): n is a, c, g, or t
  misc_feature (125)..(125): n is a, c, g, or t
  misc_feature (151)..(151): n is a, c, g, or t
  misc_feature (165)..(165): n is a, c, g, or t
  misc_feature (168)..(168): n is a, c, g, or t
  misc_feature (170)..(170): n is a, c, g, or t
  misc_feature (177)..(177): n is a, c, g, or t
  misc_feature (276)..(276): n is a, c, g, or t
  misc_feature (286)..(286): n is a, c, g, or t
  misc_feature (297)..(297): n is a, c, g, or t
  misc_feature (300)..(300): n is a, c, g, or t
  misc_feature (332)..(332): n is a, c, g, or t
  misc_feature (483)..(483): n is a, c, g, or t
  misc_feature (492)..(492): n is a, c, g, or t
  misc_feature (544)..(544): n is a, c, g, or t
  misc_feature (554)..(555): n is a, c, g, or t
  misc_feature (568)..(568): n is a, c, g, or t
  misc_feature (623)..(623): n is a, c, g, or t
gggcgtgaggcacaaggacagtagggtgtgccctggtgggggccgcctnatgatcccctangaggcccttcaggctggtggagactgaagtgtaagggttagggaggggaggggcgagagccttntagcgctgctctcctagctgcatcanagctccctctagtngtncngaagatngatgacgcctccggctggggagggaggggctggcgcctctgatagagcacatttattatcagggtcacggccaagaccgtgggcttggtttctaggtangtggactttnagggtgcaaanacnacccacttttcctgccccctacccccggctcncagagaccatttaaatccatatccaaagtatatccagagccacctgggaccatcaggcctctggctagtctttctgggccaaacctgtcctcctaccctgaggaccctcagggaaccaggaagtgtgtaggggctggctccgccccacctntagcacaanatctggcccaggaggaggctgaagaaagagtttcaagatcctgcatgctgcnatagatgagnnacctcggacaagncacctccagccttcttcacccacctcaccatatcaacaagggctagatattgccngaagtgggtgggctggggggctctgatgccaaaatgcag

SEQ ID NO: 722217 - DNA, 420 bp, Homo sapiens
ttaaatttgaggccaaaattttaagtctttatttattggaaaacagtttgtaaaatgtaaacctttgggcctctatattaaaatttttagaccagccatcaattttaattatctggaaattatgtacttaatgaactatataaattagtagtgaataagattatacctaattagagtaatcagatgaaagtagaacagttaaaacaataagaatgtagatttaggttacaggtttgttacagatggtctgagaaccaagagaaattagaagttattcatttgtctgaaaccaaagagaagcagaagaccatgggaacagtcaatttattttaactttaactggattatctgctctgtttagtcctaaatcattgggcatttttgaaggtcgacgcggccgcgaatttagtagtagtaggc

SEQ ID NO: 722218 - DNA, 375 bp, Homo sapiens
gtctgttcctcttggtgcgccgtgccagagccgtcgcgtgcgtggtactctgcacgagtgagcccgtggtcgttgtgtgcgtgtgctccgcctcaaactggggagctccgcagtgtggcgactcactagcgtttcttctgtagattttcttcaaacttgctcagtttggcctgtaactccagaaaggtccaggtttatgaagtctcatgacttaagaagaccctgtgaagagacagttttgttattaggaaggctaactttagtggctagaaacgagcagcccaatcaaattttgagagagccgccagttatactctgtaccatttccctgctacctgcttcctgcttctgcctgcgcatgctcttgttgaggga

SEQ ID NO: 722219 - DNA, 508 bp, Homo sapiens
ggatcctctacgacggtgtactgcataaagtatctttgttgtgttagtttatttgaacaaaaaacaaatttatggtagagacaggatctcaccatgtggcccaggctggctcttgaactacctaagaactcaagtgatccatccgcctgataatcccaaagtgtaggatagtgagccctgggcccagcaagcaaaaactatctatgttggcatgagcagtatgaggaccaatagttagggaatgatagggaaccatctcaaaatccaagttctcaactgtcagccatggcctgatctaacaatttcctaaggctacaggctctaaggagtctcaggcctagctagtgtataacttatttctgcacagcactcaaagtttatgtacctttttgatttagagagatgggcagactgagtatcacagaggtggggtgaccttctcaaggaaacacagctaccaggtagccaggccaagatctggaatacaggtatcatggaagaccctgag

SEQ ID NO: 722220 - DNA, 200 bp, Homo sapiens
agagtgatgacactcttaactcctgacttttatatccagtcataaagtagactttcagcacaaaagatacttataaacaaataaacaaatatatataaacgtctcttactgatagtaagcttatggcactctattatgactaggtgccattagcacatcttgcattattagtagacacactactagcacctagcctagct

SEQ ID NO: 722221 - DNA, 607 bp, Homo sapiens
  misc_feature (607)..(607): n is a, c, g, or t
gtgtttctcagtttcccgtttcgttgtggactgttccactgcccctcctcctcaccctatcacccatggagtcgtaatgtaaaaattcttttaccatgtcaaggaaaaaaaacaacaaaaacaaaaaacacaacaaaaaacctttgttgtttggcggccgcggcccttggcgccccttgggaaaaagcgctttttaaacaccccatttgtttgtggggcgcccggggcccacgtgggttaggtggcaccgtgggcccatagcgcggtgtttccctggaggaaaactcgcgggccctggacataggtggctgtggagttttttcaccaagttatcaacaaaccgcgccggggggggaaaacccaggagcgggttgtgtggaacaaaaatcccccagaatgggagaggttcccgagaggagtcccataacgcgggggattccaccatcacagcggggaagtgtcaacagcgagaggtcccagatatcaatgaatttaggccccgggactgtggggagtaactagaacaaagcagcaggccgacacgacaacaaaaccacacagcacaggaacacaaacagcaagacaccaagagcagaacaacacgacn

SEQ ID NO: 722222 - DNA, 981 bp, Homo sapiens
gctgtaatcccagctacttgagaggctcaggcaggagaatcgcttgaacctgggagtggaggttgcggtgagccgagattgcaccattgtattccaccccgggtgacagtgcaagactccatctcaaaaaaaaaaaaaaaaattgggcatcatttacaatttcatagaaattactgtgaaggcctttctaggttgagatgtgggggtattggggattctaatggtaaccccagaagaaggtaatttagctggtatttatttaaaacccatttagccttttacttatatcgggtagaattccagtgatcatcctaataaggtatatctcagaataattttttagttccttcagaaataacttagaatcagatgctataaaggggcctaggagccttatgagaataggcctagggcctagagatggaaggggccccctagaggcagcaggggaggagatacaccggagcagaaaatacaataaggactgtaccgtaaacagaatgtgacaagacaagcaccagacggcacataaaccaaagtaagaatatcacagacaatagaagaagagtgtagggccctaaggaacatacataggagagagagcaggacgacaacataaaaggatcagaagcaggagacgcaaagaacaacaggcaaacacacaacaacacaagatacagaaagcgacgcgaccaggtggtccgaacagccacaaggaaatacccccaccaaccggaaaacaccaccgcaggaaaggacacgaaaacacaaaaggaccgcacgacagacacggcgaagagtggagcgacgaaagcagccacaggagcccgcagaggcaacatagcagcgaagacgggaagaaaacgacagagaaacgaaccagcagacgagagaagcgacaagaagagcagaccagcaagaaaagacgacgagaacaatagagagggcacacaggaaacgacagaacacaacacatcaaga

SEQ ID NO: 722223 - DNA, 203 bp, Homo sapiens
ttgaacaaggccgtcatcggatctttttcatccggacgggtttccacaacacgctcgtacaagcgaccaaaagcgctgcggatagatacgcgctttgaccagggcaaagaaacgtttgcgctcaaagtcgaactccagatccacgtcgtagacctgacccagctccagaccacggaactcaaccttggagcccgggtcgacgc

SEQ ID NO: 722224 - DNA, 148 bp, Homo sapiens
acataatgatacaaccctgaccaagctaacagacgcttgttcaaaggctattttctatatttattgttgggaacaagtcactttacaagcactatgtagctatttaggaagcacaagctatatttttattgtacagctggaactgcag

SEQ ID NO: 722225 - DNA, 143 bp, Homo sapiens
gtgagttctttgtggatgtgatgtgagcagggccctcgcccagctccattccgctcccaccccagccggtctgcgttcctctctccatccgtccgtcttttttacttgtctggtacctgaaacggaaataaaaggaactaaat

SEQ ID NO: 722226 - DNA, 4035 bp, Homo sapiens
aagcttgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaaggtactgccttgctaagaaccacttctttgctgtcagcttgtgctgactgcccgtgtgctcgtacgtttaagtatcccaacagtcaggtgagagcgtgtggttgaggcagtggtgatgacgtattgacagagaagccaaacgctgctcagaaacgtgtccctcggctgagggcgatgctgacaggtggccgaagctgagcctaggtcttccgactccagttcctccaccatcagctgtgctttcaaaataggcctgatgggcattccctaagggggaagcaggtggcggagaggagggacccgcggatatctttaaacagtggaaaacaggcccttctgttgaagtgaggggccagaggccagccagccccactgcagtgccctgtgccattgctagggaccactcaagccaagccctgagttgggccaggtttccgcaccctggtggggagggcagaatgacacattccaccgaagagcaggagtttgcaggtggcccggtgtgggtgcgggtgccaggctgagctgcagggcggagagtgtgggagaggaggcagacattcgggggcacggcagcctggccttcaagacagccttgcctgcaggagcaccccgcttcggcctcagctgtgccgtggcagcaatgcaaaagcagtccctttgcacactgttccacgtggtgcagagcagggaccctgatgtctctgggcatctaacttccaagtgccaggtcaggggcagcaactaacagcagccgggacttctaggtaatatcagtttcacagcatcagaggatagaaatcataaaacaggactctagagccgccagagctctttgatgtcaggatgaatgtcctgggcacacactggcagccccaagggtatatggctctagctcagtctgtgaggatctatttgtcagcaagaaaatcttgtccagcagatgttaacaggccagaaaagtacctcatgcctttgacttctctggaacaccccagtccctaagcccaaataaatcacaggtgctgcttcgccccgagaaagccctctgaggggccacctttcaaagcctcagccgcctcccctgtggaatggagtccgtgtgctccccagggctggtgaagaatcagggctttggcccgcacggagaagggcttcctcaggcctgtgggacgcagtgcccgctgtcagtcaccttctgtctctccacaaggatcagcgtcagcaagtgtcttagtctcactcagatttggcccttcttccgcgcctgccagttcagctagcacttcggccagtgtctcaggcagggtctagggttgcaggcaccagaagctcgctctgcttacttcagccaaagggaactgattgaaagtgggagtgtgcctgagtgagcaggtgctggagaccgcctggaggccccagggcagcctgcagaggccaagaggtggagcacggagctaggatgcagaaatcccggctgcggccagacggggaaagagccccttgatgacagtcctgtgaggccccatctgatggagaaacagtgcctcactaggaaacaggtgctatgagggacaatggatgtggccagaacgcagctacccactcatcaggggcttagacagaaagtggattctagaatgtcctttcctcttcagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagctagaacccgaaacaaaaggtactaaaggcaggtggcctgagagccatctaacctatttcggactagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaa

SEQ ID NO: 722227 - DNA, 807 bp, Homo sapiens
gccgcagtgtggaagaaacactccgtttggtaaaggcgttccagtttgtggagacccatggagaagtctgcccagccaactggacaccagagtcccctacgatcaagccaagtccaacagcttccaaagagtactttgagaaggtccatcagtaggccatcctatgtctgcaattacctgaagcttttcaggccaaaaaagagccccagctggaatccttccaatgccttgaagattatttatagaatggcaaaacctcattatgtttgtgtttataagtactgctccacaggcttgtaattttaagacaggttcaggctctctaaaggtggctagctgcttccatagctgctcttactagggacttcttgatggctaaccaattctccccgagtgcttggcccccatttcttggatcatgtccttagagggtaagcattctttcccttagcctgccctgaaccttggtctacagtgaagtagcacatagtgccagtacttggtgaaatgaagtagcacatagcaccagcacttaatggaagcttctgatcaaggtcctaaaatttcctctggaattttgtgaattatgctgaatttccctttttttttttttcaaatgtagtcattaactcacaggtgtcctggtggtgttctgaggtatcgacgaggtataatcatgaaggctatgtctactccataagtcatttcttcaagagctggtatttgaattaaattaccttaaaaacaaaaaagggggggggctaaaaatccctgaggccaattagcgtaccagttttggaaagggcc

SEQ ID NO: 722228 - DNA, 579 bp, Homo sapiens
aagcttgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaa

SEQ ID NO: 722229 - DNA, 199 bp, Homo sapiens
taaagttagatatacgccgatgtaatatgatagatgaatatggtattttggcagtgggtttggtctacgggtgtagcctgagacgtagggtgaaatcagttgaagtgaagcctccgtatgactggctcaatagcagctccctattggaccctttatcggaggggcgatcctcgtagaggtcgacgctgcagtgcatgca

SEQ ID NO: 722230 - DNA, 351 bp, Homo sapiens
tttcatttcgagtctctgagaatacttattcggtctgagtatcgtcctcactctcttccacgtccatcaagctcatacgcagcttcatccgcatgccttggatcctcagtattccacaaaaccatagcctcagttcagatcaatatctctgatcagtccatatcccttgaagactctttagacgtccttatctctgaccgatggattgagtctaccgatgaatacccgacatccactcatgatgtccggctagtacttctttccggacagggtctatgccggctgagacacagacaggtccgtagtatgagcccgagtcgtcgacctccacgcagtccagcacttaactcg

SEQ ID NO: 722231 - DNA, 321 bp, Homo sapiens
cgtcgacattagctcttataatccatatttagaaaaggagtgatcagtgttatttatttagctttattatggtaattcatttttatgaacgtgcacaaacagattgtaatgtccccaacattgaatagaagtctattagaatatttagaagagttcagcgtattctgtcctctcatttgtaagcattgatatcatgttaatcgccagtcattatgtgtgtacattatatcttttaatccccatagtcaaagagctcccagtaagtacggatcatgggtccgaggctttggatgccttgccatttgaacacacagtcgacgc

SEQ ID NO: 722232 - DNA, 244 bp, Homo sapiens
ctgaagggtatatggtagattacaatgttggaggcgatccatatggatcaacatttactgaccaatcaatccttttcccactgaattataatggcaactctgccatgtaccatacaccaagtatctatctcttcatgagacttgccaatcttccccgtagatactgtacagctatggcacaatgtcacactgttgtaatcaccaaaatgtactgctgtaagcaaggtcaaaatcctttctctat

SEQ ID NO: 722233 - DNA, 321 bp, Homo sapiens
tcctctccgggctcgtgagtagcattctcaggagtagtgtagcgagcaagttctggaagttagtcctcaatcttcgatttcccagcaagaactttctcagtgagcagatcttgctagtcgaggaacaggatcacagagatggtgcgcagccctctgtggtcccagatgctcttaatgagtttcggagcctcctgcagtcgctgggactgtttgtcctccgggttgaccatttggtagctgctgctggccgccatgtaaacatatggcagtcacttcgttgaagcactggatccacttgcgggcgtacatcgcgctggccac

SEQ ID NO: 722234 - DNA, 949 bp, Homo sapiens
gcgtggagtgaaggcggacacgtagcaacatgcttgtagcagcccgggcggcggcagcaacagcggctggctggcatacgtgcccgagcctgccggcctgccctaaccaaccgtacgctgacccgctggtaaccctaagctaccctaccactataggaataccccctaggtacccagatcgctacagagccggggagactagcatactagtagctatactctactactagatatactaccagtagcactaccgacacctggacggccggcgcactagcacgcaaccaggacaacacaatagtgaattagacggggcgctacagcacaccgtcgataccacgtatatcacgcctaggacgaaggactagttatcaacaatcacaccagacgggtcgacaatcacacccgcacgcgggcccaacgacacagcgggggccattccacaaccaactagtctacccaggcgccacaccacgttcaggccaatagctactcacttctagcatagcagaacacccacatagactatacacctaacttagacgcactagcattacaatagacaggacgtactaacatccccctaatccacatcgaacaccctacgaccagtacggtcttcgaccacataactagtagagataacaaccgcagacacatatagaagtaacaccaaataggaggacatctcaagccagcttcgataggcagtaccagcattagcccactgaaatctgaacagaactatccccgatgttgccaaggcctaacggaaatagcgatagcccgccaaaaacaccgactaccacattaccacagcaatacacagccaacacatactactaaacaccatacactatcccccattagaatagtatggcgtacctatcaacaacgtcatattcgaaaggcatccgcaggacagagacacatcagaatacagagtcag

SEQ ID NO: 722235 - DNA, 218 bp, Homo sapiens
gcagatgcacaggagaagagcatctaggagcgcttccgatagactcagctgagatacgctgctggtagcatgcacgcagcaagaacacgctccagtctcatcacgacgcagaagctgctagatgcagcatgtgtgttggcaagtctagaggcatgaggtgtgcggaggtgagagcaccagacagacagcggatagacccctgaggatgtatcatcgca

SEQ ID NO: 722236 - DNA, 272 bp, Homo sapiens
cagtcacactggatctgagccgtgtctgcaacctacaccacagctcacggccgcgccggatccttaacccactgagcaaggccaggaagggcactcacatcctcacagacactgcattgggttcttaacccattgagccacaacaggaactcccctacggtcagctggtgagcaacctgaatttcacctgcgtttaattctcctttgctgtgtgacctaacgtactcagctgccgttgattcccctttcaggaattcagtctaacttaggat

SEQ ID NO: 722237 - DNA, 218 bp, Homo sapiens
ccaacagatgcttgggcattcaggctgggccagcatccacttgcagtgccagcacagttcccagcacccagccgtggcccaaccatggttgcacacaccttgttctctcaatcacatcaatcaccacacacacattcagccagggccattggttggttgtgttgccgttgtaaatccgccagcatcacctctgtggccaggcttgcagcactgtggca

SEQ ID NO: 722238 - DNA, 186 bp, Homo sapiens
ctgtgctgttgatgtatccatgctctcacagcaccacacgctgtcccactgtaggcttgtttcaagttagcccaccctctttagaagtctatgtaaaagttaaatgctgtctgtgtccgtggcccagtctatggatgttaatccactgggtctgagtgcactcaataaaatcctccttttctccca

SEQ ID NO: 722239 - DNA, 217 bp, Homo sapiens
ataaattctgtgggcatctttttttgtttggaaaaaaactaggttcaattcattttcctgagatgtttggtttataagatttgaggatggttttaaatactgtaagtattgtaatgttatgaatccaggttatttgaaaactgtttattactatctccttcctggtaatgctatgggagtgtttttaataaaatttatatttatttaatgcgcttta

SEQ ID NO: 722240 - DNA, 81 bp, Homo sapiens
tttcccattttttttcaaacaagtatgaatctagttggttgaggccttttttttcatgacataataaagtattttctttaa

SEQ ID NO: 722241 - DNA, 176 bp, Homo sapiens
ccagataacaagtcttcaatgtcgtcctgcaagatgggttacaattaacatctcctcctaaaaacaaaaacaaaataccagttagatatgtgcaactctgcacaagcttttaaagagtccactattcatagaatttgttttaatgtcctctactttattttcattcacataattaa

SEQ ID NO: 722242 - DNA, 576 bp, Homo sapiens
atccggtgtttcctttgtctcatatcagtcagaatggttagataaaaagtaaaaaacaaaacaaaacaaaaaaacctaaaatcagatgctggcaaagctgagagagaagggaacactgtacactgtcggtgggaatgtaaatgaattcagccaccacggagagcagtttggagatttctcaaagagctaagaatcgaactactatttgacccagcaatctcatgattgggtatatacccaaaggaaaataaatcaatctaccaaaaagacacatgcatccatatgttaattgcagtgctattcacaaaagcaaagatgtggaatcaacccaggtgcccatcaatggtggattggataaagaaaatgtggtacatatacaccatggaatactacacagctgcaaaaaagaatgaagtcatatcttttgcagcagtatggatgaagctggaggccgttatcctaagggaactaatgcagaagcagaaaaccaaataccacatattctcacttataagtgagagctaaactttgagtccacatggacataaagatgaaaaccatagacaaagggaaaca

SEQ ID NO: 722243 - DNA, 164 bp, Homo sapiens
ccaacaggcaatcgaggtgcttttgtgataagccccatgctactgtgccagtgtcacattgaacaagttatcatgtcccttccgcgatcaagctgcagaacaaggagcatgtcattgatgcccatgcgcctggccgagttcaagtttcctggccgccagaagat

SEQ ID NO: 722244 - DNA, 1162 bp, Homo sapiens
  misc_feature (20)..(20): n is a, c, g, or t
  misc_feature (22)..(22): n is a, c, g, or t
  misc_feature (55)..(56): n is a, c, g, or t
  misc_feature (96)..(96): n is a, c, g, or t
  misc_feature (607)..(607): n is a, c, g, or t
  misc_feature (870)..(870): n is a, c, g, or t
gacccgcgtgtggcgcaggnangaccctcaaaataaacagcctctaccttgcganncgcgtcttccccaggcctgcgtccgagtctccgccgctgngggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcnccttgcacgggaatgcacaattgaggctacagcctaataattttccttttgtcgcccctcctttttcctgattgatgtcgtgtacatttctctgaatcctcttcactgccaaaggtgggcacgatagaggcaactccaggcagtgagctttactgtgccgtgtcaacggcggaaggggtgaacaaaaaccgactttgtgccataactacaacaaaagttatgtcagcaggcacgaggagcaaggataaggttggtaaagaacnccctttcgtggcactgtgagctagggatggctggcatggcgagcggtgagtcagaaccagtaagccgtctgggtccttggactgtcccctgtggaggcaacactcggatgcgacgaacgccaaacatacgagacggaaggggccggctgaggcccacggctaaaacaccagaacgggtaggccactggaaacgtgggggaccccaaaaaactcgcaggcggacacggcacgcacgaacaccgggggcaccggggggcacaaacaaccacggacgggggaaacagaagtagac

SEQ ID NO: 722245 - DNA, 1182 bp, Homo sapiens
  misc_feature (20)..(20): n is a, c, g, or t
  misc_feature (22)..(22): n is a, c, g, or t
  misc_feature (55)..(56): n is a, c, g, or t
  misc_feature (96)..(96): n is a, c, g, or t
  misc_feature (238)..(238): n is a, c, g, or t
  misc_feature (627)..(627): n is a, c, g, or t
  misc_feature (890)..(890): n is a, c, g, or t
gacccgcgtgtggcgcaggnangaccctcaaaataaacagcctctaccttgcganncgcgtcttccccaggcctgcgtccgagtctccgccgctgngggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtgnttttacctcggatagaggttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcnccttgcacgggaatgcacaattgaggctacagcctaataattttccttttgtcgcccctcctttttcctgattgatgtcgtgtacatttctctgaatcctcttcactgccaaaggtgggcacgatagaggcaactccaggcagtgagctttactgtgccgtgtcaacggcggaaggggtgaacaaaaaccgactttgtgccataactacaacaaaagttatgtcagcaggcacgaggagcaaggataaggttggtaaagaacnccctttcgtggcactgtgagctagggatggctggcatggcgagcggtgagtcagaaccagtaagccgtctgggtccttggactgtcccctgtggaggcaacactcggatgcgacgaacgccaaacatacgagacggaaggggccggctgaggcccacggctaaaacaccagaacgggtaggccactggaaacgtgggggaccccaaaaaactcgcaggcggacacggcacgcacgaacaccgggggcaccggggggcacaaacaaccacggacgggggaaacagaagtagac

SEQ ID NO: 722246 - DNA, 983 bp, Homo sapiens
  misc_feature (20)..(20): n is a, c, g, or t
  misc_feature (22)..(22): n is a, c, g, or t
  misc_feature (55)..(56): n is a, c, g, or t
  misc_feature (96)..(96): n is a, c, g, or t
gacccgcgtgtggcgcaggnangaccctcaaaataaacagcctctaccttgcganncgcgtcttccccaggcctgcgtccgagtctccgccgctgngggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtaaggtgtcagaatgttgttagaagaaaactcagttgcggagattcttccagagatgaattagctataaatggaagggccttagtaaattcagtgaaacttagctgtgaccagataagaccaattttcagcatatgtaactggcagtctatctgtatataattctgtattctgccctgatatcctgtggcttatggtacctgggcagttttcacaactggacttttttaatatataaaagtaagagtgttataatttgaaacttcctgagacttcatagaaagctctgtaatatacataaatcttttatcatgtaaccagaaatcttttgcctgtttgtgacatgtaagtgtataattcgataaatggtcgtcgtgtacatatctgtgaaaccttaggggttaattgcatgaaaacaaagatcaggcgcttgttctgcatggtgactgttgcttgg

SEQ ID NO: 722247 - DNA, 595 bp, Homo sapiens
cgccgaaggaaagatggaggactaccaggctgcgaaggagactgctttggtggttgatgaagtgggcaccattgtaaaggaggctttggaaggcgcaattgggggtaacgcttatcaccacagcaaagggaaccaggggcccacaaatgtagtagaccaaactttaagccaactaaccaggctgggaaaaccatttaaatccatcgggacctgggtaattatgcagaagaatggagctggattccacacagcaggttcctgcttttgggacagttttactgccggaagctgcactgtccgatgggagaataggaccatgtcctgaatcgtcagtgccttcggactgccaatttgacctgcagtccagcctatggcctttctcctttgggctctagttcatcctttaaccaccagccatgaattcagtgaactcttttctcattcccttggtttggtggcacttttacaatgtaggggaaaaacccaattgaccgaactgggaggtgaatggcaccgaagtcagatgagtatccttggaggtaaccttgagcctgcgttgccactggccttaactctgttcaattcggtgctccct

SEQ ID NO: 722248 - DNA, 530 bp, Homo sapiens
  misc_feature (32)..(32): n is a, c, g, or t
  misc_feature (87)..(87): n is a, c, g, or t
  misc_feature (101)..(101): n is a, c, g, or t
tattatttaatatttcaattaaaaatttcatntatttatattttttattttataataatttgagattttttaaatattataatacanaaattaaatttaanatattaattccaattttacttttcctcctaaacatccctatccgttgtcctctcccttttttgtattggatagttttatcctaccgcattgtttttttatccgcgcgacaatggcactctattgtatttctgtcacatctttttcgcgtcattcgtcgcgccgtcattaaattcgctttgctatttgatgatttcggccccggaatcgcgcggcatttgtatgtgcgctcggtctatatttgcgtttatatacgtcgtcatgttgttttttattaaatccgaccacaccaatgttacatttatttcgctttccccccatctactaccctcctataaattagctcttgtatattataaccgttttcgtatcgccctccattccggtatccacatattatgttctcccgttctatcccgtaatttattttt

SEQ ID NO: 722249 - DNA, 319 bp, Homo sapiens
  misc_feature (16)..(16): n is a, c, g, or t
  misc_feature (20)..(20): n is a, c, g, or t
ccccctggataatccnctcngttgcacttttggtccctctgataatcctgactgttacactcagggccccctggataatcctcactgttacactcagggacccctggataaccctcactgttactctcagggcacctggataatcctcactgttacactcaggccccctggataatcctcactgttacactcagggccccccggataatcctcactgttacactcaggcccccctggataatcctctgtgtgttcacgcggtgccctcggtgtgcagtgtgtgtcattgtgcctgctctaaagtgaggtaccgagctcg

SEQ ID NO: 722250 - DNA, 276 bp, Homo sapiens
  misc_feature (17)..(17): n is a, c, g, or t
catatggggctcactgngatacaagagtcagaccatgggtgtgctgtattcaggagatccatctcacatgcaaagacacacacaggctcaaaataaagggatggaggaagatctaccaagcaaatggaaaacaaaaaaaaaagcgggggtggcaatcctagtctctgataaaacagactttaaaccaacaaggatcaaaagagacaaagaagggcataacctaagggtaaagggatcaaggaaacaagcagcactatcataatatatatgcaccca

SEQ ID NO: 722251 - DNA, 281 bp, Homo sapiens
ggcaagggcacatgaccccgggaatgagccacagacaatggcagacggccagagagtcgggattgctcagtgcctgtcggttccaacggaaaaggagacacagcagcttccggtgtcccagggaacaagccacaatcagagggtgcaagagaattgatccacgttgagcggtcaactctgctctaagtccagcttccagtctccacattccgccactgcttcagggtctcgatgaggcgggcatagctgggcagcagcaggtgcagaaggctcatgcccgg

SEQ ID NO: 722252 - DNA, 219 bp, Homo sapiens
actggagttggaggaagaggtttcagagtggaactgagggttggaactatacccgggatcaaactcacggaccactcgaggcctgcaaaccttcctgggaggacaggcaggccacgatggcccctccactggggaatgctcccagcttgtgctgctgccgcagaagctgattgttttggctgctattgtcacgccattcgctcctgggcactcggagac

SEQ ID NO: 722253 - DNA, 164 bp, Homo sapiens
gtccacttcctgtgtggccactccttccaccaaacactgctttgagagttactcggaaagtgatgctgactgccccacctgcctccctgaaaaccggaaggcatgggtattattccgggcccagggacaaaaacgaggtcttcatgatcaattccgcatcagct

SEQ ID NO: 722254 - DNA, 242 bp, Homo sapiens
ggctgagatgtctcacaagaaaatttaaaaatttaggaaagaaaagtgttcaggagtaaaattgataggattggtgattgactgaacacagatgtgagaaagaatgaggagttgttgatttttccaggttaaaaccttagttagatactaggtgggtactgggatcggcacctgagatagaggattgcagaggaggccctggcagggacaggggaagcaagttcaattctgggcttattcag

SEQ ID NO: 722255 - DNA, 692 bp, Homo sapiens
ggaggcgcggcggcatggaggcgctgctgctggtgctgcggtgttgctgctgggctgcttacgtgcttgtctactacaacctggtgaagtgccccgccgtgcggccgtgcatgtgtgcaaccctgcgtgggccatgacggcgtggtcacgtggtgagtgctggagtgctgggtgagtgctgagctggcggtggcgcagctggagaggagtgcctgggcctggctggtatgcagcgttgcccagtcgggctcagactcagctctggttcccgcacctgtcggtccgcaggctgccaaacagctggcatcggaaaatgaatgacgtgcagctggagacatggcggccgccgtgggaagcagcagcggtttggtgcatagtgcctgcccgccagacccaagtgagctgcggggggatggcgggcgtgcacattcgaccatcctgccacaggaagaagtgggacacacattgacggtgtcatcttttaactgggcccttgggaccttttgggcccacagatattggcccttctgggttggccggcgcacttttggccaacgttgccttttcctgcagcactcttgtagcccaacgtggttgggtacattccctacattccagcaaattgaccaggtatcgaggttccttgatggcccgagacccggttgaggacgtttaacccatgcatgctatcg

SEQ ID NO: 722256 - DNA, 264 bp, Homo sapiens
acaccaaactcacatctctgatattcttgtccatacaggtagataatccacatgccagtgtgccagcacagaactgtaccactgtactggaggaagctcaaactgaagatcgaggatgtcacaaatcaattgacttgacttcatcacgtgctacaatctccaaaaatatactgcagggctgtgagatgggccatgagctgccctgtatcatttgggactccgcagatcctaccgtgctgctcactgctgcttccccctgataca

SEQ ID NO: 722257 - DNA, 106 bp, Homo sapiens
tctgcatcgctagtcttttgtattgcttggggctgctggggagggaggggccgtgttcgggactttcccagtctgagtggctcaggagcacccacccctctcccct

SEQ ID NO: 722258 - DNA, 893 bp, Homo sapiens
  misc_feature (7)..(7): n is a, c, g, or t
  misc_feature (73)..(73): n is a, c, g, or t
  misc_feature (94)..(95): n is a, c, g, or t
  misc_feature (105)..(105): n is a, c, g, or t
  misc_feature (113)..(113): n is a, c, g, or t
  misc_feature (139)..(139): n is a, c, g, or t
  misc_feature (152)..(152): n is a, c, g, or t
  misc_feature (154)..(154): n is a, c, g, or t
  misc_feature (157)..(157): n is a, c, g, or t
  misc_feature (181)..(182): n is a, c, g, or t
  misc_feature (190)..(190): n is a, c, g, or t
  misc_feature (194)..(194): n is a, c, g, or t
  misc_feature (196)..(197): n is a, c, g, or t
  misc_feature (214)..(214): n is a, c, g, or t
  misc_feature (233)..(233): n is a, c, g, or t
  misc_feature (246)..(246): n is a, c, g, or t
  misc_feature (248)..(248): n is a, c, g, or t
  misc_feature (253)..(253): n is a, c, g, or t
  misc_feature (256)..(256): n is a, c, g, or t
  misc_feature (281)..(281): n is a, c, g, or t
  misc_feature (289)..(289): n is a, c, g, or t
  misc_feature (296)..(296): n is a, c, g, or t
  misc_feature (342)..(342): n is a, c, g, or t
  misc_feature (362)..(362): n is a, c, g, or t
  misc_feature (367)..(367): n is a, c, g, or t
  misc_feature (436)..(436): n is a, c, g, or t
  misc_feature (470)..(470): n is a, c, g, or t
  misc_feature (472)..(472): n is a, c, g, or t
  misc_feature (494)..(494): n is a, c, g, or t
  misc_feature (497)..(497): n is a, c, g, or t
  misc_feature (500)..(500): n is a, c, g, or t
  misc_feature (511)..(511): n is a, c, g, or t
  misc_feature (514)..(514): n is a, c, g, or t
  misc_feature (531)..(531): n is a, c, g, or t
  misc_feature (588)..(588): n is a, c, g, or t
  misc_feature (642)..(642): n is a, c, g, or t
  misc_feature (664)..(664): n is a, c, g, or t
  misc_feature (666)..(666): n is a, c, g, or t
  misc_feature (668)..(668): n is a, c, g, or t
  misc_feature (681)..(682): n is a, c, g, or t
  misc_feature (730)..(730): n is a, c, g, or t
  misc_feature (734)..(734): n is a, c, g, or t
  misc_feature (815)..(815): n is a, c, g, or t
  misc_feature (864)..(864): n is a, c, g, or t
cgtgacnttcgtttataacacataaactacatttttagttgttaagtcaccttgtagtataaatatgttttcntcattttttttgtaataaggnncataccaatnccaatgancaatggccaccccatcttatttcgtnattcttccaatgncnaantcatctctggccaacccccaattnnccaaaganaagncnnccaattgtccctctgtncaccaatacggtccttttnggttgtttggggntntgtcnggnggggccgcggcgttgggctgggggngccatggngtggggnctggttgcgttttcctcggtggctttttcctttgtctttccttcgnctgttttttcggtttttggncggtncgggtgggggttggtctcggctctctctttctttggtctcgggtgttccttttgtgctctgggttttcngtccttccctcctggcttgtgtttttggtgtgtntntctttctttggcttccggtggngtntcncgccttttttnccncttcctgcgcccctccntgtggctggctctctgtccccccccacccaacaatattcccccggttgtgacaagantctgctcctccggtctctcttatctcttcattgctaagcccactctcccagatnttgccgcctgtcagtctccccnancnggctaatgtttcnncccccccaccccccacacagcagccattcttttcttggccaatctgcnggcntcctccctcaggcccaatgtgacctgtggccatctcaacagtggtcgccgccagtccccctttcccccacacggctgtccncccttcctctgccttcccaggcgccgcacaggtgggtccccttcccccngcccacatggcttctgccacccgtttgtc

SEQ ID NO: 722259 - DNA, 314 bp, Homo sapiens
cctgtcttcctaagatcttcattcctagattatgaaaatattgtccatcatgtctttcagtatttctattgagttatttttattacctagatctgtttttttttctttttgagacagggtctcactctgtggcccaggctggagtacactggcatgatcttggctcactgcaacgtctgcctccccagctcaagccatcctcccacctcagcctcccaagtaactgggaccacaggagcacaccaccatgcctggctaattttttgcatttttggtagagacagggtcttgctttttttgtccaatctgatctc

SEQ ID NO: 722260 - DNA, 1494 bp, Homo sapiens
  misc_feature (116)..(116): n is a, c, g, or t
gggtgtttgtttgtcgcgtcctctctccgtgtgttgttgtctctcgtatgctctgtttctcattggggtcctcctggtctctctaattgggtgttgtatttgtatttgggtttttnttttggggagttctcgatcacgcacgcctggtagtagtttgtgtgctgccggtgattcggggggggatattagagttcccgtctcttcgggcgtcgtggggttctcccccgggggggtcacctaaaccactcccttccgtgtggtggctctcccctcacaggttttcttccggtctagtttttttcctggggccccccccacaggttgcccctcgaggtcccttctgggcctcattggtggtgcatgttgtgttgctccctttgttgcgcctgccccgtgggctgtccttatacctataggccccgtcggttcctatgcctctgtcttgtggcttcctcttgcgcaatgccccccccccggggcgccgtcccgggtataatggggggcctggggcctgcgtgagttccccgttcgtgggggggcaccccgggcttcgtcggccactatctgtgctctgggcgccctggggtcctccgcgtttttcaccccctgtgtggcggtctctctgcccctcgttctccccccgggtgtccgcggggtttcctgagtgcgcctccagcgcactttgcgtcggggttgcccccccccgggagagctttgtgagagaattgccccccgtgggtcctgtagaagagccgccacagcaccttgggcccctttggggcgccctcgggaaactctttacgcgggccacccacaacctcgcgggagaccccccacctctttggagatgtgtctcggcgcaaaaggcacccgctcgggagagagagacccacacgctggagagagataaatgatgctttgccacagagtttctctctcttgtcgtgcccctgggagagtgaagaggcgcttgttccgcaggggggtctttaaaaacgtggtccgccgccttcactacaccgcggtttctttctccgcggaaacctcggtggaagcccctcgctccggtatttccgcgagggaaacacagcgtttttgagatattccccgctctcacgggagagaaatattggcttcttctcttgcacccacacacacagggcttcggagagctccccgcacaccccacaaggagagccaccctctgggcactctgggccacacgaacacttgagccacatctttgttgtgaacccacaaaaaccctatttttatgtaattctccacacacacctcgaaccctcggaaccgttctgcccccttcttcccaactttccaacttccggcccccccctcttacagaaggaacaccctttccttcacagcccccgaaccctgaggcgtatgggaagcgtagacccccaaggtaccccggagggctaaatttgtaattttgggttgaactatttgttagaataaagtaattttgctaat

SEQ ID NO: 722261 - DNA, 766 bp, Homo sapiens
gaggcgcgtggggcttgaggccccacgcgctagaagctgaagaagccgccctggttgcaaatgccgtcgcgcatgatgtgtatgctctggtggtggtgtctatacttcctcatacacccggaggaacatacattctatcgatgattattgttagaacctccaagtgtcggctcgctatgactggattgaacattggcccattcagagcgccagtacgctttcttggggccttacaggcaggtacaaattgcgaccaatactattaatggaaacggactttgccaattccagttttccttatttaccaatggcgaagggtacgcaaggttgcattaactccttggaaccgatgtcgaaacgtgccgccaaatttattcgccagaagagttcagttaggaattcctttctttcatgctccattggcacttctgctctgtgctcccttattgtgagttatttcccaatgggctaagagctatttcattgaagcactgaaaacagctgcccgggacatactcttgcatgggggctatagcaggtgccctctttgacgaacagcaaactcagggtggcataccggggcatttggcttcccttgttcacatggcacgcttttaacaaggctttgtacccaaattccttctatctattgacactgctggcacacaacgactttgacacgagccgccagtaacaccgcaaatatttacgtgcaacaccagggaaagccgtattgaaccttggactacgcaattcttctgggaat

SEQ ID NO: 722262 - DNA, 376 bp, Homo sapiens
  misc_feature (10)..(10): n is a, c, g, or t
cggatcccgntatcccaacacatgatacttatgttctttaatgatatagggtaatgcagagatgcaacatgctggaacttcttaaaatatacagtataactgggcgcagtggctcacgtctgtaatcccagcactttaggaggccgaggcgggcggatcacctgaggtcgggagtttgagaccagcctgaccaacatggagaaaccagtctctactaaaaatacaaaattagccaggcgttgtggcacatgcctgtaatcccagctactggagaggctgatacaggagaattgcttgaaatgggagacagaggttgcagtgagctgagatcatgccactgcactccagcatgggccacagagtgagactccgcctc

SEQ ID NO: 722263 - DNA, 138 bp, Homo sapiens
tgtgccattctagacttccagtatcgtctcagccgtgcaggcttgcagttgcccggcccacgtgactcagcgcctcaaatgaagagacgggtgtggggaggagagagatgtagagagccttggaagaggtctacggag

SEQ ID NO: 722264 - DNA, 329 bp, Homo sapiens
attaaaaaaattttgaagattaaaaaaagataaaacatctaaatgatgaagtacacataaagagacaaacagactatcatgttgcaaacatgaaaacagcatatcaggtataacacttacattcaataccatgggataccaatctcatatcccactaaatcacctggtgaggagggagcacctggatgactcatacagagtttgagccaatcagagaaatgaatggtctccagctctaatttccataaacaaatcctttcagttttctgagctgcagtgctaaaacagatccctaaaaggtaatagcatctaccagactagtttaatta

SEQ ID NO: 722265 - DNA, 253 bp, Homo sapiens
  misc_feature (74)..(74): n is a, c, g, or t
  misc_feature (157)..(157): n is a, c, g, or t
  misc_feature (168)..(168): n is a, c, g, or t
  misc_feature (192)..(192): n is a, c, g, or t
  misc_feature (228)..(229): n is a, c, g, or t
ctgacgtatccgtaccactcccaattaatctttacattttcgtctgcgttagtaaatgcgttaactaggcttanaatgacgcaattctccctgcgtcatggatttcaaggtcttttaatcaccttcgggtttaatctcttttttaaaaggatcgccnttcaaattatnttaattcaaacctacaacttttanaactaaaactttagagcttgtttaatggtcaccttnncattttaatctaatgagcatttgc

SEQ ID NO: 722266 - DNA, 213 bp, Homo sapiens
aactgtggtgttccgtggggactttataacccacttacagcaactggatagatcaaccagacagaaaatcaataaggaaacacaggccctgaatgatgcattaaaccagatggacttaatagatatttatagcacattccatccaaaagcaacagaatacacattattcccaagtgcacacggaacattctctaagattgatcatatactggg

SEQ ID NO: 722267 - DNA, 364 bp, Homo sapiens
  misc_feature (8)..(8): n is a, c, g, or t
aatcgagncggtaccgacagcatcctaaccaggaggactgtaaataagcagatccccggcccagtccctgagatccaattcacatagacagatgggtgggggcccaggaatctgcattggttgtgttgtggtttgagacggaatctggctctgtcacccaggctggagtgcagtggtgtggtctcagctcacggcaacctcggtctcccaggttcaagcaattctcctgcctcagcctcccaaatagctgggatcacaggcaccagccaccatgcacagctgattttggtatttttagtagagacggggtttcaccatgtgggccagggtggtctcgaactctcgacctaaggtgatcaacctg

SEQ ID NO: 722268 - DNA, 110 bp, Homo sapiens
gtactctaagatcccagcaagcctacctatagatcaggtgctgctgagctgtgcgggatctgagtggtcggctcatgggaatgcagtgcatctgatgatgatgtctgcag

SEQ ID NO: 722269 - DNA, 417 bp, Homo sapiens
tttgagacggagtctcactgtgtcacccaggctggagtgcagtggcacgatctcagctcaatgcaagctccgcctcctgggttcacgccattctcctgcctcaggcttccgagtagctgggaggcaggagcgttgcttgagcctgggaggcaaaggctgcattgagccatgaccatgccgctgcattccagcctgggtgactgagcaagaccctgtcttaaataataataagaattattatcatccagggggcctttaattacaatgaatcgttttctgattctaaaaaatattcttcatttgaaaatacttactataatctgttttttctttgtaattctaaactgtcttaaataattttaaatatttcctcccatggttaaatattggacactttcttacttttgcctggttttc

SEQ ID NO: 722270 - DNA, 429 bp, Homo sapiens
  misc_feature (126)..(126): n is a, c, g, or t
taggcggcgcatatttatggtatctgatccgcatctatcgcaaagtgccgttgtatgatggtgacagaacgccggtgagtgaaacgtaatagtcggatgccggcgcattatcctgcctgagggtanacgcgccgcgccattaactataaaaagatgtatgacccggatcacgagtgctatcatccgcccttatgcttagcgcattaaccccaggggcaaataatgaaccacgatatcccgctaaaatattttgatattgccgatgagtacgcgaccgaatgcgcagagcctgtcgcagaggtgaacgcacaccgctggcccactacttccagttactgctcacccgtttgatgaacaatgaagagatcagcgaagaagcccaacatgaaatggctgctgaagcggggattaatcccgtacgcattgatg

SEQ ID NO: 722271 - DNA, 173 bp, Homo sapiens
  misc_feature (87)..(87): n is a, c, g, or t
  misc_feature (170)..(170): n is a, c, g, or t
tgtggagctaaactaagcacagtgcctatagaccagggtgctatgaacaggcggaaagagtgttgacaatcagaaattgtcaatggnaattgcaaataggaagacgcaagggcagaatggcagctgcaagcactgatttgcaattatgccactttcactgggaactctgngta

SEQ ID NO: 722272 - DNA, 732 bp, Homo sapiens
tcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccactgctctccagcctaggcaacagagtgagactctgtctccaaaaaaaaaaaaaaaaaaaggggactataacacccccagggaaagggacaggtgggacattcttattcttaatttaaataaattgacaggggaaagttgggccactcttgagcttgtgggtgctcaccaggttgaccccaaaaaaagaagccttccacaaaacattaatttatttccctaatatacccgcctctgtgagttaagggataatgcatcaggactcttgcaaccagacaaaattatttaaaaacgccacttgggggggaggcgggtccctcctggggattcgcctttgtgggagagaaaactgcacagacttgggcaaataatgttttttgtcaccccaaaacgtattcgcgagacatttcattagaacgaagctttaccctaatattgaactccccatttaaacagtttccacacacacttagggagatttttccctctgtgagttccgcagaacaatagttggacgggaatagaaccctgaaacactttagttcaccacgaactattatagggcggg

SEQ ID NO: 722273 - DNA, 442 bp, Homo sapiens
gggacgtctaaaagcatgtgctcatagtacgagaacaaagagatgatctgaagttggaacttacatttaaaagagaagcagagcataaaagttgtgaaattggcagcttgaccatgcaatagaaaagagaaacctattttccaggggtaaattcaagcgggctgcagacatttgcataagtaaagaggagcccagtgttaatagccaagacaatggggaaaatctctccagggcatttcagagaccttggcagtagcccctctcatcacaggcctggaggcctaggagggagaaatggtttggtgggccaggcttagggcccggctgctctgtgcagcctcaggacatggtgccctgtgtcccagccactctagctccagctgtggctaaaaggggccaaagtgcagcttgggcccttgcttcaaggggtgccgatgaatag

SEQ ID NO: 722274 - DNA, 130 bp, Homo sapiens
  misc_feature (116)..(116): n is a, c, g, or t
ctcccaataaataaaccctcgttccacatgaagctgccatcaatgtatttctctcacgcaatgcaacctgcatccactaatcctctctatatagctatccctcttcaacaattccntcactccttgggag

SEQ ID NO: 722275 - DNA, 667 bp, Homo sapiens
aaataccatagcactttcttgcatgccaaagatccctttttaacgaccagtccttttaaaggcccatgaaactccccaaggtgatgtagggtttcttatgaaacagtacactggataaaaaccgacgcaacggtttacgccaagatatctctcatctccctgaaattctccgcgggtgtcatgataagtactggagaagcctacatgttgatagtgaagaatacaattcggcccagagtctcaaatcagtcaatatattaacgttagagcaaggatagtgtcgttacgcggcatatgaaacccacatctctagattctataggcgcatatgttaacagcatagtctggcacacagccctgctcctgtgaagccgttagcaccataagcggcacccactagcacggtttggtgggcgcttcattagaagatgcgacatttctcgcatgttgggaactcacaataataagtgcatacatggatctcgctaactaggcgtcctaatcattttttcccagtcattgtacacggatgggtgtgctttagggtcactcagaagacaggccctaagacgaaaatgggagcaaaatgggtacagcttactgtacacagtggacgtatagtacctttgtgagtggggcttgactcgtgcatcaatcaatgatttac

SEQ ID NO: 722276 - DNA, 433 bp, Homo sapiens
ctgtcagtgcattgtccaattgcatgtgtcacttgggtcctgtgtcacatttgggtaattatgacaatatttcaaactttattatcatatctgttatgctgatctgtgatcagtgatctttgatgttaccatgcaattgttttggggtaccacaaactatacccatataagagggcaaacttagtggatatgtgtgtgtgttctgactgctccactgaccagctcttccctgtctttcttcctcttctggggcctccctatttcctgagacacaacagtatcaaaattaagccaattaataaccctgcaatggcttttaactgttcaaatgaagagttgcacatctcttcattttaaatcaaaagtagaaatgattaagcttagtgaagaaggcatatcaaaagccgagacaggctgaaagccaggcctctgg

SEQ ID NO: 722277 - DNA, 343 bp, Homo sapiens
ggatttagagatataaatataaactgcctcagaaaacctccattctcttatatcttttcatccccttaaatacctactcgcatttcacttacagcacatatattcttatatcctttagagtatagagtgcttttttttttaaaatgaaaatccaggccaaagactaaattcttcaagctttcattccttccttagaacctcatatatttgtgttcactgctgaaaatcccttttctacaaagctcccaaactccacattcttccctttgatactacagtcatttgacacaatgactagagtcagtgtaaatctatatagactgcaaattgcgctctaatctcc

SEQ ID NO: 722278 - DNA, 102 bp, Homo sapiens
ccggggtgtggtggtgctctgcgtacttggcttctcatctttgtagcttgcttccagttcacaactctttccttctgctctccttcttcttcttctttttgg

SEQ ID NO: 722279 - DNA, 371 bp, Homo sapiens
tttttggaaagagcccaaacctttgtgccttggagggagccaaccccccctgacagggagacattggcaaaatagaccaaaaacaaaaggtgttttcatggtatccagcctggatgccaagcccaatttttggtggataccaaaggccagctgtttgggaaaagggcaggatgttttgaggcctggcacccacatttccatgtgtttttttaccaaaaaaggggttttttttttgagggttggacagggggggtgtacacacaggcataaaaaaggtggagaggggtttttgggggcaaaactcagactgtaaattttgtggggttcccttgttttttgagcccattaaataaaaaggttgttttggggta

SEQ ID NO: 722280 - DNA, 176 bp, Homo sapiens
ggacacagtatactcaatcagtacagtctattcctttgtatctcatgccacggcaaaatacagatagcagacagcagcgtctaccccatatgaaagaccttactaacctggataagcagagacatacacctatatgagaactatctctacgaatgccaagacagagcatgggtggt

SEQ ID NO: 722281 - DNA, 946 bp, Homo sapiens
  misc_feature (19)..(19): n is a, c, g, or t
  misc_feature (74)..(74): n is a, c, g, or t
  misc_feature (93)..(93): n is a, c, g, or t
  misc_feature (106)..(106): n is a, c, g, or t
  misc_feature (120)..(120): n is a, c, g, or t
  misc_feature (132)..(132): n is a, c, g, or t
  misc_feature (154)..(155): n is a, c, g, or t
  misc_feature (197)..(197): n is a, c, g, or t
  misc_feature (336)..(336): n is a, c, g, or t
  misc_feature (422)..(422): n is a, c, g, or t
  misc_feature (429)..(429): n is a, c, g, or t
  misc_feature (434)..(434): n is a, c, g, or t
  misc_feature (439)..(439): n is a, c, g, or t
  misc_feature (453)..(453): n is a, c, g, or t
  misc_feature (457)..(457): n is a, c, g, or t
  misc_feature (460)..(460): n is a, c, g, or t
  misc_feature (606)..(606): n is a, c, g, or t
  misc_feature (624)..(626): n is a, c, g, or t
  misc_feature (631)..(631): n is a, c, g, or t
  misc_feature (633)..(633): n is a, c, g, or t
  misc_feature (635)..(635): n is a, c, g, or t
  misc_feature (637)..(637): n is a, c, g, or t
  misc_feature (651)..(651): n is a, c, g, or t
  misc_feature (656)..(657): n is a, c, g, or t
  misc_feature (660)..(660): n is a, c, g, or t
  misc_feature (664)..(664): n is a, c, g, or t
  misc_feature (670)..(670): n is a, c, g, or t
  misc_feature (672)..(672): n is a, c, g, or t
  misc_feature (677)..(677): n is a, c, g, or t
aggatgaaaggcgcctctnccatgatctgtattaatgtttttatttctcggtgcatttgagagaagccacgctntcctctcgagcccagatgnaaagacgtttttntgctgtgggcagcnccctcccccgcngcggggtagggaagaaaattannctgcgggttttaatttatttcatccagtttgttctccgggtntggcctcagccctcagaacaatccgattcacgtagggaaatgttaaggacttctgcagctatgcgcaatgtggcattggggggccgggcaggtcctgcccatgtgtcccctcactctgtcagccagccgccctgggctntctgtcaccagctatctgtcatctctctggggccctgggcctcagttcaacctggtggcaccagatgcaacctcactatggtatgntggccanaaccntttcntgggggttacaggnaaanaanaaccccccagaactaaggccgtttttctgaggacgtcatcggaggctgggcccctgggatgggaccagggatgggggatgggccagggtttacccagtgggacagaggagcaaggtttaaatttgttattgtgtattatgttgttnaaatgcattttgggggtnnntaatntntntnacaggaaagacatncgaannctncttntgtgtnanagttnttggtgactgtcccaccgggagcctccccctcagatgatctctccacggtagcacttgaccttttcgacgcttaacctttccgtgtcgccccaggccctccctgactccctgtgggggtggccatccctgggcccctccacgcctcctggccagacgctgacgctgccgctgcaccacggcgtttttttacaacattcaactttagtatttttactattataatataatatgaaccttccctccaaattcttcaataaaagttgctttt

SEQ ID NO: 722282 - DNA, 427 bp, Homo sapiens
  misc_feature (189)..(189): n is a, c, g, or t
  misc_feature (383)..(383): n is a, c, g, or t
  misc_feature (386)..(386): n is a, c, g, or t
  misc_feature (389)..(389): n is a, c, g, or t
tgctggtaccggatgtgctgtaggccagcgtacggcccatgcttgtggtcatcctcctccgttgctgtccccacaaagtccaagaaggatcggagaccagagccccagcatccgaggtgcatccggcagtcaagggatggggacagcggcccccaggggatgcagacagacgttccctcatgcaagtgncagatggccaggcactgtgtctcctggaggaatgggacagaacacgcccctccctcagaactgccctagcccagcccagagaacgccacacctcagggccagcccccacgtgcgctgcgcccttgctgtcctctgaaggcaggggatgagccagggcagaatcaggtgtgccccatacctgactccaccgctgnccnacngcacaggccttgaggctctttttttttttttttttggg

SEQ ID NO: 722283 - DNA, 1560 bp, Homo sapiens
  misc_feature (443)..(443): n is a, c, g, or t
  misc_feature (445)..(445): n is a, c, g, or t
acgcgtccgcttccagacagcaaccacaactatgcaagctgctgactcgcggtggtttcccagggtgttcaggggctacgcggagaggaagcgccggaaacgggagaatgattccgcgtctgtaatccagaggaacttccgcaaacacctgcgcatggtcggcagccggagggtgaaggcccagagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagagcnanaaggacgaagtcacggccatctcaactcccgtggaacatggctggaagaagaacgaccgctgtggaccagagactcgcaggactcccagcgctgtaccggaagggatgctcgcgaggcgcctccctgggggggccccttgcggcggcggccccgttcggcgccgtcctgggccggcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaac

SEQ ID NO: 722284 - DNA, 399 bp, Homo sapiens
  misc_feature (193)..(193): n is a, c, g, or t
  misc_feature (196)..(196): n is a, c, g, or t
tgccatcccccagggttccccatcacccgaaaggaaaggacgccccaattaacccccgttggcccttgggcctcccgagtggccggctgcaaccccggctcctttccagggtaggccagcttgaggaattttatttattttatttatttacccaaatttgaactagtttgttgggttgggggaaggaggtggntgntacccccaagccttcccagtgttgacaaccccgggggcaggggagggggcccagtccctccccatggggtgcacattgggccctcgggccctcccatgtccctgggggtactgccctttcaaggcttcctccaatttggggtcgggggcccctgggaggtgctttacagaccgctaataaaaaacgatttgggtgaaccccca

SEQ ID NO: 722285 - DNA, 190 bp, Homo sapiens
  misc_feature (132)..(132): n is a, c, g, or t
  misc_feature (138)..(138): n is a, c, g, or t
  misc_feature (170)..(170): n is a, c, g, or t
  misc_feature (183)..(183): n is a, c, g, or t
gagaagcgctctcgccgattccggtcatagtcccgatattcaccccgactacggcgctcacggcccacggtcccactctctgtcattccaatcgtcccctcgacgtctttcatctctctcgcgggaacggtncgtaangcctgcgctctcttctgaacttgtccctgcgnccttcgatcgtanctcgtca

SEQ ID NO: 722286 - DNA, 240 bp, Homo sapiens
tagaagtttcaatagtaggaagaagtcaagagctctatggtataccatagtaactctaggatctttgggtttggttttttaattttaagttccagggcacatgtggaggatgtgcaggtctgttacataggtagacatgtgctgtgatgttttgctgcacttatcaacctatcgcgtaggtattaagcccagcatgcattagccatttttcctgatgctatggaaacttctaaaactagg

SEQ ID NO: 722287 - DNA, 234 bp, Homo sapiens
  misc_feature (71)..(71): n is a, c, g, or t
  misc_feature (131)..(131): n is a, c, g, or t
  misc_feature (133)..(134): n is a, c, g, or t
  misc_feature (147)..(147): n is a, c, g, or t
  misc_feature (150)..(151): n is a, c, g, or t
  misc_feature (175)..(175): n is a, c, g, or t
gaaatttcaacaccacatgttctcactcacgcagaagctaaaaaaaaaagttgatcttatagaagtaaaangtagaacagaggatactgcaggctgaaaagggtagggagaaaggaggaatagtaagacantnntcaatggatacanaannacagctaggtaggagtaataagtnctagtgttctatagtaccgtagatgactatagttaacaatactatattatgtagtttaa

SEQ ID NO: 722288 - DNA, 579 bp, Homo sapiens
tagaggatccgtagctgaggaggagcctgagcgggtccgaaggagccttcagaaactcatggcacttcaatacatagtctgctgacttgcctctgccagagtgtgcttacagatgcccgagacgagatgactaggcatctgcatcatctgtgtcggtcccctccctgagccagcatctccatccaccaccccgtgcaagctcgcgtgccagcatttattcctcccagtgtccaagcccctccaggagggtcctggggttgggccagatgcctgcccagctctgtctcctgcctctgttcctctgcccttcttatagccagaacttgtatcttctcagcaaccttcactttgtccttgtccttttaccattccccatcaaagagtagtctgctataatcactttgtgtaagatatgtctgtcttttggggtcctcagagaaaattgccattttctcggagaattctctggactcctctctgcttcacattccactttcccagacactggtgttactgctagaccaagccctctggtggccctgtccgggcataagagaaggctcaactcttgtctactgg

SEQ ID NO: 722289 - DNA, 417 bp, Homo sapiens
catttcattcttgacattcggaagcatttgtcatcccacaatgacctggttaactagtgagggacggctggttccctgtaattcctgtcatgactacataacgtaaaggtcaaactcagattgatgtgtgatggtactatccactgtagtgcctgctggtacattgccacttttctcctaccctttctgttttatctgcacagaagagtcgtgactgatatcaaccctggcgccacaatataagttattcctggccggtaatcttcttccaagctaatacatgcctttcgaattgctattagttctggccaagctacctgtttcatttgtccctcagatacccctccacggtaatagatgatccgagtgggtttgaagcgtgtggatttgtagaactgaatcagcagctctcgaacc

SEQ ID NO: 722290 - DNA, 391 bp, Homo sapiens
  misc_feature (24)..(24): n is a, c, g, or t
  misc_feature (87)..(87): n is a, c, g, or t
  misc_feature (178)..(178): n is a, c, g, or t
  misc_feature (188)..(188): n is a, c, g, or t
  misc_feature (197)..(197): n is a, c, g, or t
  misc_feature (200)..(200): n is a, c, g, or t
  misc_feature (213)..(213): n is a, c, g, or t
  misc_feature (218)..(218): n is a, c, g, or t
  misc_feature (254)..(254): n is a, c, g, or t
  misc_feature (333)..(333): n is a, c, g, or t
  misc_feature (347)..(347): n is a, c, g, or t
taaacggtacatcccagaattctncgctgtttggtcaagaaggggctggtaaaaaccaaaaagccttaaacctgctcggggccccanggatgctggtggactgtgtgcccctggtggaggtggacgacatgatgatcatggcaagaagctgaccccaagtgtgtcttcacctatgtgnagtgctctanaaccacctngangccacgaacatgnctcgnggcaagaatgtctagcctgcccgcccgcatggccancagtggcaactgccgcccccactctccgggcaccgtctcctgcctgtcgtccgcccaccgctgccctgtctgttgcganaccctcccccccanggacacacgcagcgttttgataaattattggttttcaacgaaaa

SEQ ID NO: 722291 - DNA, 761 bp, Homo sapiens
gggggggagagctttaaaaaaaaaagaacaggcggtcacctctaaaaacaaaaaaaaacaaaaaaaaaaaaaaaaaaacaaaacaaaaaaaaaaaaaaaaaaaaaaaaaaaaaaaaaaaaactttttgggcgcccccgcccccccgatttttttataatccaagttttttttttttgcccccaaaaggggggcttttggcaaaaacccctttttggggggggtttaaaaaaattcggggggcggtttaaaaaaaccgggggggggaaaaccccgggggcccccccaaaaaaaccttgggggaaaaaccccctttttcaggggggggaaaaaaaaaaaaggggcccccaaaaaacctttttaaaaaaaggggcacccccttgggggaaaaaaaatttttgcccgcttttttttttaaaaaaacccccaaaaattttttaaaaaaaccactttttttaacaacaaaccgcaaaagggaaaaatccttttttaaaaaaaaaaaaaaaccccggagggggggggggtgttccccccttgaaaaaaaaaccccctttttaaaaaggggggcccccccaaaaaagggggaaaaacccctttttagggggggggccccccttttgagaaaccccccctctaaatttttttgggggggggggccccaaaaaacaaaataagccccccaaggggggcccccctttataaattcttgggaaaaacccccccttcgggggaaagggggggggggggcccccccccccccccc

SEQ ID NO: 722292 - DNA, 170 bp, Homo sapiens
aatcggaatgtcttctggacttgtgcgctcagagcagaggtcccaggctctaacaatatacaccctgtcagactgctaatgcctcttctctctcatcgggccagttaaagtctccttccctctctcagtcacaggcatccagagtgttagattcattccgttcgcatgtt

SEQ ID NO: 722293 - DNA, 319 bp, Homo sapiens
  misc_feature (76)..(76): n is a, c, g, or t
  misc_feature (120)..(120): n is a, c, g, or t
  misc_feature (234)..(234): n is a, c, g, or t
  misc_feature (237)..(237): n is a, c, g, or t
  misc_feature (260)..(260): n is a, c, g, or t
  misc_feature (278)..(278): n is a, c, g, or t
ggattacaggtgctcgccaccacgcctggcgaatttttgtatctttagtagtgaaaccccggccccatctctacantataaacaaaaatgacccaggtgtgatggcacatgcctgttgtntccctattgggagacagaagcaggaggatttcttgagtccaggagttcaagaccagcttgggcaacatagctagaccctgtgtctacttctcccatgccccgccaaaaaaaagngtnatttataagtgcttaagcatagngtagatactcagtatatnaaaggtgtttggcatagagttgataataaaatgtcgattta

SEQ ID NO: 722294 - DNA, 529 bp, Homo sapiens
actcaatctgatataatgcatctatatcttcatgaatacgttgacgcaactttatcgccggaagcgccgaaacatggttaatacgggcgtacaagatcatttaacgcttcaagaaaggccaaacgatcagcgtcatagagatcaggggaggactcaatataatccagtattactgtcaaagtatcaaaacggctaggagcaccagaagcaagcattgcatcaattcttttagaaaacgcggtgcgttgattcaatccttcattaaacagaatttggccaacttggctcgaagtaacccgctcctgaggcgactgtacctcatcatccgtgagaagcaccataatacgacggtaactctctaactgttgatgcaaagacgctaaaagtggctgggcctgttgtgggtcaggggaatgtttaacgtcaactgaaacggtagtaaccggtgatgcagactcaacaggtttagattgatgcttacaagctacaagtgcccagcatgtacacagattcagtaaaaaagaactga

SEQ ID NO: 722295 - DNA, 102 bp, Homo sapiens
gcttgaatccacaggacttttggaattgtggctgtcagattatagcaatgaattttccagactccgggtccaatgatggaccttcacacgggctgggttctt

SEQ ID NO: 722296 - DNA, 223 bp, Homo sapiens
ctgatgacttccactcaggctgcagccgaacgccaccaccccgggcactactgtgccccaacggaacttcccgcgcctgccggcaacagccgcgagaggaacgaaaacagcgtgcccactgcagtgttgacgatcatgccgaagatgatcaggcacatcaccagccccagcagcggtgacacttcgttggcaatcgacagcatcggcatgggcaggtctgcca

SEQ ID NO: 722297 - DNA, 446 bp, Homo sapiens
ccgccccaggtcgaagtaaatatcccatggctattgtgccagtgtgtcccatgtgcctccctctcaggggcaggttcacaagtctgcagcaacaacatgaggagccaatggaaaccagcatcagaatgcaaaggaggaagagaagcatgccagtggcacaggaggacaccacatgtagacagagcaacagcagccagacaccagcagcaaaataaggcagagtctgaagacaatggagacctctcaagctggatccaaggataaaaagatggaccaaccaccccatgccatgaaggcaaaagtgaagaacagtactgtggacctgccaatcgagaatcagctaattatggcagatagacagagagatgctcaactagtcaccattgcaactgagggtcagatgatcatgcaggataaacctggagcaaggagcggaatgctgctaa

SEQ ID NO: 722298 - DNA, 229 bp, Homo sapiens
tccagcatcgtagagtgctgggctctaccgtactactatgatctgagtcatggctacatgcatgcatgcataactagaagctaacactgagctgtatatctacagacctgtgcactttgctagtatgtatatcacacctacaatggaaacttgtaacaggaacttaataacttttttttttaaacgcttctaatgtgaactttacctaagaggtatatcatgtaacagc

SEQ ID NO: 722299 - DNA, 474 bp, Homo sapiens
  misc_feature (24)..(24): n is a, c, g, or t
  misc_feature (67)..(67): n is a, c, g, or t
  misc_feature (73)..(73): n is a, c, g, or t
  misc_feature (254)..(255): n is a, c, g, or t
aagaccagcctggggtaatatagngggatcctgtgcctctataaaaaaattaaaaattagtcagttntagtgncacatacctgtagtcccagctactcaggaggctgaggtggaaggatcacttgagcccagaaggtaaggctgcagtgagctgtgactgtgccactacactccagcctgagtgacagagaaagaacctgtcaaaaaaaaaaaaaaaaaaacctacatttcaagtactatttcccttctctccnntctaattgctaaagattttctttcatacgcacacactccagtgactggaaaaacgggagttttcagtcaaagcttgacatttagagaaaacaaggactttctgcctttataaatggaaatcaactgtgtgtgaactataactctgcagaggttatgaattcatcctttacaaacaataatgaacttttagtcctgtaataaatgaaatgttattaggca

SEQ ID NO: 722300 - DNA, 424 bp, Homo sapiens
tgcgctcacgttctcaggcggctgctccaggccttcgagggggagctggctcctgtggggggagttggggctcggtgggccagctgggagttggagctattcgatggagttgagtgttttggtggagtccgaatcaggctctttgtcgaagtcctggtctggatcagacatacttctcaaatgcacattcacgctatgctccgatccacctgatgagggccactagactgtagggcttgttcctgaatggatgctgtcgagccaggtcggtgtgagcgtggcccggcctttcctcctgggaagggggcacagccctctagaggcaggtccatgacgccctgcatgccgtcgcctgggcccatgttcgccacgtgcttaaagttggttgcgtaggctatcatttcggatccccattctgggtctc

SEQ ID NO: 722301 - DNA, 417 bp, Homo sapiens
  misc_feature (17)..(17): n is a, c, g, or t
  misc_feature (26)..(26): n is a, c, g, or t
  misc_feature (183)..(183): n is a, c, g, or t
ttacgatgacttctctnttttgcttntacccgctccccctcctctggtcccgctcccgtggtggggcgcggggctgcctgtctttctggtctggagccacaaccgcaggcccccgtcctcgcccgtgaccgacggccggcgctgctgcaggccccctcgcggactccgcactgcgcacccacngccgcgcctcgcgtccccgacccaacagggctaggagcggggaatgcaggactgcggaggggcagggagagacgccctgagacgcggagataaacacccggagacgccgggagagacggggagagacgcacacagagacaccaagacacagacacgcaggttgtagagacaaattcagagacacgagcgaggatagaggcgcggactgagcccgggactgggacccggcggccg

SEQ ID NO: 722302 - DNA, 87 bp, Homo sapiens
aggctaagaatacctttttgaatttgttggtttttacaaaataaaaaggcccccagaagaattgcaaaaaaccagacgagtgaccaa

SEQ ID NO: 722303 - DNA, 856 bp, Homo sapiens
ttcccgcgggtgattttttctccgcgacacttttcctcttgctgtcttggtgccctacagaagtgtggtccctaaaaacaggtggttgctcggcgcgtttctcccgggtgcttcttcccgccgcctggcgcgcccttcttcttttttcaacccgacgccgggtgggtgctccgcctgtctttcttcctagatgaggacagcctcctccttgtgctgtccctctcactcgtgctgtaagtaggtgagaggctttttttgctgggcggctgacgccttcttctttcttcctccaatcactgttgttccccctcctctattttattatcttttctccgcgcgatcgctccccagccgcttgtgtttctccccccaccatcttcttcgcatagaatgatacttctctctgtgtcgaatgaataaaaaacaaacagactcgtggctgcgttgaatatcaactcaacacgtcaccaccacactctggtgttcttctctccccccccaccaaaaaaatatagatgtgtctgctcctcctctcctccttcccctccccccccccccactacatttttttgtttttttggtgtgcgcgagcctctgtttccttctctcctccttcttggtgtgccgcacggcgccccttctcccacctgcgtgtgtgtgtctctgctgcttcctcccgctgcgctgtttcttcttcttcttttttttttcttgtcgggtcgttgttttgtttgcccccccccccccgcggggggtgtgcccccccctctttctggggggggggggaagtttgttgtccccccaaaaaaaaacccctttttttccccccctttttttttaaattttttttttttta

SEQ ID NO: 722304 - DNA, 284 bp, Homo sapiens
cagccgggatattgattcgatgacagacttatcatcgttcagtgatgtacctccgggtcaaacttagatatccaagataggttattcttttttttcttgagacagaatttcactcttgttgcccaggatggagtgcaatggcacgatcttggttcaccacaacctccgcttcccaggttcaagcgattcacctgcctcagcctcctgagtagctgggattacaggcacgtgccaccatgccgctaatctttgtatttttagtagagacggggttttactatgct

SEQ ID NO: 722305 - DNA, 583 bp, Homo sapiens
gaggacccccgaacatgtcgagctatagggaaaaaaaactccttctacttgagaaaagaagacattaaagaggactttatcttgcagcttaggtaccagttaggccacagttgggtagagcaacaagtggtctattggcatccctgattccaggcattagctcttggatggcatttctataactaccctgagccagagagaagccaactgccctgaaggtgagtcctaggcctggcagcactcatcataagctgactaaagagcctttggtccttgaatgaatatcattggtagccaggcagtactccctgtgggcctgtggtagtggtggccatgagaagagactcctcttcttacggaaaggggtaggaagagtgggaaaaactatcttgtggcttgggtaccagctcaaccacagtagaatagaacaccaagtaggttcctaaggtttctgattccagtccctagacaccggatgtcatctctggatgtgcccaggaccatggggaacttgccaccctgaagggaaggatacaagcctggatggcttgatcatctactgattgtagagtactaagggctt

SEQ ID NO: 722306 - DNA, 784 bp, Homo sapiens
gggatccaacgttgcagcgtgccaccatccaccagacagaccaccgtgaccccattctcaaactcctgtaaggatggatgcgaaccatcaaacccaagcgcaggttgacaagttcactatcgagcgggaaaggggagagaagaacgattcaagatcgaactgtgtgacgattggcgaaaaccagccaaacgcgatttatggggtcaaaacaagccaaatggccgataaccttatgcggagattttgtaccaccatgtgtgtaaaaacacttcactttacacgggcgacctgtggttggtcaaaattggggctcgcaactcatggggggtgcgccttgggggcccaaccgcggggtttgggcggcccctgcacgggtgggcccccttagtttccccgcaaaagggatggctctccgcgcaaaaaggcgttaacgcttgctcagcacgcaacattacacaccgacagtttcggcaccgggtggagcagacccaacaaggccgggaagacaggagcgcaatttttacccccctcttattgaggggcccttacacaaacgcgtagtggaagcgcatacacccccacggtagactggtaataggttaaaacagcaaacaaacagctatgtgtcgtccaaccttagtcactaacacgagggagaaacaagttaccccttgtgggctgcacaagggggctgaaagcacaggacagaggtagatgagtatttcccagcagaactcacgacaaatatctcttttggcaaaccagccataacaacaataaacgg

SEQ ID NO: 722307 - DNA, 973 bp, Homo sapiens
  misc_feature (972)..(973): n is a, c, g, or t
tgcctcctgggctcaagcaattctcctgcctcagcctcctgagtaactgggattacaggtgcgtgccaccacaccctgctaattttgtatttttagtagagatgggggtttcaccatgtggccaggctggtctcgaactcctgacctcatgagccccctgcctcagccttccaaagtgctgggattacaggcgtgagccaccatgcccagccatattattactttttttttttttttcctctggagacgggagtctggctctgttcgcccaggcttggcagtgcagtgggcgcaatcttgggctccctgcaagctctggcctcccgggttcatgggccattctcctgctttaagctctcccaagtcgctggggactacgggtgcccaccacccatgcccagctaaattaggggtatcttcagtgggagaggggtgtttcactggtgttagccaggatacgtctataatcttcccgatcttggtgatcggcccacctgcggcctcccaaaagtcctgagattccgggtgtgagcccaccaggccccagcgcgtattcattactttttaacactatgtcttaggatcatatataatggggagctaaatttttcggccatctacgagaatgcttgcagatcatggatactcctgcgggtttgtatacatctacctcatggattacacattcggccgtatattttagcatgggggtggtgaaattaaaccaggttgcttagatagcctcgctatggacgtttcatatgagaacgaggatttgaacgttatactgtggtccaatttagaacacggctgggcttaggagggaatggggtatccgcccttggagtaaacacggtgtatgttggaaggtaacttcctttcgattatatatccacagggagtattcggtcaatgggtcggagagtgccactactgatcactaggcatacgtgtaaatgattatatagttann

SEQ ID NO: 722308 - DNA, 278 bp, Homo sapiens
  misc_feature (121)..(121): n is a, c, g, or t
atagcctggtcctgctggcttaagacctgcccggcggcgtctggtgagctctcgtctgtgccctttaaatctgggggacgagggtgtaaatctcgtgccgttgcctgtacccatatctganagcatgtctccaatggttaacagtctctggcacgttgtaacaatgtatgtaagggaagtcgacaagcctgatccgtaacttcgggataaggattggctctaagggctggatctggtcatgcttgaggcgcgaagcttggtcttgttggctgcatggt

SEQ ID NO: 722309 - DNA, 100 bp, Homo sapiens
gtgcaaccagatttagggcatgataaagataaggacaagtggaaagaggttcaaaagaaggtggttgagagtccttatgaggtgatcaaaataaaagggt

SEQ ID NO: 722310 - DNA, 306 bp, Homo sapiens
  misc_feature (40)..(40): n is a, c, g, or t
  misc_feature (163)..(163): n is a, c, g, or t
gggtaccgctttagagtaatatctgtcccctgaactttgncatgagcggaagcagctgaaactcttaccagaaccagaactgtgtcaaacctcttttccttataaattacccaccctctggtattcctttatagcaacacaaatggactaagacacagctacnacaaagactggaatgttttaacttcatttactctccttcatgacttatttgttactattttcatgtattatgaaattctaccttgattttaccccatagatattattatattactaaacaattagtggggttttttggagggg

SEQ ID NO: 722311 - DNA, 380 bp, Homo sapiens
  misc_feature (64)..(64): n is a, c, g, or t
  misc_feature (126)..(126): n is a, c, g, or t
  misc_feature (128)..(128): n is a, c, g, or t
  misc_feature (219)..(219): n is a, c, g, or t
  misc_feature (268)..(268): n is a, c, g, or t
  misc_feature (286)..(286): n is a, c, g, or t
  misc_feature (354)..(354): n is a, c, g, or t
cttaaattaattatataaccactagcaagacacagaactggtcttgaactcctggactcaagcnatcctcccgcctcggcctcccaaagtgctgggattacaggcacaagccaccacacccaactntntttaaatttttttaacagtgttttggctaggcacagtggctcatgcctgtaatccaagcacattatgatgctgaggcagagagattgcttnagcccaggagttcgaggtcagcctgggcaacatggcaaaacctcatctntacaaaaaattacaaaanttagtcaggcatggtggtgcatgcttgtagtccctggtactcaggaggctgaggtgggaagatttttntgagcacagtaggtaggggctacagt

SEQ ID NO: 722312 - DNA, 306 bp, Homo sapiens
cgtactgacaaagttgaagaggacataagcagctctatgaccaaatagcacagctgccagtagacccccgtgtcaccctgaggctggtggtccctggtagtcagtgtggctctctcattggaaaaggtggatgcgagatcaaggaaatacgagagagtacaggggctcgggtccaggtgggaggggatgtgttagctacctaaattgactggggcgggcattattattggtggcataccatattccatcattgtgtgtgtcacacagatctgcgtggtcatgttggagactctctcccagtccccc

SEQ ID NO: 722313 - DNA, 362 bp, Homo sapiens
gcttatggtagatttgtgtatctaaccagatatataatagaaaaagtatagtaaaagaaatctaaaagattaaaaatggaagccgggggctgtagctcacacctgtaatcccagcattttgggaggccaaggcgggtggatcacaaggtcaggagatcgagactatcctggccaacacagtgaaaccccatctctactaaagatacaaaaattggccggacgtggtggtgcgcgcctgtgatcccagctgctccagaggctgaggcgggagaattgttggatcccgggaggaagaggtttcattgagctgagatctcattactgtacactccagcctgggtgacagagcgagactccatctc

SEQ ID NO: 722314 - DNA, 128 bp, Homo sapiens
cacggatccccatcactagcgtttgcctagctacccctcgaacttggcacttccttagtaactcttcaacccattgttatctggcctctgctctcacaacacggaaaccgtttatggtgagcaggatg

SEQ ID NO: 722315 - DNA, 789 bp, Homo sapiens
  misc_feature (323)..(323): n is a, c, g, or t
  misc_feature (337)..(337): n is a, c, g, or t
  misc_feature (359)..(359): n is a, c, g, or t
  misc_feature (393)..(393): n is a, c, g, or t
aaaaaaaatgtttaagggatcttgggaacctttccggggagggttgttaaccgaattaagccttttagaacctaaaccttctctttttaacaggttaaattgttaaattttccaaccccaggtcaagagagctgcgccaaattattttttaacgaaaagtaatttatttccaagaatcccaattttggttaaatcacaatttgccaccttccaattttaattaagtaactggtctccctacgtgtctccttagagacttggcttgcttaatgggtacatttcttaatccactttttacctcctcaatatatctgcaggtgtgnaatatcagaaatgnagctatacctcctgagagatgnagttatataccagagatgattataaaataaaganttattcttaaaataagccaaaacactattttttttagaaaacgagaaagatcgcatatttagactattttctaacctttcgactgatgaaaggggcagcttaaaaaaactatctatggccaggcgtggtggctggcgcctgtaatcccagcactttgggaagctgagacgggcggatcacggggtcaggagtttgagaccagcttggccaatgtggtgaaaccccatcttctactaaaaatacaaaaattagctgggcccggtggtgcacgcctgtaatcccagctactcagggaggctgagacaggagaattgcttgaacccaggagccaaaggttcaagtgaactgagatcatgccattgcgctccagcctgggcgacagagtgaaactccatc

SEQ ID NO: 722316 - DNA, 212 bp, Homo sapiens
  misc_feature (29)..(29): n is a, c, g, or t
  misc_feature (68)..(68): n is a, c, g, or t
  misc_feature (197)..(197): n is a, c, g, or t
aaaacaacatgtcatagtagactgaaggnagaagcagataagagactaaaacaatttttgattaagcnagatatttaagagctttgcaaagatgtgaaacaatgccacttttcactagttttttttgcgtttgcaagtcatttttcattaaaatgttatttatgttaatttgtaatgagtttgttattttaaaatgnataaataaatattat

SEQ ID NO: 722317 - DNA, 134 bp, Homo sapiens
tcaaaggacctggcggggctccatatccctcgtagcggcagcctgttctgtagatcgataaacaccagtaagtaccccatacaccggaagtaccccatacaccggaagtaccccatacaccggaagtaccccat

SEQ ID NO: 722318 - DNA, 148 bp, Homo sapiens
aagcataatatagccaggactaacccctataccttctgcataatgaattaactagaactaactttgcaaggcagaaccacagctaagcaccccgaaagcagacgagctacctacgaacagctaacagagcacacccgtctatgtagca

SEQ ID NO: 722319 - DNA, 241 bp, Homo sapiens
attgctatccccactgtgcgtcaagtatttagctgactcgcaaactccacggacgccatatgaaatgatctgctgcagatgctctgagccctaggattcatctattcttttcacctgtaggtggcctgactggaattgtattcgcaaactcatcactagccatcgtactaccaccgacacgtactacgttgtagcccccttcccctctgtcctctcactaggagcggtggcgcactcatgt

SEQ ID NO: 722320 - DNA, 242 bp, Homo sapiens
  misc_feature (60)..(60): n is a, c, g, or t
  misc_feature (203)..(203): n is a, c, g, or t
ggcacgagcttgagttcaggagttcgagactagcctaggcaacatggtgaaacccatctnttaaaagaaaaaaaaaagaaagaaagaaattagcgaggtatagtgcatagtggtgtacagctgtgatctcagccactggggaggctgaggcaggaggttcgctggagcctggggggtcaaggctgcagtgagcagtgattgcnccactgtactccagcttgggcgacagagtgagaccctgt

SEQ ID NO: 722321 - DNA, 730 bp, Homo sapiens
  misc_feature (425)..(425): n is a, c, g, or t
aacggctaggtacgaggctgggtggcgcatgtacacgtatctgaaaactggagggccttcaaggctctcatcgctgctcagtacagcggggctcagtgtcctgcgtgctctccgcaccaccccacttccattttggccaaaccaacctgcacccctgaatttctccgcaaatttcctgcctggcaaggtcccagcatttgatgtgtgtgatgatggattcttgtgtgttttgagagcaactgccattgcctactattgtgatgcacatgatgtgatgctgctggggaatgtactccatgagtgcatgcatgcccagtgtggtgcagttgggtgagctttgctgattcctgatatatgtgcccccagccagtacctgggtgttccccaccttgtgtgcatcattgcagccacagacagaacatgtngcccacttgcagaaattgcaacatgtgatgtgaatgtgatgtgcgaattctggtggctgcttggatgcttacttgaagacgaggacttttcttggttgggctgaactgatgtgacattggcttgacatcacatgttgtctgcaccctgttgtggctctataagcatggttctagagccttctttcctgccaggcctttcccaataccaacctgctggttcctcacctgcattaaccagccccagttcctgggctgtcttggggggaagtgaaactgttgtgaggaagatggcccagtttgatgct

SEQ ID NO: 722322 - DNA, 144 bp, Homo sapiens
ctctagaggatcctgtgcttatcatacctacccaaaaacaacccggtcccaaagcttaaaacaagtagactaacatgaaagccacatatcagtggctaccagtggttacaataaatgctaataagatacacttccctatgaaaa

SEQ ID NO: 722323 - DNA, 882 bp, Homo sapiens
  misc_feature (173)..(173): n is a, c, g, or t
accgtcttcatgggtgtgccctcctcgtaaacacccctcgggggcaaaattaccctttggggcggtaatacctttggggcgccgccaacgagggcgagtccaacactcacttcctggtagccctccccctcggggtagttgcgccacacggcttctctcccgtgcggctcagnggaggaacgcaccccacgcaatggggtgtgcactcactctcacacttgttggtctcgataacgcgcacgccgttctgttttcgcgacgtaaaggacacgccctggggaggtactcccatccggtcgtttctcccatttataaaccaggtggcccccactcttctcggggctgcgcccctcgtcgagggatacaaacacccggtggcggtatacagtaaagggggtcggcccaattggaaactcccccactctacgcgctacaatggacagccagcctcgagttgacgcgcactaacctcgagcccgcaccgctcttggaagacaacacactgcgggtgagacaaggcgctggggtgtctcaccccaccgggagtacaggcacagccagggacactccacggggtggcctcccggagtcaacaagctgggaccaatcaacgtcgcgcgcgcatgatctgagggaaccgtgcacacacgtgtgcacactggccgcgcaaggacgcggctatagaatgataggcgggccccacctagggggctcgcggcccgttggagcgatcgagcgaggagtggttgtcgtgagtgcggcagccaattgggcgagtggcggtgaaccaccgacaaggggggcggtactacacagggatccgtgcgcccagccgccaagacagaggtgaacaacaaattccggcgtcccaacaaagacgcc

SEQ ID NO: 722324 - DNA, 115 bp, Homo sapiens
caagctgcagcaagcaaggcagctgaaagagctgctgcagacggagctctctggcttcctggatgcccagaacggatgtggatgctgtggacacatgtcgctgcaggagctagac

SEQ ID NO: 722325 - DNA, 447 bp, Homo sapiens
  misc_feature (7)..(7): n is a, c, g, or t
  misc_feature (14)..(14): n is a, c, g, or t
  misc_feature (445)..(445): n is a, c, g, or t
ctgaagnagctctncaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttcctgaaaagttgagcttaatattacaaaatggcagttcaatggaaaatccagaaagagtacttcttctggattggcagctatgattttaacataaaattatgatagtttggttttnat

SEQ ID NO: 722326 - DNA, 169 bp, Homo sapiens
cagacaagccacatcgcgcagtgtgagagagccactggacgccacgaagggctggatggcatgctacctccctcagtgacagaaacaagagaccgttaaactcatgctgaataagagttccagacacgtccaaaacgataaagccgcagagttagaaccacagcgtctg

SEQ ID NO: 722327 - DNA, 312 bp, Homo sapiens
cttttagagctcgcgagccaactgccccatagcgtgctcgacgcttgcacaggccaacgcctccttggaatcaaaatgagcatagaaggctccgtgagtcagacccgatgccttaatgacctccgcgatgcttgcaccggcgatacccttgctgcggaacaaacgtgatgcttcatgcaggatcttttcgtggcgctctgccgtcttgctagctggatatctcaccaaggaatctccaatagttgaacatgacgcattacatgatgatcgtcatacttgcgcgatagtatgacgaccatcatgttagatgac

SEQ ID NO: 722328 - DNA, 811 bp, Homo sapiens
  misc_feature (219)..(219): n is a, c, g, or t
taacacagagaactcactgccctagtcatagcatgtaggcctcttattctatggtcttgacatatgcatgagttaaatgccttaaagtagacatacatggaaaaacttacattgtttattggagtataaaatattacccaagtttgtgtcaatgagtagaccagtgagctggttttaaggtacgtgggtgtatttgtggagtaacaaggtaaaatatantgtaatatcagtaaaaaatggttaattgatgatgaagcttattcacccaagatgcctttggtgcaatatgatactggaaaagtcgcataatgtgccgtcagttattacagtcagtaaaatgttgtgtttcttttccagtgtagtgtgtaagggaatataaatttccccatgctagatatagtatcgtgcagtcaaagagaattggcccgcaggaggtcgtcaggaaaggaataccgggtcttacccagtcgtaatgatggaaggctgtctgtgaaaagtggctgttgtacttataaggttaacacatttgatgggatatgtaaagtgagagaagagtttggtgcaaccagtagtaggatatatttctgctagaaaatccttataggtgagatggatttgtgcctattagagatattggggattgggcaataaagaaccgaggtggtaaacttaattaagaaggggggaaagcagtatccaagggtggagcctttgtaaaaatttttctaaaaaaaattgatgactgaactgggccgttagatgaaacaacgcggtgaaaaacgcgccagtttggggcacccgggttgaaaag

SEQ ID NO: 722329 - DNA, 121 bp, Homo sapiens
tcgacagaggtgagtggcctcagggggcttcacctctgcctgccctctacagtgcttgcacggctataccgatgttggttgcaaggaagaacacagaaagcatgggccaccctgattttac

SEQ ID NO: 722330 - DNA, 83 bp, Homo sapiens
tgagcgtatataaaaggcgcttgtgaagacagtaaagcagcatacacaaccttgggtttccttcttccattcgatttacccat

SEQ ID NO: 722331 - DNA, 105 bp, Homo sapiens
tcgcacgggttctgtgctctgtcgccccaggcgggcatgtgcagtggccacgcatctccctccacggcaccctctgcctcccaggttcacgtgcttctcccacct

SEQ ID NO: 722332 - DNA, 298 bp, Homo sapiens
tatgtgttggagaatgacatttgataaatagcaaactgggtgtggtgttgcaccgctatactcccagctgttggggaggctgagacagaaggatcacttcagcccaggagattgaggctgcggtgagctatgatcacaccactgcactccaggctgggcaacagagtgagaccctgtcttgaaaataataataggctggtcacagtggctcatcctgtaatcccaacactttgggaggctgaggtgggtggatcgcctgaggtcaggagtttgagaccagcctggccaacatggtgaa

SEQ ID NO: 722333 - DNA, 387 bp, Homo sapiens
ggccaccagcacagacaaacatactaaagaacaaaggcttttaatccacctccttaatggtagggcctgacggggaccctcccttgggaccctgagccccgaagccctcaggcccgggaccaccggcaccctgggacagtccgctgaggatggtgatacacacctgctccagctccttcctctagtgctcaaactcgaacttctcggccaaggtgttgtcagtccagccaacgagatgacctcttgacacttgtccagaaccttcttattgtccgccttgctgatcttgcccttgagcccctcatgctgcacggcgctcttcatgttgaaggcgtaggaactccagcgcgtacttggctgacaccctttcgcgctgcaccttgtcct

SEQ ID NO: 722334 - DNA, 644 bp, Homo sapiens
ggtgcagtgggggggccggggtgccctggtggccctgggatgggtgaaccgcggtggcttccgcggaggtttcggcagtggatccggggcggggtcgcgtgcgtgcgagcggggccggggctgaggctgagtgagcctcgctgtgcaggcgaaggccgcagggataaggcagtggattgccccggtctaaccaagtttggggccgcttggtcagtgggtacctgcaagaatcaaccgtccgctggcagggtagatcatatctcattcctccctgccctatttcaaggaaatccacgagcatcattcggattttctttctcttggggggggcgcctctacttcctaagggcgcattggcaggtggtccttttggaaacgcgatttagtggggccccaataggtttgccacgcacacagcaacggtaacaccgctggttggcctccgtggtcccaaaggcgggcccaaccctcaagagggtttttccaagttggtgcattttctgtggtgtggcttacaatcacggcggcgggagagcgtaaagaaatgtgtgccccacgtggtgccgcgggtccttagggcgggtttggtttccacctggtgtgcgttcgccaagatgtggcaaggggttcgtgccgctaccgcg

SEQ ID NO: 722335 - DNA, 146 bp, Homo sapiens
  misc_feature (116)..(116): n is a, c, g, or t
gtaatgactcccgtggtctgtgtcagatgtgtattggtctggccagcttctccctgttaccataattctgcctctttccataatccgtggttcagtttgactttgtatatcaagtnggggtttttttttttttttttttttttttt

SEQ ID NO: 722336 - DNA, 980 bp, Homo sapiens
  misc_feature (154)..(154): n is a, c, g, or t
ggtaaggaggctcccaggaaccggagctggaaacccggccgaggtccagccagagcccaagagccagagtgaccccgtcgaccatgtcagcgcatgggggagatggagccaacctgcgatcagcgtaagcggcagcacgctcaagacagcaganttgcagtatgccagggaaagccttgtgctgacgtttactctggccagagtctggttgtctggacctagcaggtggctgggacgagttccacgagtgcagacgctggcggtaccgttaagtgggacactctggccagatatttatctgccatgctactgggtccactgtattctataggctgtctggctaatgctgcctcgcacaagatgggaaggctgatcgtcgtgggacagactacagccagccaacaaggtgacacgccagtcccactgccgctcctcctggggtcatgaccgtgtgcctatgccccagtcagggtaactttgctggcatgtggggggctggaccgaacatgtgttccatctagaagctcaaaatcccgatggagggcaatgtcaaggatcagacgggagcttactgcgtcacacaggttatctctcctggctgccgcttcctggcatgacaactaatattgtcgagcagctcggggtgacaccacgtgtgccttgtgggacacttgaagactgggcagcacgtacagactgtatatgtgggacacacgggtgactgtatgaggcctggctggtgctttcctgacttgcatatctcttgcagtatcgggggcctgtgatggccatgtgccaaggctctggcgaatgttgctaaaacgaggacctggcctgtgcagaactttgcactggcccacgatgtcggacgtcaacgccaatctgggatcttctccccttcgaatggccagctactatccgttgggtacaacaattccactggcatgtccgggactccataagttgaacgtgtggcattc

SEQ ID NO: 722337 - DNA, 178 bp, Homo sapiens
ggggcaatgtggcaaaccgcgtgtttacaaaaaatacaaaaattagccaggcatggtggtcatccctgtagtcccagctgtttgggaggcttaggcaggaggatctttagcctaggatgctaaggttgcagtagccaagatggcaccacttgcacatctagcctggcagcagacaaga

SEQ ID NO: 722338 - DNA, 321 bp, Homo sapiens
tgaccttttgcaaggactctgaatttttgcagtgtatttttggatactgtaaaaaaaaaaaaaagaaacaacacacacacacacacacactcatagcagagctgctctgctcgctctaagggcctctttgaggggaaggacagtcccaaaggggcactgcccgggtgacttggggtgggccctgccctctcctcgaggcagccagctacagccagggcccggtccaagggggccccacagcacagtaatcatctatcccagccagggcacaccagcccccgacaggggtctcaaatggcaacgaggggcatcctctaagag

SEQ ID NO: 722339 - DNA, 770 bp, Homo sapiens
  misc_feature (146)..(146): n is a, c, g, or t
  misc_feature (233)..(233): n is a, c, g, or t
  misc_feature (280)..(280): n is a, c, g, or t
  misc_feature (307)..(307): n is a, c, g, or t
  misc_feature (627)..(627): n is a, c, g, or t
ggcggcattggagtcaagatggaggagtacgcgcgagagccttgcccatggcgaattgtggatgactgtggtggggcctttacgatgggtaccattggtggtggtatctttcaaggcaatcaaaggttttcgcaattctccagtgngagtaaaccacagactactgcagggagtttgacagctattaaacaaccagggctccacagttaggaggtagctttgcagtttggggnagggctgttttccatgattgactgtagtatggttcaagtcagaggancaggaagatccctggatatctccatcnacaagtggtgccttaacgggagcctatacgtggcaggcagagagaatggaccagtggccatgggttgggtcagccgcaatgggtggcattctcctagctttgaattgaaggagctggtatcttgttgacaagatttgcctctggcacagtttcccaatggtcctcagtttgcagaatgacccctcccagttgccttcaactcagttaccttgcctcaccttttggagactatcgacaatatcagtaggacttcgtttcctaggattctttaaacagaacgagttgtggttcgagaaggatttgcgagaagatcaagttanagtctgttttgaaaaccataggtgggacagttatggccaataggctataaagagacattaggctttggtctattaaaggaacacgcggggaggggttgaagataataggttttttttccacttgaattgcttggtgtcaaata

SEQ ID NO: 722340 - DNA, 370 bp, Homo sapiens
cctctaagcttcacctaaaacccatcctctatttccaatatgaccattctttacctttactgtactgatttgtatgtagagataaggtctcaccaagttgcccacactgttcttgacttcctgaactcaagagatcctccagtctcggcctcccaaagtgctgggattacaggtgtgagccaccacacctggcctgtcaggacatcttcacctgttcctgtgtccaagatggtattgcataggttgtcttctggggtttaaatagcatatggtttgtcacatttaactatttaatacatcttgagttaagtatagtatatggtataaagaaggggtccactctactgcatatagtaaggcaggtatctca

SEQ ID NO: 722341 - DNA, 292 bp, Homo sapiens
tgaagaaaaagaaagtataaatcagctgggcttggtggcttgatgcctataatcccagcactttgtgtgaggcaaagatgggtggatcacttgagctcaggagatcaagaccagccgtgggcaacgcagctaaatcccgactctacaaagaaaaactacaaaaattagccaggcataggggcacgctgcctgtagtcctagctacctgagaggctgaggcgggaggatggctggagcccaggaggaggaggttgttgtgagctaagatcacactactgcacttcagtctggg

SEQ ID NO: 722342 - DNA, 517 bp, Homo sapiens
  misc_feature (158)..(158): n is a, c, g, or t
  misc_feature (171)..(171): n is a, c, g, or t
ggcggcattggagtcaagatggaggagtacgcgcgagagccttgcccatggcgaattgtggatgactgtggtggggcctttacgatgggtaccccacttgtggggtgggtggggtattctttccacacgccaaattccaaagggggtttttcgcaaantttctttcccagntggggggacgttaaaaaccaacaggaactaacggaggggcgagacgtctttgggaaacccagggcctccaattgtgaaatacaccccaagggggcctttccccaagccaggcttttccaggggcacggcgcttaagcccttttctgtgcgccaaagctttctgcgggcgcgcaaacggcggcggcctttgggttcattattctccccccaattgggaaattctgggggaaacctttgggttaaaggttaattgggggttcttccaaaagggttccaaggaggggcacaacgggaaaagaatccccttgggaaactcccaatcacaatgtggggccttaacgcggag

SEQ ID NO: 722343 - DNA, 261 bp, Homo sapiens
tgcatatccatgacataatagaaaccttctttccaccctcccatttgacatttctttttaggatgtgggtcttcaacagactgacctataactctctctcacaggggaaatatatcatacaactcttgaaagggaaatttccatgtcagctctttcacagagagagtggctctttgaatgggaggaagaggcattttcttatatccttttgtccattctaagggatagtttggggttggtttcttattccattatatttga

SEQ ID NO: 722344 - DNA, 866 bp, Homo sapiens
tgaactgtttgggcctcggggagccttcttgctggctgctgcaaacatggcttgtgcgggagccttgcctgaagctcccttattgctcaaagtctgcccacgtgagtgagcatttcgtgccggcacgaattgaccagcagcatccaggtcgaggcggatcggtggagccctaagagaaatggagtaggctggcacagtctgccgagcaatgctctgcctagaagcgtgtcctgattatatctccgggcttgagaggatagactcaccatgtttatgagcattattactcagctagctactatgggcggaccgtgctccatggagcgtggtctcggatgcctggctggagggggccgtgctgggaatgcgaagacttcggttccccgtggctttctctcgcataagccgcccttcgctccctcaaggtacgattgtttcgacacgaaaggcacatgaaggctaagtctcttgagaaggaagccgtgagaggcgcacaagatttcccagcgtcgtacctagctcccaggcaggcttgcgatccaggaaactctcttgcaaagcttggagcgataccgggagggaacgaacacgtacaaggtggggcctttgggggctccagttggccgagggatgcacaaatgtagcgtatgaaggaaggaaggaaacggctggaggtggcacgcaggccagctgggtgggattgatggcccggagggcgagagggaagggaccacccgcaggaccaaatgcaggggcctctgacctaatgcaagggggcacatggcagaaagtaggtctgtgctggtccctgtccccggagactcctggccctggagccctcaatctggccagcactgagacccgaa

SEQ ID NO: 722345 - DNA, 419 bp, Homo sapiens
ccagaaacctgggcatcactcttgattagttcttctccactgggcacaatttcttccctccattcaccaagtcttgttgattctaatgcttaattgcctctgaaatatgtttatttctccataaccccatttctccttccataacttgagatattatctctcatggagattagtttaataggaaattcttatcttaaaaaaataccttataaatataaactgtattagtccattttcatactgctatgaagaaatacctgagactggataatttataaagaaaaagaggtttaattgactcatagttccacatgcctggggaggcctcacaatcatggaggaagttcagtgaaggaggagaaaggcacatcttacacggcagcaggcaagagaccatgtgcaagggaaatgccctttat

SEQ ID NO: 722346 - DNA, 463 bp, Homo sapiens
gagtgtgatcgtaaaattaagacgtaatgtttcgctctatgtcatcgtatataggataatccagtaagagtggcatgctactcccaacatcaggcattagttctttcaactcatccaaggatggcttcttattcagtagtttcttatatcaagccaaaggaaaagggaggtccagaatggtacaattataaatagctaagccacagataacaccaatcaaatgcaacaaatcactgtcttcaaatgtcttatcagcaacaaccaaatgagcctggaatctacatcactacctaacacatgccgtatgtcggatccaataattccctcatgatgagcaagaaaatattctttgcgcaccccatcctgcatccacagcatcttctccaacaaatataacattgagtggcttcttgtaatctatgttctttgtattcctaaggacttccattgcagcgtaccacaa

SEQ ID NO: 722347 - DNA, 613 bp, Homo sapiens
aagaaggttcacccgcagaagcgcctcaagaattttctttgccgcgcacacatttgagggcccacacgcggcacaccaacaggagcgcggagaagccacaaacgcacagagaaggtggaatgcacttccgccgagcttgtgtggggagagtgaacctggtggagaggcgggcacactctctctctctctgcgtgttctcccctctcccgcttcttgtgagctctcttgcactaatctccacggagaaggagatcttgcgcacccctccacagagaggagaggcacagcacccgcagagggtggcctctgtttgagaagcacagaccacgcacattttgggagaaatttggccctcttcctctcacagggttctgcttggagagcacagctcctctgcacggcaccacagcctggagactaattcccacggcacacacagctgttgggcccacaggagagccacagctcacaggtggctcccctccacccacatgggcacaggctgtgcacaaaaagcccccggcttttttcagcactttgctgctgggcctctcctgggagctacccgtgtggctcttacgtgttttctttgctaaaataaccctagttttta

SEQ ID NO: 722348 - DNA, 120 bp, Homo sapiens
gctgcactatggctggccgccgtgcagactggctgccagtcgattacgcgatacgctcgcgtaccgcgggacatggtacagacgctcgacgaaggtactagatggaccacgatggggccg

SEQ ID NO: 722349 - DNA, 232 bp, Homo sapiens
ggctaaaatagcgagggatatcgcagtattgtgatactttgtatggcacagatggtaactagacttgtggtgatcatttgaaatgtatagaaatatcaaaccactatgttgtgtaacagaaactaacatagcattgtaggtccattatgcttcaaagacaaacaaaatcatacaaaaagagatcaggtttgtggtttcaaaaggcagggaatgagggggaaggggaattgga

SEQ ID NO: 722350 - DNA, 263 bp, Homo sapiens
gaaggtgctggtacctatacacgaatacgggttaataactgtatacaaactagtcatcttccctctctttacttttatgcaccacctgcattctagatactatccatcacactaaataataataaaaaccaaccaccttcaatctgatcattctgggcaggaaactgaatacagttttgaccagatcttcgagcacgcttcatatacacgaacttaactagttctgttggtggtatcagggttttcgagctcgaataccgtaa

SEQ ID NO: 722351 - DNA, 440 bp, Homo sapiens
agtgtatagtctgtatgatagaacatgttatatgtaaaagtagctcacaatgtactagttaaaggcatcttaacaatccctgccagccagtctgagggatagtgcaaaggtgttcatagctagcctgcaaatcgaggtggtcaagcaaaatctccctacagctgccactcaattagagctaatgaaactgcgcccagatgagtaaactagtctatcagaggcctgttttctctctacattatgcagaataatcttgtgcaaggttagaacagatataatgagactttctgagaatagtcgtgagaatttatggatggagggtgggccgcagggaaaatgataaatgcataatttacactgttttttcactggctagtaataatgactataatatcatgaaacattgttttaacaaatgaattattatgcctagtagtata

SEQ ID NO: 722352 - DNA, 571 bp, Homo sapiens
  misc_feature (154)..(154): n is a, c, g, or t
aactggggacgtatcagtcactggttctagtgtggatgagacagtgagatgaaatgctctaattactcaataggatggcagtattttacatacatttaaacggcggtccagttcctggagaattctacttggcaattgttcacctccttgtgtnttcacatcacttaggtttgttggttttggttttggtttggtttttgggtaacctaaaatcttgtgataaagggtagagtggtgaaagtattggaattctgactactctcattaattattccatctaactgggtagtttcatttaaagggataatatgtttaaaaagccaaaccagaagttcatagctagtattgtatttaaaagcctgctcagggcagatatttttatctgaaatttagactttcacattcataacagtgctcttacttaattgcacatatcaatatcacaatattacgcaattaaccatgtcaagattttactgcataaaatttttaggcaagcccagacaaactcatttctctggaggctgaggtaggaggatcactacagctgggaggtcaagctgtgtgaggg

SEQ ID NO: 722353 - DNA, 186 bp, Homo sapiens
acccttcccctaaaaagggaattccctaaatttaacagttctagccattcctgatcatagtctttcataggccccccttgggttgaatgcctttttttgggaaaattcaaacctgaggccccccctgatcttctcccaactaataccatgggctgcccattcgggatgggggaaaattgctcccca

SEQ ID NO: 722354 - DNA, 414 bp, Homo sapiens
  misc_feature (19)..(19): n is a, c, g, or t
  misc_feature (21)..(21): n is a, c, g, or t
  misc_feature (363)..(363): n is a, c, g, or t
  misc_feature (410)..(410): n is a, c, g, or t
gtttgttttgagacggacngnctactgtcatccaggctggagtgcagtggcatgatctcggctcactgcaacccccatctcccaggttcaagcgattctcctgcctcctcctgagtagctgggactacaggtgctcaccaccacacccggctaatttttttgtatttttagtagagacggggtttcaccatgttgaccagggctggtctcgaactcctgacctgggtgatctgcccacccagggcctcccaaagtgctggggattaaaggtgtgagccaccatgcctgggccctatgtgtgttttttaactacttaaaaattattttttgtaaatgattgagtcttctttatggggaaacaantgggccttcagccctttgcggcccttaattgtgattcccggggtttnattt

SEQ ID NO: 722355 - DNA, 290 bp, Homo sapiens
tactactactaaattcgcggccgcgtcgacttgaagcctacttgatcatggtgataagctttttgatgtgctgccagatttggtttgccagtattttattgaggatttttgcattgatgttcattagggatattggcctgaagccttcttttttcgttgttctttctttgccaaggtttggtatcaggatgatgctgacctcataaaatgagttagggcccggggtaggttttttccgtttttatgccaaactgggggttcaccatgttggccaagctggtctcaaactc

SEQ ID NO: 722356 - DNA, 146 bp, Homo sapiens
ctgcttgtcttcacgccactcctgtgtgcatgtgcctcctcggcctgtccatgtcgctggcggcccctgcaggtcggcgcgtgtgtgtttgagtgtgggtgcgttgctgctcctcccacaggggctcctctccagcgtcgccctgc

SEQ ID NO: 722357 - DNA, 975 bp, Homo sapiens
  misc_feature (975)..(975): n is a, c, g, or t
ggatgagagcgatcgctatatcgctccacggtggctgggatggatgtgcaggagatggagcctgtgatgcaggaggagatcttcgggcccatcctgtccatcgtgatcgtggtgagcttggacgaggtgatcgagttcatcaaccggcgggagatgcgcctggccctgttggccttctgcaagagcaggcaggtggtctgaggcgggtgctgacccatgacacagtcgaggcggggagtccgttctgtgtggataactgacgggctttcgatgtcgctatggaacctggccgaggctgccttgtaggtaggagtgggtgccagtgggatgggccggctaccatggccctgttctccttcgacagcttctcccaccatcgtgcctgcctcctgcgctgccccggggatggagacgctcaccgccctcgcgcttaaaccttgcgggatctgcgcgcgccgtctgaggggtggctggctagggtggcccagtgggaggtgccgaatggcttgttggttgctgcggctgcttctgatgcctcgttgcccacaggggcccaggctcgtcagagcaccatgatcgtgcctgtccgcctgcggtcttggtgtgagactgggggcctgggctccctgggcccgaggaggctgccacggatgggcaagggttcagagggacccctctgagcatgggcctgtctcctcccttgctggggttgtcctctcacgtgcgtgaggctcctccctcagcgctcgcaagcatgaaagccgaggtgggatgcatggggaaatagtggagtgattgtacccccctggcccgataacgggcagcgaattccggagaaaggagagaacggccctttggaggtccgcgctccggggccggtgccgagggccggattggtcgggccaggaactggtcagcaaccgccttggttcatgcttttcgggaaaaaatcgcacccgggggggggaccgtcan

SEQ ID NO: 722358 - DNA, 126 bp, Homo sapiens
tgtgattggggatgaaccagagtccttaggtgaatgagtgcttggcattgacgagttcaggcacctgacttagggtactgatttggaccgtgactttttgtttgagatagagtttcgctcttgttg

SEQ ID NO: 722359 - DNA, 911 bp, Homo sapiens
  misc_feature (20)..(20): n is a, c, g, or t
  misc_feature (61)..(61): n is a, c, g, or t
  misc_feature (63)..(63): n is a, c, g, or t
  misc_feature (71)..(71): n is a, c, g, or t
  misc_feature (73)..(73): n is a, c, g, or t
  misc_feature (79)..(79): n is a, c, g, or t
  misc_feature (93)..(93): n is a, c, g, or t
  misc_feature (143)..(143): n is a, c, g, or t
  misc_feature (174)..(174): n is a, c, g, or t
  misc_feature (197)..(197): n is a, c, g, or t
  misc_feature (223)..(227): n is a, c, g, or t
  misc_feature (229)..(229): n is a, c, g, or t
  misc_feature (246)..(246): n is a, c, g, or t
  misc_feature (256)..(256): n is a, c, g, or t
  misc_feature (279)..(279): n is a, c, g, or t
  misc_feature (288)..(288): n is a, c, g, or t
  misc_feature (319)..(319): n is a, c, g, or t
  misc_feature (330)..(330): n is a, c, g, or t
  misc_feature (332)..(333): n is a, c, g, or t
  misc_feature (336)..(336): n is a, c, g, or t
  misc_feature (342)..(343): n is a, c, g, or t
  misc_feature (346)..(346): n is a, c, g, or t
  misc_feature (349)..(349): n is a, c, g, or t
  misc_feature (366)..(366): n is a, c, g, or t
  misc_feature (371)..(371): n is a, c, g, or t
  misc_feature (431)..(431): n is a, c, g, or t
  misc_feature (447)..(447): n is a, c, g, or t
  misc_feature (464)..(464): n is a, c, g, or t
  misc_feature (485)..(485): n is a, c, g, or t
  misc_feature (494)..(494): n is a, c, g, or t
  misc_feature (500)..(501): n is a, c, g, or t
  misc_feature (525)..(525): n is a, c, g, or t
  misc_feature (535)..(535): n is a, c, g, or t
  misc_feature (554)..(554): n is a, c, g, or t
  misc_feature (566)..(566): n is a, c, g, or t
  misc_feature (570)..(570): n is a, c, g, or t
  misc_feature (583)..(583): n is a, c, g, or t
  misc_feature (593)..(593): n is a, c, g, or t
  misc_feature (595)..(595): n is a, c, g, or t
  misc_feature (600)..(601): n is a, c, g, or t
  misc_feature (603)..(603): n is a, c, g, or t
  misc_feature (624)..(624): n is a, c, g, or t
  misc_feature (652)..(652): n is a, c, g, or t
  misc_feature (658)..(658): n is a, c, g, or t
  misc_feature (701)..(701): n is a, c, g, or t
  misc_feature (704)..(705): n is a, c, g, or t
  misc_feature (727)..(727): n is a, c, g, or t
  misc_feature (734)..(734): n is a, c, g, or t
  misc_feature (740)..(741): n is a, c, g, or t
  misc_feature (743)..(744): n is a, c, g, or t
  misc_feature (755)..(755): n is a, c, g, or t
  misc_feature (765)..(765): n is a, c, g, or t
  misc_feature (772)..(772): n is a, c, g, or t
  misc_feature (786)..(786): n is a, c, g, or t
  misc_feature (812)..(812): n is a, c, g, or t
  misc_feature (824)..(824): n is a, c, g, or t
  misc_feature (826)..(826): n is a, c, g, or t
  misc_feature (850)..(850): n is a, c, g, or t
  misc_feature (892)..(892): n is a, c, g, or t
tgggatagaaatggcagtgnagtgtcctatgaacgaggcgaggaatgggcatggcgctgcngnaccacccngnaacctntgtgcttccaaacnacactatgtgtggtggagacaaagggtgtcgcggtttgcttttaattgcncacagttccttgggcttctcatttgtttttnaagttgtcagtttcttcaaatcnctttccaacccccccccccccccccnnnnnanggcacttaaccaatgtngcatttccanatttacaccaacaaaaaaaattnacaagacanaatagcaaacaatcttgacatttagtaatancaataaaacangnncanccattnnaanttncccgtacaaaccatcanaacanaactttattcacattaaaaaaaccacctttaatttgatttgacctacatatcccccattncatttcacccatttcncaaaccccccaccacgncacccacaccttcaccagacnacagaatcnataagnnattagatctaacacctaaatagancttagaaagncctctcccaaacatttccncacttccctganaatnccccaaaaaacanaaaaaaaacncnccccnngngggccttccccttcccttccncatttcaatcatcaaatccgccagacgncctttncacctcaatctgaacaaggttagaaagagagagttcctctgtnggnnatcttgatgctacacccatgantttggtntttttnntnntgttctgctcnaaaaaaaggncgtttantggaaaaaaaaacnacaaaatttgtggtcgattcagccanactgtgttgagnancagtagagctggaagtgactcggnatcaaataggatctcatagcatgagggctgcaatacatctgntgcatcaagtcttctgtgg

SEQ ID NO: 722360 - DNA, 297 bp, Homo sapiens
cacggagagagcggatatagcgggtcatctcagttcctgatggtcagagtgaatagccgagaggctcctgcccggcccccataggtgatcagagcccccaggggttactgcggcgaggactgtgccgtgggaacagccacatgggctggagagccctaaagctggacctgaggtgaccacatctggctgggcaatggcccgagcagcgtagggagagctagggaacgcaccagccttgcccaaccgtccttcccccaacaccatgtccgaggtgagggtctgggagcccagtcaacc

SEQ ID NO: 722361 - DNA, 320 bp, Homo sapiens
gtccacagccacgtaaagctggagctccacgctcctgtgtgtacctgtcatggctctacttagaccgggacgacgtgaccctggagcgtatcagccgctgcttcctgagaccaatcgcaagagaagagggagcacgcccaagaagctgataatgctgcagaacctgcgcggtgggcgcctctgccttcgtgacatctggaaaccagagcgtgaataactgggagagtgggctccaggccatggagtgtgccttccacctgaaggagagtgtcacctaccggctcctggagctggactcacctggccatggagccggggtg

SEQ ID NO: 722362 - DNA, 546 bp, Homo sapiens
ttctcccagcactttggtcatgctgaggcaggcagatcacttgagtccaggagtttgagaccagaatgcacaacatggcaaaaccccacctctacaaaaaataaaaaaaatagctgggtgtggtggtgcacagctactggtagtcccagctactcaggaggctgaggtggtaggatcaccagagcctagggggctgcagtgagccatgatcacaccactgcattcctgagcaacagagtgagacccttcctcaaaaaaagtgaaaaagcatgtttagaagaggaaatcaaggatgtagcacggcgacctcttgccaaagagattagcacagctagaaggaagccaggtgcttctcctcaaaacagtgaaagaaagaccgcaaagccattttaaagacctttgaggcttccccgctgttacaggcccagaggcctatgagggcagggatgagcccaagacaccttccacagactccctccccagggccacctcaggaccctgctaaccagattctggtgaggtgcttctcagctgccccagctgtgg

SEQ ID NO: 722363 - DNA, 906 bp, Homo sapiens
cttctgaagtttatgtaacaagtaaaatctttaataaataagctagctttaaaattattggtaaagtaatattagacatgtcttaaaaattgccagcatgcatttttgtttgcatttattaatcaagcaatttcatgcttatccctgtcaaataccataaggtgtcaaaatttgccatggagttacaaaactgtaatagaatgatctttgcttgtataatctttaataaataagacattgatattggtttaataaaaatagtcacatcttgaatttagtgagattactgtaacttctaattttgtggttttggtggtctagtccacaggcagtaagatttagtttgagaatgaactgttataatctttgtttcaaaggtaaactataaactatgttcctctcaacgtctgttcagcctgtgcccaggattgaacaagaacagtttggaggttagaagcaagatggagtcaattaggtcagatctttttcactgtctcagttataattttgcaatggcagttccataactttaaatgatgactattgcagttttcataaataatctaggtaaacaattcctttttaacaaggtgaacaattgtcatctaattcaatgcttatttaaagcattatgtcataagacaagtttaaacaggaaccaggaaatcagagagatgtacagacaggtactcacaactaacgaggctaacgagggtccttccggtcaggaaagcttaacagagcaaatcatttcatattgagaacagatcttgtatggtacattcagaactaaaataaaatgaattggtcaagaacgatggatgttccaaacaaaccagaaagtccagctatccattaacatgtcgctatcaaaccaagaaacacgcaacacacagcaaaaacagg

SEQ ID NO: 722364 - DNA, 231 bp, Homo sapiens
taacaaaaagtggtgttggttgggcctccataagtaaattccaagcagtgaggatttggtggtgcctgaaatggccgagggcacagggagtgagctgtatgtgtagaggaattgggagagcgagataaaagtccagggtgtcaaccccttaaaacttgggtgccctgtacattttaatactatctccactctaacggcctttaacagggcttcccggattttcacgggcct

SEQ ID NO: 722365 - DNA, 809 bp, Homo sapiens
gtgcgcggccccgaactcctgccccattctgggtcgcgcccgctctcccgccttgactgcttggggaggggtatctaccgtttcgtctggccccgcccctgacggttccggggcccctgagaagcttagtcccttctttgtcaagccaggacccgaccacggtctatatcatagggtcccaaaccacttatgagacacaacaaccccgagattggtccgaatgacctcgtgagattcgtcgctggctcgttgcactctagtgctgtcgctgtgcagacctggcttagaaggagcccataatggctgagggggtcacttgcgcagaactgagtccggtccgctaggtcctgtcttactacttccaggccaggccccccttaaactgtgttcccccaggaaaggcgggcgcttgctacatgggaaccagtgagccttgccttgcggaaacttagtggctggggccggggggggcttccggtaccatgggggcagcagggaggcgggtccagtacagaggaaccaccgcctacttcggggcccaaggggcacggcgaaggaaggaaggcccggggattgaccttggacggagagggggcacagggaaggaacctaaggcgcccgggcataaaaccgcggccgtgggttcgcgaccgggggtcccccgtggggattgatgagggggcggtcccccgtttgcacgcgaagatgccttaccatttggcgggccttgcgtgtggaacggccctggatggggggaacactcacgaggaaggcaaaagggcagtgggaaacaacacgatgggagatgc

SEQ ID NO: 722366 - DNA, 1536 bp, Homo sapiens
  misc_feature (150)..(150): n is a, c, g, or t
  misc_feature (198)..(198): n is a, c, g, or t
  misc_feature (322)..(322): n is a, c, g, or t
gacgaggaatcactagacggggagagatagtcatggagtaccaaatatcagtgtctacgtattcgtgtgctcctttgttaggcctctcgtccctaacaacatcatggccaagcagatcacctgcgagtccaaaccatgggacaagccaanggaagtgcatcagaacacggacatcttgcgcaccacgaacactcgtcnccagagaagctctgcgtcgctaagaacgcgattgtgaggttgtaggcaacatcatcagtactggtagacatcagaagcattatatgtaatagaagtcctcataatacataagacataccacagnacccatggcaatgaatatacctctagtaatgattgtatctgaatctagctcggcagtgcaagttgacgccatcatacagcgtacaaacggcgtttacgacgtacacacgatgtatatagcactgaatcacagtacaacgtaaggatacgcaggacagatttgggtcacgcatgccatgcatattgcttggcttccatcaaattactggggtttgacctagaaaacacacccctttgacgtacacaatggagctcgtttctacttctccgtgaattgcgcacagggatacttgatcgctctcagggtgaagatctacctagttctgtggattgagaccaaccgcaataatcgatcgtgcagacagtgcttcacgcatgtgccagagaatattatttaccatgggggaccacggaatttcatttgtaacaagaagcctcctgttcggataacttcaccttgggcatgtaaattgaacaaggccctttgcgtagggataatgtaccttagtgggacataacttgggatattgaaacattttgaaaacaaaagagcttacttgaaaaaggaattatagggttgtaacataggaaaaaggtgtaatggttttggataacggaacgcgatggaaaaccttcgcgcatattacactggacaaaagggcaccacctattttcctttggtctaaattgggtcccccggtgtcctcggttgccatgggaataaccatggggacaccatgtggcaacgaacaccttatgcaaggctcggttcgaaggacaacggaacacgtggggctcgtaacggaatgaggtaggggaatgaggcatatagtcgtggtgggcagacacagcgacccattgaggattgaagagagcaaacccactgtggggactttccagacggggttttcatagcggactataacacattggatttgtaccagagaccaaaacataattaaatccaaggaatcgtcaaacgcaaacaacctcatgtcgttgcttttccgcccaacagatttgttgaggccattgtgcgagttggtggagttaaccattgtttgttggtcataactcaacactaggggttttaacgcacccatatatatggcactgccccatcacatttgtccatcacaacgagatcacgggagagagaaaggtagtagagggagggcggacacacgggactataccccgaagaaaacaagcaca

SEQ ID NO: 722367 - DNA, 969 bp, Homo sapiens
tgtggtggcacatgcctgtagctccagccatttgggaggctgaggtatgataattgcctgaaccattgaggaggttgcgaggtgaccagtgcactccagcctgtgtgagcagagcgagactctggcctcactacagatgagaatgcataaggagttggggcctgttaagataacttttctggaggggcttacgggaaaggcattcaagcagaacggaccacttccaggaggtggtctagggcagatgagataccgtgaagctgctttggaacttgtaccgtcctaccactggtggctgcctcgttccctgtctgcggctcattcggtccatagtccatccccaggcctggagatgtaccggactcagaacagaccttcgaatacacttcggcatcttagggactggtcagatgctgtgcttatcatgcacctgtcctcatttcctggtccgataacttcattgccataagtgctcgtagcaagtgtgccaagttgtcattagctggcctagaaggttcctttagcactgttatgattagggccatttggacaggcgctctgtatgtgtattcggttttccaagtggacatcagcatggtggcatcctgattttcgaccaggtcctgtaaaaagcctttcggtgctaccttgctcggtctccgtcacagacttgctatagcttggcctctttcgggacttggcgttcccgagacggtgcgcaatgtgcaggcaccttgctgcctggctcacgtgggtcgaaccagaagcggttggagcccggtctgccggtcctggtccggtcagccgaggagggcttctcgatgtcgtacccttcgtgttggccggcgcccccagtgtctggcgtcgcgtctctttttcacggcttgccaagcctaagtgggggggggccacaccctgctctcctctccttctgcccgtcctttctacctcctcctcgctctggaggtg

SEQ ID NO: 722368 - DNA, 281 bp, Homo sapiens
aagcaccacatcctccattgctgagatctatgagacagagttgatggacatcgagaaggccattgcccactacgagcagtctgcagactactacaaagaccaggagtccaacaactcagccaacaagtgcctgctgaagacggctgcctaagttgcgctgccggagcagtaccacaagaccatcgatacctacgaacgggcagaaccaacgccatgcacagtcctttccctaagtaccatgtccgcggctaacagcggaagctgcatccatgctactcttg

SEQ ID NO: 722369 - DNA, 806 bp, Homo sapiens
  misc_feature (173)..(173): n is a, c, g, or t
  misc_feature (193)..(193): n is a, c, g, or t
  misc_feature (270)..(270): n is a, c, g, or t
  misc_feature (297)..(297): n is a, c, g, or t
  misc_feature (302)..(302): n is a, c, g, or t
  misc_feature (369)..(369): n is a, c, g, or t
  misc_feature (371)..(371): n is a, c, g, or t
  misc_feature (377)..(377): n is a, c, g, or t
  misc_feature (417)..(417): n is a, c, g, or t
  misc_feature (445)..(445): n is a, c, g, or t
  misc_feature (495)..(495): n is a, c, g, or t
  misc_feature (498)..(498): n is a, c, g, or t
  misc_feature (513)..(513): n is a, c, g, or t
  misc_feature (534)..(534): n is a, c, g, or t
  misc_feature (568)..(569): n is a, c, g, or t
  misc_feature (577)..(577): n is a, c, g, or t
  misc_feature (581)..(581): n is a, c, g, or t
  misc_feature (593)..(593): n is a, c, g, or t
  misc_feature (596)..(596): n is a, c, g, or t
  misc_feature (599)..(600): n is a, c, g, or t
  misc_feature (628)..(628): n is a, c, g, or t
agcggctaggtaatttcatgcttaaaaagatgcgcctaggctccctcttggtggctggatttctttttcttcgcccgtggtggccatggttcttaatagggccaccggaatcatggtttctttcttttttttttttttggagatggagtctcgccctgtgacccaggctggantgcagtggcacgatctcggntcactgcaacctctgcctcctgggttcacgccattctcctgtctcagcctcctgagtagctgggactacaggtgaantgccaccacgcccgcgtgattttggtnttttntagtagagatggggtttcaccataggggtcaggcgtgttctcgaactcctgacctcaggtgatccancntgcctnggcctcccaaagtgctaggattacaggtgtgagccaccanacccggccccagagtaagggtttcttgnactttctgtagcccttgttccttagtctgctgtgatatttatgttgaccnttnatcattttctattcngaacccctcttagcatttaangtgaaatctaagaaattagaagtagaagggcttnnatggtttngacncctttgaaattnttnttnnataatttttccagagcaaaaaagcaaanacgctcaataagactaaacaaaacaaattatagtgtcatcatttaatgtccaagggtctattctacctgtagaaatgtttcaaaccctagatattttgagctgaaaatcagttctggaaaaggtaacatggtttttcaccgaaaggaatcaataaagacgtcttaataactaatgtga

SEQ ID NO: 722370 - DNA, 395 bp, Homo sapiens
  misc_feature (149)..(149): n is a, c, g, or t
  misc_feature (217)..(217): n is a, c, g, or t
  misc_feature (319)..(319): n is a, c, g, or t
  misc_feature (370)..(370): n is a, c, g, or t
tgtcaatctgtaacttcgatattgttttattccgggtccatagcgaggacttctcatgctaagctaaaccctttttttcggaacttttcgtttagtaattgtcgctaaagggtaaaacgatatacaaacacaaaccaccaacccaaaangaacttagaaaatgtaacttttgtgtaagtggataaggaagtcaatatttttttaattttagtttgtntgacaatttcctaaggcacccgaaattttctacacagactttcctacctttcttttcataattcagtcgtcgtctctttcgtaataagccccccaccctccngcaggtgtttcgaagttctattgcgaaccaccagacttcgcgcggttaaangtcaacaacgacgagacggcacagt

SEQ ID NO: 722371 - DNA, 134 bp, Homo sapiens
cgggatcggggcctcgttgggtctgggcctcctcctccaggtcttcttcaggatgttcaccgtccggctcacgtttggacctgagctcctgcggggcagctgtggaatccagcgtgtcctccaacgtctgtttt

SEQ ID NO: 722372 - DNA, 617 bp, Homo sapiens
ggcacgagattgttgagagcacacacgagcctgtgctctggcaacaatctgaattatatacttcctggagaacacagggcctggagaaccatagggtttgcccggcgcatttatgaagactctgaagcccatttgcaattgcagggcttctatgaagaagtggccaacccactggtgaccggtgtggagataggagtaccccgagaacgctattctggaccttacaccagaacacttaccagcacttctaccaaggctctgagaacgtggtggccgcgcgcctgtgggaccaagacatgaacaggtttaaagcagatagtgaaaggccatggggccaccaacgaactgacctttacagaggagagggacactgaaggagaaggagaaaggcctgcacgagccggactacatcttcgggaattacattgagcgcgtctgtgcctatcttaccattgagcacatgctgtagaagcgcaagaacgcccatgtggaggaggagaaccttacaggccggccctgtacctgtgcctcaaggtcactctgtgactccactgagctcaataggggtgaccaagcctgaggacaacgcggattagagggccattgtcgcgcctggg

SEQ ID NO: 722373 - DNA, 272 bp, Homo sapiens
tcgtgatccgattcgccactgtgtcgatttgagtgagctcaatctcatcgacgatggtctccccgatcgccaccacgtgggtacggccaccgggatctcgcagagccacattgcgtgcgctcaaccccacgatctcccaaccaggcagaccaggccgagacaccgaatgtggtgacagtgctttcacgtcgctcggtgaatgactgttcgcgggtacctcccgacgcaaatgtacggcctccggatcccggggggtcaattgccgatgaagc

SEQ ID NO: 722374 - DNA, 632 bp, Homo sapiens
ctcctgagctggagcctgggccgaggcttcctgcgggccgcggtggcgtgctgtgtgccggggctgtccgcgctgcctgctcccggtggctggcaggagtgtccggggcccgaggtgcagtgtgcctgccatccctgatgtctgctgcctgcactgtgccggggcccagtgcctgctgcctgctgctggcagcgctcgcctggttctcgagtgccctgctgcgggcgagagtgagtgagtgagcagcatgtggagcctgacgtgtggcctgcttgcctgagtgactgtgggctggactgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggcagtatctatgcttgcgcagaacagacaggaatttgctgttgctggca

SEQ ID NO: 722375 - DNA, 982 bp, Homo sapiens
  misc_feature (104)..(104): n is a, c, g, or t
attagcagtaactgcagtagagttactagttgaacagtggcctgaagcgcgtacacaccgccgtcaccctcctcaagtatacttcaaggacatttaactaaaanccctacgcatttatatagaggagacaagtcgtaacatggtaagtgtactggaaagtgcactgtggacgaagccagagtgtagggttaacgccaaagcacccagaattacacttaggagatttcaatcttaacttgaccgctctgagctaaacctagaccccaaagccgctgccaccttactaccagacaagccttgagaccaaagccatttacccaaataaagtataggcgatagaaatggagacctggcgcagtagatatagtagcgcaagggaacgatgagacacattatacacgctaagacatcatatacgtcataggtagcgtaacccctagtacctgtctgctagtaagtgaatgtagctagaacataacttggcgaggagaggcgaagctaaaaccgccgaaaccagacagaactaccgtaagaacggctaaaagagcgacacccgtctatgtcgcagaatagtgggaagatgcataggtagaggcgacaaactacgagcctggtgatagctggttgtccaagatagaatcttagggcaagtttaagattgccaggagaacctctagatcccctgtcacattgtaactgttagtcgaaagaggacaggtcttggcggtaggaaaagctgtcgaggagtaaaatttatcaccagtgtgtggctgaccagaggcaccaattagaagcgtcaggtcaaaccatactaaaatccaatttaatgatctgtaccatggcaattacttaaaagaagggtactaagaaaatcgcggaaacgtggtaaagagtggcaagagcatctcaccagatatacgtgccggctgcgggaaaaagacaacacgcgaaaccatagggacaggccacaaacaacgtacaa

SEQ ID NO: 722376 - DNA, 661 bp, Homo sapiens
  misc_feature (238)..(238): n is a, c, g, or t
taaggttcaattactttctggtattttggggaggggggtttaatgggtattagaaaaacaggtattggaaagaactaaataatcaaggccgggaagctcaagggaaatatggtaggtggcactccccgtgggggagtggaagaggtggattcccaacatgtgcgtgctcgtgcaaatgtgccctgtgccaaaggagggaaagttcgacagccgcggcatgcccttcgcagttagccanacagggtgattccgggggtcagcagagggtcagttctccatacccggtacctccgtgtgtaacgtggcagcagaaagtgaagccaagagcaccatcgtggttctcgtgcgtgactctcttgtggcatatgggtgggcagcgggcagcctcttccaacgagggcgtgcatccctgtggtgggacggacctcttggcgtgctagcaattgaaccaccacgcgctgcggccagggcgcacatgcccagtccggcccctgcgtggggaccccgctccaagcggtccggtccggggacgtgtcccttcgggaccaggaaggcgtccccaagtgtgcagccgcgaggcattgggatcgaagcgtcctcccgtggggccccgggggtgcccacgtccggagaacaagcgcgatgtccaggcgccccggtg

SEQ ID NO: 722377 - DNA, 905 bp, Homo sapiens
gaattctctttcccatcttgcaagatggcgggtgatgaagtggagatggccagatactaaaagagaagaagccgaagccgagaaggttgatgctggtggcgaggtgaaaaagggtaacctcaaagctaagaaagcccaatgaaggggaagccccattgcagccgcaaacctgtgcttgtcagaggaattggcaggtagttcccgagtctgccatgtgattccagagaaggccatgtacaagaggaagtactcatgccgctaaatccaaggttgaagagaaaaagaaggagaaggttctcgcgaatgttacaaaaccagtgggtggtgacaagatcggtggtacccgggtggttacaacttcgcaaaatgccgtagatataatcctacgtgaagatgtgcctgcgaaagctgttgagccagggtagaaaacccttcagtcagcatgtgagagaacgtgtgagcagcattacccgccgggagcattctgatcatcctcaatgtaccgcacaggggtgagaggctggtgttacatgaagccggtggctagtggctaataacttgtgactgactctggtcctcaatcgggtctctagcgaggagccccagaaatttgcattgcaatacatcaagatcgatgtcggatgtcataatccgaaacatcttctgatgctgacgtgaagaagaagaagtgcggacgcaagacaccagtaggtgaatttcgacctgaaagaaattgccaaacggggggagatgaccaaagtggggccggttgccaatcaggaactcgccgaccggacggggcggaagtacacacagggtgtggacacccgccacaaaaaaaagggcggcggaaatggggcaaaaaacactcggcacaggaagtgatacaccacgtatataagaaa

SEQ ID NO: 722378 - DNA, 314 bp, Homo sapiens
  misc_feature (72)..(72): n is a, c, g, or t
  misc_feature (113)..(113): n is a, c, g, or t
  misc_feature (251)..(251): n is a, c, g, or t
ggcacgagcgagcatcctggcttatccattggtgatgttgcaaagaaactaggagagatgtggacaacactncagcagatgacaagcagccctatgagaagaaagctgccaantgaaggagaagtatgagaaggatattgctgcctacagagctaaaggaaaacctgatgcagcgaaaaagggggtggtcaaggctgaaaagagcaagaaaaagaaggaagaggaagatgatgaggaggatgaagaggatnaggaagaggaggaagaagaggaagacgagatgaagaagaagatgatgatgatgaataagttgg

SEQ ID NO: 722379 - DNA, 156 bp, Homo sapiens
catcgctatagcatcctaaccaggatcatgctccttcattaacgcagcacgtggaagctacccttctgtccatgggatgtgagtccgtctcccttcacatggtcgctcagctgagatcagtatctgggagagcgttccccctatctgatactccca

SEQ ID NO: 722380 - DNA, 801 bp, Homo sapiens
tcctaggtccccacccggcgcgctgggactcgcccgcctacccgtactagtacaccccctgcgcctcgccgtggacaacggggtagagggcatatgtggtgcgtggtgtgccccagcctatgttccccctgccgtgcactagtgctgctgtgctgtgctctgctgcccgaacctgaaagtcctggtgactgtgggtgatgtgtggccctgatgctgccatgctgtgcctgtgtgctgtgtgacgtctacaagtgatgctggtgttccctgtgtccctgcatgtgctgtgcctggcatgtgtgtagtgcatctgatgatctagcatcaccttccccagcctgatgtagctgtagaatgactgcaggcatgcagctaggactgatgctgctcagcagccctgcctggcgtgtacctgagtggactccaacgaagacagaagacattggcacgaaacgcgtgtgtttcgttcgccatgtgctgtcctagggccttgtacctgctgtggccttaggctccctagctctactgtgttccagtccccagatggcgtgcctgtcagggttttgggaatgttcgatgttcctcaggcagaccacattgagtggatgcccatgtggactggcttgtgacagcacgcgtagggctgctgtgccggcagggacgctaggcgtaggcgatgcctgtggtggacgtttgcccaagaggagaccatcaggtgaagttcatccacgaccagatctacccaaacccaatacagaggttcttccacgtgtacgggagatttgcggacatggctgacgg

SEQ ID NO: 722381 - DNA, 628 bp, Homo sapiens
agcggatgaaattattagccaaaatgttggtgtagggtttagtgttctctgtctttttctgaagggccccgtccttccagaaatgtctgttattctaataatgaaaggaagattgtcattcacttaatatagatacatgtattagcgatataagagctatgaagggttccagccttcttttaacatgataagcagggtgtccgaaatttgaatcgcttgttctggtgactgacattcggactggataaccctatgcccttctatactacactgtcgtcccatcagttctctgcttgtaaccctcgtgacgcctgtaggaatgatgcgtgcacgactgggcccactcgtgtcgacatgaccttcctatggatgaacattattgaagcattttaccctgggtcgtactgtcctaagtaatacagcaaggagttaatacaccttaccttgagtgcttgctacttcattggcttatctgatcggaccttgtattcaaacagtagttggtagcatgtctgatggcagaggataatgagtacatatatcctcagtaagtgcattgtttgagtaaacgatccaacagtactagtcttggggactaatagttgcggggaagaaatggtatgactca

SEQ ID NO: 722382 - DNA, 460 bp, Homo sapiens
  misc_feature (1)..(1): n is a, c, g, or t
  misc_feature (39)..(39): n is a, c, g, or t
  misc_feature (107)..(107): n is a, c, g, or t
  misc_feature (217)..(217): n is a, c, g, or t
ngaccaaatatggcataaatttcctgctctcacacctcngatctcgttcccttaaaaaaaatgaattattatctaggcgtcacctctttcttgctgtaactttatgngctcttttcctctgctttgttctcagtccagattatttcacgtatatgttatgagagtggctatcttgagggacaaaagttgacttaaatgattttaaacttaaccgtgncaaacgttccatcactaaaaaaattaagtcaaggttttggatggatcattattgcaaataggcttcttctttttttccccttctctccccacccccagatggctattttaactgtaaattagacttcaaattttagatatgtctctttttcttactgtcatgtcctttcaccattgaaagaaatttaatttccaatctcttttgtttgtatgtcctccatctatgcaaaacaaaaaattgaag

SEQ ID NO: 722383 - DNA, 448 bp, Homo sapiens
  misc_feature (396)..(396): n is a, c, g, or t
  misc_feature (399)..(399): n is a, c, g, or t
  misc_feature (409)..(409): n is a, c, g, or t
  misc_feature (416)..(416): n is a, c, g, or t
  misc_feature (441)..(441): n is a, c, g, or t
acatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatccccgggcaaccactttaaaaaaaaaattaggttcagggggtacatgtgcaggtaaactcgtggacaagggggtttgttatacagattatttagtgacccgggtactaaggcctagtacccaatagttacttttctgggtcctgtnccntttcccaccntccaccntcaggtagggccccgtatgttattnccttgtg

SEQ ID NO: 722384 - DNA, 952 bp, Homo sapiens
ggcgacagaggcccgttagtttatctcagactcggtctatgttcgctgagtctaaaaagggaccgcggatggaccttgtgaggtgaccatagccgccgaggacacataagtgactgcgcactgatgtggccacagttcgctaagaaggttgccatcgggacgcggtgtgttctagggctttcgcttccgggcttagtgcggctcgcagaagcgtaaaccgagtaacttgagtcgcctcttcacggtttaccttttcccagtgccagagtgcgcctacggttggggtcctcgctcaggcacatgagacccgacacgcgagcttggcggcttcccctgggatcgagggacgcgcactgccagaggagacgaaaggaacccgggtcggaccatatcggaaccactgaccattgcccatggcggccctaggccctagccagtcagaatgtcgactgaatacgtcgcttacgagttcctaagaatactaaccaaaacaatattacatcatggcttataatgcagaccgacaaggtcgactttgctacagtggaatcaggctcaggctaggtagccgggacttgagacaacactgacaaatctaccaagaggaggcagatgcccggagtcgcggcgcgtgcacgtgagttcacccgcgagcttcgggacgaggctccgaggacagaccgtaacggcattcgtcctcaagggaagttccggcaccggaggacccagcctcgtggctgctccgggtcaacggtaactcaggcaggcagtacacgggcatcaagaagggaggcgtagcaggacgatcacgtcctacttcatgttttcaccagttgccccgacgcgggacttcagaggccttcccacgtgcacacctgggtacaatctcaacaccgcttggtccggcttccgcacgctaattggcgcagaggctgaggaagactggaaaagg

SEQ ID NO: 722385 - DNA, 225 bp, Homo sapiens
gaaaacgtcccgcttgaaatctcgtaggtttcgtcgtcattttcttctaacctctcttggttttgtatggctgaatccaccttctccagcccacatagttggatcatatcggcaaccatttcacctggtggtttttgattgttgtcgatataattttcaatcatcttcgaaatattctggtgcccgaaaatcgcaccaacgttatgacaccattcgcgacctttg

SEQ ID NO: 722386 - DNA, 658 bp, Homo sapiens
ggtttcctgcttcatcagtgcttggacggaacccggacgctcgttccccaccccggaccggacgcccatagccagccctccgtcacctcttcacctgcaccctcgtgacatgcccctaaggcacccacggccgccgcagtccagcggccgacgcagccaaccgcacgccgccgaccgccgtcgtccgtataggtcagccgcaccatgcaccgaaccagacagtttccagaccatcgccagggttgcgccccagaaaaacttagccgaacacaagtgcacatccaagcagggccgctggcacaaattctaaacccgcccaggagtcaaacccatgagaaggacttcatacaggccatccatacgttttaccctgctccatttgtcttactacctttgaccgcagcatgacatatggctattgacatacaaccttgtccacaccattacgttctcgttcaccgcaaaatcatcaattgctggacgcagtggcaaacatttgcttgagaaaacaccgtgcactgacacgggccatgcacagaaaacccacacggcagggatggccccgacattccttcccgttcagggaactcgctcacaggacaaccccagaaccgtggtgcatagcactcgggacagcacgcgggcgtgacaagtggca

SEQ ID NO: 722387 - DNA, 139 bp, Homo sapiens
cagcacggtacttagctctcagccctcttgcttggctgagagagctgcttcaccacagaatgcctcttcctagggcaagtatgtcagtgctcatcatgtgagagtgagcagtgctcgagcatattaggtgatgatgata

SEQ ID NO: 722388 - DNA, 384 bp, Homo sapiens
tcagggtatactacataagatatcatgccatctgtaaacatagataattgtatttagtctttagtgcttggattctgtttatatactataacctgtctgattgctctggctaggtataccagtgctatgtagaagggaagtgacaagagtgggtattcttgccttgcttctgatcttaaaggaaaagttttacagtttttcaccattggcatgatgtggggctgtaggcttttcacatatggcctttattatgtggatgtcattccctttttattttaccttttgtgtagagtgtttttatgatgaaagttttaggagtttcgcaaaatgccttttctgcatcaattgagatgatcacataggtttaggcaccaatcacagtga

SEQ ID NO: 722389 - DNA, 426 bp, Homo sapiens
  misc_feature (17)..(17): n is a, c, g, or t
caatatctattaaatanaactgtatctttgactcactattcccatctctaataatctgtcttagcgaaataagaatgttgaatacagatatatttatagaaatatttattgccaccttattttgtaggggtggaaaactgtaaattaaggcaaagctcactgatagaagaatggatgaatacattggagaatacctacttcatgaactatcagatagcattatttcaatatattaataaataaaataaataatcagaaaattataaatgaaattaatctatgttgataaagcaaacatgaccaaaagcacattagttaggttcatgtgtgagtacatggttgtatatatacatacatatgtacatgtagaaaatgtataaagtattcagcctgggcaacattgcaagactctgtctcaaaacaaaa

SEQ ID NO: 722390 - DNA, 220 bp, Homo sapiens
atggccatacgatagaggagaccccattctataccaacacctatactgataatcggtcacccagaagtgtctatacatatcctaccaggctacggaatactctcccatagtgtaacttactactccggaaaaaaagaaccatatggatacatcggtatggtctgagctatgatatcaataggatacctagggtttatcgtgtgagcacaccatatatata

SEQ ID NO: 722391 - DNA, 206 bp, Homo sapiens
gggaagctagctgtgacctgggagcatatgctaccaaggccaggactatattagtaacttatttttatagagatggggtctcacttatgtggtccatgctgttctcgaactcctgggctcaagcagttctcccgccatggcttcacaaagtgttgggattacaggcgtgagtcaccacgcctggccccacactcccttttcttgtt

SEQ ID NO: 722392 - DNA, 847 bp, Homo sapiens
  misc_feature (6)..(6): n is a, c, g, or t
ggaatngcaactccgaaatatgtgctacttagccgcctctattactgtacacctggaaggcaaggttaattaagtcctgtgtggggtttgagggccagaatttaattttggagttttatttaatgtcgggagcagattgggtaataaaatgtatactgagaataagacggcctttgaccttttagagtctagggctgtaaagtgtcttagggttgatgccaaacgagccatgaactgggctggatttttatattgatgaaaaagagcctaaacgctatctgattgggataaagaaaaaggagcattaaccttgactatgcctttggctccagctgactttttaagagtaaattgctggtcaggagggggagggctagttacggaacgaaactgtaagccggaccgggtgtgaggaggggagatgataaaaggattatagggtggaggagcagaggctgaggaagaattgggatctagcttggcctggcgaggaggggaggtgtcgtccctgcgtggtctgacacctctgaaacctgggtgaataatcagagaggtgtgtccctgcaatgattaacacgaagggaaggctgcttccttagtccggactggcgccaaagtttgggttccaggataagacgtgtctccttgttctctacagaagatgaaaggatgaaattagagagggggaaatgagtggggcggcaaattggaaaaagagtaggatagcaggagttgggaagaattaaaaaaggggtaggattgaatggggaggtttgggcgggatggaacgtggttatgaaagcggatattcatgaaaaggacaggtaataaaagtgattacaaaaga

SEQ ID NO: 722393 - DNA, 187 bp, Homo sapiens
atattgtggatctcatgcatacttgactctctgcatcagcagaggtcaagcagcagtgccggctgagcagctggccagcatgatattctcaaagaccccttcatgggtcactctcaccgtgtgcggctgctaccataagcacgtccacctgttcctccaaggaacacttcatgagtggtcctgtgtc

SEQ ID NO: 722394 - DNA, 416 bp, Homo sapiens
  misc_feature (144)..(144): n is a, c, g, or t
  misc_feature (185)..(185): n is a, c, g, or t
  misc_feature (221)..(221): n is a, c, g, or t
  misc_feature (244)..(244): n is a, c, g, or t
  misc_feature (253)..(253): n is a, c, g, or t
  misc_feature (325)..(325): n is a, c, g, or t
  misc_feature (331)..(331): n is a, c, g, or t
  misc_feature (335)..(335): n is a, c, g, or t
  misc_feature (338)..(338): n is a, c, g, or t
  misc_feature (346)..(346): n is a, c, g, or t
  misc_feature (355)..(355): n is a, c, g, or t
  misc_feature (359)..(359): n is a, c, g, or t
  misc_feature (368)..(368): n is a, c, g, or t
  misc_feature (375)..(376): n is a, c, g, or t
  misc_feature (379)..(379): n is a, c, g, or t
  misc_feature (384)..(384): n is a, c, g, or t
  misc_feature (388)..(388): n is a, c, g, or t
  misc_feature (390)..(390): n is a, c, g, or t
  misc_feature (412)..(412): n is a, c, g, or t
tccctcccccaccacacatcagtgtttcctccctcctgctttggtgccttccctttgcaccagcccgagtttaggtttgggccaagcacattacaagtgggaccggtggaacagcccctgggctccctgggcaggggagttttnaggctcctgctctcccatccacctgtctgttttggcctaangccagggtttgagttttgtgaccaaaaccagggggnttccctttccttcccccccctgnggccccagntttggagtgggagggttggttgcccctcccctcaaagctcccccaaaggccagtaatggatccccggccccngtcccnactntgntttggganagggtgagnttcnttttggacncgggggnnttngtccngttncnaaccccataaactttgtagagnggga

SEQ ID NO: 722395 - DNA, 285 bp, Homo sapiens
atgcatttcaagatagatcaaagtcaataatggtataaaggtgaaagaaagataataaacattcaatctaagcttaggtgacggttggtgtcagtgaatttcttgtgttggcctgggagctcgtgggcatggtggggatgggacatggccttcatagccactcatccatgcttccccggaggtcagagaccaaggtttgtccctttctaacatggcccttggagaaggggctcagggccacttccgtcgtaccaaacccgaggaaggccagcgtggcttccacat

SEQ ID NO: 722396 - DNA, 723 bp, Homo sapiens
aagacaattgatgacctggaagataaactgaaatgcaccaaagaggagcacctctgtacacaaaggatgctggaccagaccctgcttgacctgaatgagatgtagaacgccccagtcccaccctgctgctgctctccctctgaccagacttcggctgagggcagctgggggaaggtgaactttaattggagggttggaatctttaactggaagggtggtttcttctttcaacaaccccttctttcctggtgttctttttcggcaaactggtcttctgtgcttccttccgggaaaatccaactgggcttaaaaggctgaagcaactttggaaaccacatttaagggaatggtgagccacatggcataatggtctttaaaaagccatgttgggatggtcccattttgtaatttaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggccttgcttaacgagagccaaacagagcccagggagactccgctgtgggaaacctcattgttctgtacaaagtactagctaaacagaaaggtgattccaggaggagttagcaaaaaaacaaaaacaaaaatgtgctgttcagttttcagttaagatata

SEQ ID NO: 722397 - DNA, 671 bp, Homo sapiens
atccgccgcgggctaagatcgcggccgatgtttgctgtgcgggctgcagcacagcaggatgttgtttgtcgcaaagcagcggcgtcgacacacacttgctgtgtccctgctcactgtgctgttgtgctgcttgtcctccgctctcctccccaaaagtgtggatcccccctcgcacagctatcacagtagtagtgtggtattcgctgtcgtctctaggagaagaattacccccatttaatgtttagttagtagcttgctggcggtgttttccagttgtccccgcgcgcgtgcgccgcaccccgcgactcttctgcgtgtggccgcgccccgcccgtcgccgcactctcatgctcacgcgcttttcttttttcgtctgtggcgtggcgcactccctatctcgtctctatctccccaggtcgaagcttccgcgcacgcgtcgctcttaggggttccgcttggtgtggggcgtgcgtgcgtgtgcgtcgtgtgtgtcgtggtatgattattgtctctcgcatgcgcctctctctggcgcttcccacgcgctatcttctgctgcgcgtaatgttagctccaaacaatagcagtagctgacctcattatataattgctatatcaacccctctgttatgccgagcgccctctctggcggccaacaataagcaaaaaac

SEQ ID NO: 722398 - DNA, 236 bp, Homo sapiens
  misc_feature (17)..(17): n is a, c, g, or t
  misc_feature (114)..(114): n is a, c, g, or t
accgctactgtggtgtnccgtgaactatgtctagatactcatgtgcacagaacaaagggtgggggaaaaaaatgtaatgtatataacttgatccccttgctgtacagttggaanataaaattcccgtcctgacgcagcggaaacgaatccgactgagaaccacgaggtggcgggttttttcctaggccttattcagtaggttaaggatcccgccttgccatgagctgtggtgtagg

SEQ ID NO: 722399 - DNA, 123 bp, Homo sapiens
catgttggcgacgtggtcggacatgtaaggtgtctaagacctgtggacagctagaccgctgaccaggtgatgtcacagcctgcagaggtctgcgggcacaaagccagagctacctggagccag

SEQ ID NO: 722400 - DNA, 594 bp, Homo sapiens
  misc_feature (45)..(45): n is a, c, g, or t
  misc_feature (74)..(74): n is a, c, g, or t
  misc_feature (84)..(84): n is a, c, g, or t
  misc_feature (89)..(89): n is a, c, g, or t
  misc_feature (102)..(102): n is a, c, g, or t
  misc_feature (122)..(122): n is a, c, g, or t
  misc_feature (135)..(136): n is a, c, g, or t
  misc_feature (162)..(162): n is a, c, g, or t
  misc_feature (173)..(173): n is a, c, g, or t
  misc_feature (175)..(175): n is a, c, g, or t
  misc_feature (189)..(189): n is a, c, g, or t
  misc_feature (202)..(202): n is a, c, g, or t
  misc_feature (207)..(207): n is a, c, g, or t
  misc_feature (209)..(209): n is a, c, g, or t
  misc_feature (212)..(212): n is a, c, g, or t
  misc_feature (222)..(222): n is a, c, g, or t
  misc_feature (235)..(235): n is a, c, g, or t
  misc_feature (238)..(238): n is a, c, g, or t
  misc_feature (247)..(247): n is a, c, g, or t
  misc_feature (255)..(255): n is a, c, g, or t
  misc_feature (258)..(260): n is a, c, g, or t
  misc_feature (262)..(262): n is a, c, g, or t
  misc_feature (269)..(269): n is a, c, g, or t
  misc_feature (275)..(275): n is a, c, g, or t
  misc_feature (280)..(280): n is a, c, g, or t
  misc_feature (283)..(283): n is a, c, g, or t
  misc_feature (287)..(287): n is a, c, g, or t
  misc_feature (292)..(292): n is a, c, g, or t
  misc_feature (296)..(296): n is a, c, g, or t
  misc_feature (302)..(302): n is a, c, g, or t
  misc_feature (320)..(320): n is a, c, g, or t
  misc_feature (361)..(361): n is a, c, g, or t
  misc_feature (363)..(363): n is a, c, g, or t
  misc_feature (374)..(374): n is a, c, g, or t
  misc_feature (379)..(379): n is a, c, g, or t
  misc_feature (382)..(382): n is a, c, g, or t
  misc_feature (386)..(386): n is a, c, g, or t
  misc_feature (405)..(405): n is a, c, g, or t
  misc_feature (421)..(422): n is a, c, g, or t
  misc_feature (427)..(427): n is a, c, g, or t
  misc_feature (450)..(450): n is a, c, g, or t
  misc_feature (453)..(453): n is a, c, g, or t
  misc_feature (474)..(474): n is a, c, g, or t
  misc_feature (477)..(477): n is a, c, g, or t
  misc_feature (501)..(501): n is a, c, g, or t
  misc_feature (504)..(504): n is a, c, g, or t
  misc_feature (515)..(515): n is a, c, g, or t
  misc_feature (546)..(546): n is a, c, g, or t
gggtgggccggcatccactgtgtggatatatctgtatactcgggngggcgggggacggggcagtgggggaaaantggaaaatanaattntgactatgagcangctgggggggcggtgcaggngtggctgtgaagnnccaaccaaaccacagggcacgggggnggggggggggngnctgggagggcaggnagaacctcctgancagangnggnggccagaacngggcgcgtttgtnctngtgggggtntggggggnggnnngncggtggncggggncgcgnggntggnctggntccncggggncggggctgcgctgggggngggggtgggggggtggggcgggtcgtcgggggggtctgggngngagtggggtgnttggnttngggngggtccgagcctgtcagcngggagatggtggggtnntcggngaagtgcccacttcggagatgtnggngccctctcccagctcaaacancancggcaggtcgttgctcccggtgtncanggagccggggnccagcaggttcagcggctgcgctgtgtagtncaccagctgcttccctgaatccgggctgctgttctctgccttgggagg

SEQ ID NO: 722401 - DNA, 215 bp, Homo sapiens
agtagtggttattcgcctaaaagacggtctggatatatctcatcttcagggacacgaagagttaatgagtcatcacaagagaaatctcctgggcaccaaggatgtggtagtaaagtgagatatagtaaacggtccactttagatacttccagaccactaagtgaaaacccaattacacacagagagttccaaggcctatttttgccttaatgagc

SEQ ID NO: 722402 - DNA, 813 bp, Homo sapiens
  misc_feature (54)..(54): n is a, c, g, or t
  misc_feature (61)..(62): n is a, c, g, or t
  misc_feature (108)..(108): n is a, c, g, or t
  misc_feature (162)..(162): n is a, c, g, or t
  misc_feature (187)..(188): n is a, c, g, or t
  misc_feature (190)..(190): n is a, c, g, or t
  misc_feature (193)..(193): n is a, c, g, or t
  misc_feature (209)..(210): n is a, c, g, or t
  misc_feature (218)..(218): n is a, c, g, or t
  misc_feature (220)..(221): n is a, c, g, or t
  misc_feature (224)..(224): n is a, c, g, or t
  misc_feature (234)..(234): n is a, c, g, or t
  misc_feature (238)..(238): n is a, c, g, or t
  misc_feature (241)..(241): n is a, c, g, or t
  misc_feature (284)..(284): n is a, c, g, or t
  misc_feature (332)..(332): n is a, c, g, or t
  misc_feature (336)..(336): n is a, c, g, or t
  misc_feature (346)..(346): n is a, c, g, or t
  misc_feature (458)..(458): n is a, c, g, or t
  misc_feature (466)..(466): n is a, c, g, or t
  misc_feature (519)..(519): n is a, c, g, or t
  misc_feature (525)..(526): n is a, c, g, or t
  misc_feature (530)..(530): n is a, c, g, or t
  misc_feature (544)..(544): n is a, c, g, or t
  misc_feature (555)..(555): n is a, c, g, or t
  misc_feature (592)..(592): n is a, c, g, or t
  misc_feature (594)..(595): n is a, c, g, or t
  misc_feature (599)..(599): n is a, c, g, or t
  misc_feature (607)..(607): n is a, c, g, or t
  misc_feature (614)..(614): n is a, c, g, or t
  misc_feature (641)..(641): n is a, c, g, or t
  misc_feature (643)..(643): n is a, c, g, or t
  misc_feature (689)..(689): n is a, c, g, or t
  misc_feature (696)..(696): n is a, c, g, or t
  misc_feature (706)..(706): n is a, c, g, or t
  misc_feature (711)..(711): n is a, c, g, or t
  misc_feature (713)..(713): n is a, c, g, or t
  misc_feature (787)..(787): n is a, c, g, or t
tttaattgcaaacatttttacacaaaagtagttgcactctattttattaagatngatattnntaagttatcagagacatttaagagctagaggccatttattccaacngtaatgcattctatgctgaaagtaaactaagttttctgaccatgatgtcctggntattttttttttctttttttttttnncnagnctgctcttttctgggnntaccgggncnngangggctcttcntgcngtntcccagcagtgtgtttccagatttattcttggatgtggttggngctcccaacatttagcctgaactaatgttacagctcaatgtgaaacantgcngctttctgtnacagctgcctgtggttaatgagatttaatacagggggtacagttacaaatgatagcattttagaagaattataattgccatatgatttagaattagtaatcaaatactttantaacaganacgtgtattctatatttctgggaggggagtggcatacttcaaaatagtcactnttttgnntgcntgatatgttaattntttctttgggngtgtgagaataaattgcgttttttcccctaccccttngnnttcnctcctttngaaatgntttctataatggtgttctccaacatgntnttagctttattacattattgtcattaaaatatacatatacatatangtggacnctaaacaganttggnanacatgatataaatatacacatggccaaacactgttcagtttcatttaactaaattcaacaaatatttattgggngcctactacttgcagatcccatgtta

SEQ ID NO: 722403 - DNA, 173 bp, Homo sapiens
cggatcccctccgtggtataccagtcgctacgagggaaggatacatcgccctgagctgatggatctgcgctcctggaccgccggggacacgggcggtcagatcacccagcgcaatgtgtggagtgcggccctgtgggtgctgtgagcagcggtcgagcctaccgtggagggca

SEQ ID NO: 722404 - DNA, 285 bp, Homo sapiens
  misc_feature (21)..(21): n is a, c, g, or t
  misc_feature (31)..(31): n is a, c, g, or t
  misc_feature (58)..(58): n is a, c, g, or t
  misc_feature (64)..(64): n is a, c, g, or t
  misc_feature (69)..(69): n is a, c, g, or t
  misc_feature (78)..(78): n is a, c, g, or t
  misc_feature (81)..(81): n is a, c, g, or t
  misc_feature (93)..(93): n is a, c, g, or t
  misc_feature (95)..(95): n is a, c, g, or t
  misc_feature (118)..(118): n is a, c, g, or t
  misc_feature (127)..(127): n is a, c, g, or t
  misc_feature (136)..(136): n is a, c, g, or t
  misc_feature (146)..(146): n is a, c, g, or t
  misc_feature (159)..(159): n is a, c, g, or t
  misc_feature (174)..(174): n is a, c, g, or t
  misc_feature (202)..(202): n is a, c, g, or t
  misc_feature (245)..(245): n is a, c, g, or t
ccccagctccccttgtttttntggggccttnaacagatcccccactgtcccccccctnttcccntgttnttttggttnaanaccccccccccnanacccctttggtgccctatttgcncagcccgtngtcttcccnccagtttttngagggataggggncattccatcccaagnttcccccttacccccccctacccttttnaggggctttggggtggggctgggccaaccaaagggactgggtnttcccttcttgggctaataaaattgtttctttgtggccta

SEQ ID NO: 722405 - DNA, 612 bp, Homo sapiens
  misc_feature (521)..(521): n is a, c, g, or t
  misc_feature (567)..(567): n is a, c, g, or t
  misc_feature (583)..(583): n is a, c, g, or t
  misc_feature (607)..(607): n is a, c, g, or t
gaaaaatacacattcagaggagacaaaaaataaaaaacaatgatgcatgcccacaggatctagaaaataacttcttaagggcaaatctaggagttattggccttaaagaagagatagagaaagagataggaatagaaagtttgttgaaagggataataacatagaacttcctaaacctacagaaagatatttatatccaagtacaagaaggttatagaacaccaggccaatttaacccaaagattacctcaaggcatttaataatcaaactcccacaggacaagggtaaagaaaggatcctaaaagcagcaagagaaaagaaacagataacatacaatggagctccaatacatctggcagtatatttttcagtggaaaccttacaagccaggagagagtgacatgacatatgttaaagtgctgaagggaaaaaaccttttaccctagaatagtatatccagcaaaaatatccttcaaacatgaagaataaacaaagacttcccagacaaaccaaagctganggatttcatcacactagactgggccataagaaacgcttaaggagtnctttggcagaagaacngacattatgagcaccaagatcttntaagg

SEQ ID NO: 722406 - DNA, 661 bp, Homo sapiens
tgtttcacttgcttctctcattctctcatatctgctgccaagtaagatgtgccttttgccttctgacatgattgagaggcctccccagcaatgtggaatgtgagtccattaaacatctttttctttatgcattaccctgtcttgggtatctctttactagcagtgtaaaaatggactaatacactaaattggtacaggtagagtcaagtgctcctgtaaagatacccaaaaatgtggaagcaactttggaactgggtaacaggcagaggttggaacagtttggagggcttggaagaagacaggaaaatgtgggaaagtttggaacttcctagagactagttgaatggccttgagcaaaatgctgatgatgatatgaacaatgaaatccagactgaggtggtctcggacagagatgaggaacttgttgagaactggagtaaaggtgactcttgttatgttttagcaaagagactggtgagttttggggccctgtcctagagattgtgaaactttgaacttgagggagatgatttagggtatcttgtggaagaaatttttaagcaccaagcattcaaaatgtgacttgggtgctgttaaaagcatttagttaaaaaaaaagacagagaactaaaagttcaaaaaattgcgctgacatgtgatg

SEQ ID NO: 722407 - DNA, 765 bp, Homo sapiens
ccgccgccgcgccatcatgagggaaatctgtgcacttgcaggccgggcagtgcggcaagcaaatcggcgccaagttttgggaggtgatcatgcgatgatgcacggcatcgaccccacgggcacctaccacggggacatgcgacctgcagcttggaactgcatcaactgtgtactacaattgatggccacctggctggcaagtactgtagcccctgctgccgtgctctgtggatcttggagccctgtgcaccagtggactcctgtgctgctctgtgtggcccttctgggcatgatcttcctggcctggacaacttcgttttctgtgtcagatgtggttgcttggtgaacaacttgtgtgccaatggtgtgcactaacacatgaatgtgctgctggatgcttggttgtgactccggttgctggattgttgtagagaacacggatggcttgagacgcttgttgaccttgcctgcatgtggtttcccatgctagacccactccctgggtggcggggacttgggtctagggattgggtaccctcctcatcagcaagatcctgggagggagtacccacgacaggatcattgaacacgtttagtgtggttgccttcgccccaagagtgtcagaacacagtgtgtggagcccctacaatgccaccctctcagtccaccagctcgtagagaaccagacgagacctagtggcattggtaacgaagctcctagacatttggtcagaacctatagtgaccagccacttgtgactgac

SEQ ID NO: 722408 - DNA, 128 bp, Homo sapiens
  misc_feature (45)..(45): n is a, c, g, or t
ttttttttttagggggtcatttttactttatttaagggaaaaaanggggggggggacaacagtaattttcataatacacagtagacaagttagcacggcaaaaaaaggggcggccggggtaccgagct

SEQ ID NO: 722409 - DNA, 465 bp, Homo sapiens
aaaatagtaaatactagaaccagaatctactcattcaaaacatatttattttgtgcttattaacttaagacattgtcttttcacacacacacacacacacacacacacactcccacaaactcttacactaatttagagaagtgtacaattaatataagtactatgacagtggaagtatagggcactttgaaattataaagggacccctatcctggtctatagtatactcaaggataaagaaaagtaaactagataagaggatgagggtagagtaaattgaagtactccaggcaatggaaaagcacgacccacaaacctaaggaaggaactgggactgcctagaggcctattacagaagcttactggtagtacagcctataggaagtagggatgagagcagcaagacctgaaattggagaaacgaaggccattaagagtttcagaaggagtttgccattcttaatt

SEQ ID NO: 722410 - DNA, 189 bp, Homo sapiens
gtctagcctcgccatgcactggctggcttggggtgccatgggtgacgaccccagggatctgcttccctggcaagacttctagatacagaaatcattttgcccttcaccagcccaagactcagtcttttgacccttcccttccccacattcccacacttgctccctgggtgatctcatcccacttcacag

SEQ ID NO: 722411 - DNA, 110 bp, Homo sapiens
gccatgggtctaaatctaattggggtcaggcactttttcggcgggttcatggtcatcatcgcccgatttcgcacagttttcaattcgccgcacgaacttcccaatttctg

SEQ ID NO: 722412 - DNA, 1270 bp, Homo sapiens
gttagccaagattacaatgaaggactactccaaattaggagtccatgacatgaacgaccgcaaacgtctcttccaacttatcaaaattattaagattatgcaagaagaagataaagcagtcagtatcccagagcgtcatcttcagacaagcagcctgcgcatcaaatctcaggaattaagatctggccctcgcagacagctgaattttgattctcctgctgacaataaagacagaaatgccagcaatgatgggtttgaaatgtgcagtttatcagatttctctgcaaatgaacagaagtccacttacctaaaagtgctagaacacatgctaccagatgattcccagtaccatacaaaaacaggaattctgaatgccacagctggtgattcctatgtgcaaacagaaatcagcacttcactcttttcaccaaattacctttctgcaatactgggggattgtgatattcccattattcaaagaatctctcatgtttcagggtataactatggaatcccccattcttgtatcaggtaataaattttatctttctttcttttgagggaaagtagcctcaggcaagggcaggcctctccttcatgtccagcagacagcatctactccttatttatagtaaatgaatataacagaaattatcatgaacagcatttgcatcaataataggaatacctggatgtgggaaaattaatgagaaattgggactttctaggtgggagaaagatgatattgttcatgtacatcagaacagctgctacttgccaggatctgtagcagatctgtttctattgtttattatagcgtaacatgatacatctagtacatctgtgaaagtgaaatagttaacccttctacagtggagaaaaaaattacacaatccacaggacttttttaaggttatcaaattcacttaacccaaccaggagacttaaagatgctttgttaaaaaacaagggcatgtagtttaattaagtaggtctttggggcagttagttcacctacacacattgaaatatgatcctaattttgagtgctttctacaatttcaaccccggaaaaaacagataattttggtgattacaaacagtaagacattgttggtggagatgagagtttgagagtcagggtgacaataagttatttttacctagtgtttcgagttagaatttgaaataaggtccctaagaggtgaaataacaagtaatccctagtactaacaatggtataataggaaatatgttcttttaatcttgt

SEQ ID NO: 722413 - DNA, 306 bp, Homo sapiens
tgagtggcatgtgaaggagtctgtggattagattctaacaatgagtaaatgataacttttctgacctggatagttgtactgtggttatgcagtaagagtgtcctaatatttaggaaatataagtaacagggcatcacgtgtgcaactttcaaatggttcaaaaatgtcaacaactggagtactgggtaaaggtatacaggagctctatgtactatttctgaaaattttatgtaaatttgcatgtccaaggtttttttaaaaggatagtgttttgttacatgaaacggtattgagtggccatgtgag

SEQ ID NO: 722414 - DNA, 472 bp, Homo sapiens
cagttttacatgcactcatgtgtgtgtgtgtgcgtgtgtgttcgttctatgcagtttttatcacaagtggagatttgtgtgaccaccactataaccaaaatacagaaatctgtttcatcaccacaaggctcccttatgctatcccttgacagctagatccacccttattattacattttaaatttttataggtttgatttttgaatagtcacatagttcaaaaatgttttaaggttcatagagaaacctcagtgaaaagtcttcttttctgtcctcttcttcacagccatctgtttctctccttcacagaccatcagtatcacccctctcgggcgtgtctgtaaaacttataatgtatttgtaatagtccacacatatttgtctaatttccttcctcttatgtactcacatgtagaaatctgtacgccctgtaagcaaaaagaataatccatttaagtttatcaaaaagatc

SEQ ID NO: 722415 - DNA, 584 bp, Homo sapiens
  misc_feature (584)..(584): n is a, c, g, or t
taactaggcaaagaactttattaatcttggttccaaactgtgattcccaggcttcttcggcttaattagctgcaaaaaatgaatggggtataagcaaaaactgaaaagagctgcaggtgtccagggggctggggcttaaaaatattagagatctagattttatcagatccataaacaaaaatttcttaaaaagcgagtcataatataaaatagcagctcccagtaacttcttcaggtttatatctctcgagaagtggactcaattcagttggcctcattctgggaagcctcatcaaaattctccacaagatcggggaacttcatcatcatcatcctctccagtagcaagtgtggggcttttccatccacagatggttggggcagagcttcggccagtctccttaaactagtcagactatccgcaccaagcgggttaaagatgctggggtacgcatttctggtcagctggcttcgtctcagctagggcctgtaagggtgaaaagtgtccgctgccagagatgcctgaacttcagggttggtcacaaggggatcactggtccctgggttggtaaacttattcaccn

SEQ ID NO: 722416 - DNA, 1818 bp, Homo sapiens
gactgctgctggtagtaggacgctctgagactggtcttggagcctggctctgcagccggtgacgccttctccgtcgtcgatcatacgctctccgtgggaggccgatgagtactaatgccagaaagaatgtccacccagacaagagggaaggttggctcgcattccgtatccgtggtactcattgactgagaaaatcatctgtccctgtccatactctgagtagtcagcatgccgttccggctgcatacttcttgcgcatgcctattgaagaagaagagcaatatacaccacgagagagccagggctgcaacggtgacaccgatgtggcgaacgagcgatagagatgcgagagagagcgcatgtaagatcatacctagtggtcctaggaggtaagtcgatgaatgacccatacagatcgtatatagagtagtagggtccgaacatagccaggggacaagtcgtggagagaggcacttggaataacagtgggggcaagcttagcgatgtgagtcgccggactaaacgtaactagaagctaccctttgcaacaatagcacgagtcctacacaatagtgatctactgggatccatcacatgaggtagactcaaatgattgcgactaattgtaccacacaatgtggttgaggggcaaattcaaatgattttacgcgtgaggctgaggaccatgcagacataaatgccaattccaccatgagagaaagcaaattgaggaaaggagtagatgaatagagcaggacttacataaacctaccattatagtgatactcagccgaaaaccatgtgcagtaccaaacaaggaataatccaagatactatcctatgtgatgggccgttaggacaaagttcgcgcgttgaggcagatccattagcaagacaacatacttcgccaaattggggtagaacgttcaccacttggtgggatgaaccttgggccaccgcctacataactaaggtacatataagacttctccgcgatacaattttacgatgtacaccaggacgaaaggaaagaacgccaccttatagaccatgggcaataatcgcctattgggttgggagaagcaccatttccggccaggaacaaatgcccccaggattctggtgcacccacaacccagatagagcaccaataaatgaaggagagagcagaaggcgaatcaccatcaacccccaagaggcgatgcccggaaacccaacagggaacatgagcgccaggacacggaactggacagatgagcaaacacgatcggcagaaagcgggcaatgcgcacgcacaaatatcaaacaagaagacagatggagaaccaaaacgcgataccaatctaaagtcgcgagaacaacacagaacccacaggcacacaaaacgagagcagacacaaccgacgaacaagagaaacagatgcgcaccaagagaagaccaggacacaccacatatcaagacatgcccacgagaccacgcgaactaagaacaacaatgcaggaaaaagatacaacaacaacgacaagcacacaatggagaacaaccagcacaacaaaaaaaaacaaacaaacaaatcacaaacacaaagggaaccaaaacaagagaacaaacgcagacgcagaaaaagcgagacaatcacagaaagagaaggaagtaccaacaacacaagacacacaaacaagactaaccaacaaaaaccctcacgaaaaaccaacaaaacagacgtacaaacacaaagaaaagacaaaaaaacacgaacagtagacaaacaagaaaaacgagacacacaacgacagaaccacaaccaagacaaacag

SEQ ID NO: 722417 - DNA, 399 bp, Homo sapiens
aaaaaaaaaaaaaaaaaaaaaaaaaacaattgtgtgcgcgcgcgcgcgcctggggcccttggaaaaggtttttaaaacacacattgggtgtggggcgcgcgggggccccagagaggcgatgaaaggagaacattgggggccaaaaaaggggtaccaataaggagagaactcccggggcaaaagagaaaaggggggtgggaattttatcacaaaataaaaaaaccgcccggggggggaacacacagagaagtgtgtctttagaagaacaaatatcccaagagagggagagagatctcaagaggggagggcaacaataaagggggagctctatatacacaacggaggggcccacaaggagaagcacaggaaatccaaaattaacgccccagcctcggggtg

SEQ ID NO: 722418 - DNA, 1120 bp, Homo sapiens
attatgaatgagggagccctttggtggcaacatacaggtgcccccattgcctacagtgctgcgccctgcgctcccagagtaggcagcggatgatagaggggtacagggcttctcaagcctgatagttttcttctctgggcttaatttttctctttgtgggtacgtgcctgacagtgtttaacggtgtccgtctgaactggagttgcagacgttttaaactagatgagccccttcagatcatctgtgcctacctcctgcccatcaggcgtctacactgtcactcagacacctgtggcatggtggagcgacgactgccctgtcctgacgcctggcaaaagtgtgaaagctgtctcctgcaatactgctgggcatgtgggcctgagctgtgttccatttgcacacgaatcaattcgtgagtgacgatgcgattaatagctatggtcttctgtaactaaagacactacacattaataacgaagagcggagggccgggtccagaagagatgtcccctctgaaagtggggccccacggactctaaccgtcttaacccacggttttttccgttcgtcacgaaccggtggtcccctgttagattagaaagcttcgcttattcaattaggatgccttcagcgcccactttcgagtcccagtaccgggtattgcacacaagcgctacagttggaaacgtgaggataaacacccgtgcacataagacctcgggggagacccctcccggagtacataggggcacatccctctcacccagtccattgaaagagctagaggcatcaacttgactttctgtgaacatacattttaaacgcctcaccgtactacttttctaaaagccttcggcaacgggcaataccattggccttacacaagtttggaaagagacccgggtccatcaaacgggattgctcaagaactctgtaagccttgggcataatcggctttccgcttgacgtcaggagacagattagggtccccaacggcagggtaagtgcacttctcgtgacagaaccctttttactatcctcaggactacgggcgcaaaaaaaacgggtcatccccccgtctacactttaacgggaccacacaactatcacgcacacaaca

SEQ ID NO: 722419 - DNA, 348 bp, Homo sapiens
  misc_feature (2)..(2): n is a, c, g, or t
  misc_feature (131)..(131): n is a, c, g, or t
  misc_feature (151)..(151): n is a, c, g, or t
  misc_feature (154)..(154): n is a, c, g, or t
  misc_feature (176)..(176): n is a, c, g, or t
  misc_feature (187)..(187): n is a, c, g, or t
  misc_feature (191)..(191): n is a, c, g, or t
  misc_feature (213)..(213): n is a, c, g, or t
  misc_feature (246)..(246): n is a, c, g, or t
  misc_feature (265)..(265): n is a, c, g, or t
  misc_feature (276)..(276): n is a, c, g, or t
  misc_feature (283)..(283): n is a, c, g, or t
  misc_feature (301)..(301): n is a, c, g, or t
  misc_feature (303)..(303): n is a, c, g, or t
  misc_feature (305)..(305): n is a, c, g, or t
  misc_feature (309)..(309): n is a, c, g, or t
  misc_feature (329)..(329): n is a, c, g, or t
  misc_feature (338)..(338): n is a, c, g, or t
  misc_feature (344)..(344): n is a, c, g, or t
cntttttctgggaacaaaagattaacatttgtcccttcataatctcagtgattactatatacgataaattccaagggtttcatatttaactagcattctttaggttgttggtactaactctataatttacntttgatttagctgttcaatntcntttagatgaacacaaacaagantagtatatgcnaggntcttctttttttttctcttttnttctcttggttgttttactttttctcctttttntgtggctgtttcttttttnctgtttccacnaactggnataaacaggcatatattntncngagngatatttggctaatattttnttatcccantgttgnttct

SEQ ID NO: 722420 - DNA, 451 bp, Homo sapiens
acacagcagttatggatgtggcgattaaagtgattattagggctcaggcgttgatgttacacgtgttgatggcttcgatgatgagatcttttgaatagaatcctgtgaggaaaggtattccggtaagggctaggcttccgataatgagacaagatgatgtgaatggtattgcttttattatattgcctatttttcgaatgtcttgttcatcgttgaggctatggatgattgatccggagcatatgaataatatggctttgaagaatgcatgggtgcaaatgtggaggaaagcaaggtagggttggttaatccctaatgtgactattataaggcctagttggctggatgttgagaaagctacgatttttttgatgtcgttttgggtgagagcacagattgctgtgaataatgtggtgattgcaccaagacatagtatggctgttataatagt

SEQ ID NO: 722421 - DNA, 80 bp, Homo sapiens
ccttggcatcaaccatttctccaaaggagctccaatttcattgtcagtaaaaattggtatataaggccaagtgctgatgt

SEQ ID NO: 722422 - DNA, 446 bp, Homo sapiens
  misc_feature (194)..(194): n is a, c, g, or t
  misc_feature (239)..(239): n is a, c, g, or t
  misc_feature (241)..(241): n is a, c, g, or t
  misc_feature (249)..(249): n is a, c, g, or t
  misc_feature (273)..(273): n is a, c, g, or t
  misc_feature (286)..(286): n is a, c, g, or t
  misc_feature (329)..(329): n is a, c, g, or t
  misc_feature (389)..(389): n is a, c, g, or t
  misc_feature (446)..(446): n is a, c, g, or t
tcttgaaatggagaaatgtgttttccaaaatccaaacatctcacaaatatatgctatgaagaccctaaaaagagttctcagcgccctcacacagacacaaggacagaacatgagaacatagtcccagcctttaaagagagaaaacggacattccaacaagcagattcaaagtcacttggggtcgggcacggtgngctcatgcctgtatcccagcactttgggaggccaaggcgggtggntncacctgangtcgggattcgagaccagcctggncaacatgggcaangccccatctctactaatacatggccgggtgtgatggtgcacanctgtaatcccagctacccaggaggctgagggaagaagattgctgtaacctgggaggcaangctgtagtgagctgagatcgcgccacaacactctgggctgggtgacaagaggcgagn

SEQ ID NO: 722423 - DNA, 84 bp, Homo sapiens
cccagccccaaccagacctctctgtacttctgtgccagcagcccaggactagcgggggacatcacagatacgcagtattttggc

SEQ ID NO: 722424 - DNA, 118 bp, Homo sapiens
tccgtgtgcacagattctgagaatacggtggcatcgaactgcgtgagttgatgagtgcaatagctgatgtgcatgtcgactcccagctaccattgcccgaattcccccaagttgcgtg

SEQ ID NO: 722425 - DNA, 129 bp, Homo sapiens
cttccaaaggaagatacgtattcatatgctgtatgtactcgatctatgcatggcgtaaattaaatgcacccagctattgctctttgaagaatcttagtcggagtaaagataaattcttgatccgctcta

SEQ ID NO: 722426 - DNA, 380 bp, Homo sapiens
tgtatactactggtatagcttcacacagatacagtatccttgcgaagatttatgcacaagacagtgcatatcggagtttatacactgtattccctaggatgtgacttcactgggaataaatgttggactaggcactgttcagtgaaggagccaggaagttatataatacacggtaaacatccacctggctcaatgggtaaatgcagtacgtacagcattgtgcagtggtgctgtccgaggtggttgctgtatgtcacactaaccagttgaagactacacaagattaataccatccagcatcaggatatagctgtggattttacaaaccattcttatttctaacttcaggagttgatgtttttcccagtccatcttaaaat

SEQ ID NO: 722427 - DNA, 893 bp, Homo sapiens
gtattattttgggtacggcgagcactttaattttccttacacaaggacgtgtggcgggggcctaaggtctcacataacagtagaaaaccaaaattggtggtcatctcttcaaagaatcgagaatggcgtacaaagaaaaccgcttacataatttaaggattggaattacatttacagggcgtaaattgcaaacccggcttccaactcaaagcaagtaacagcccagggggttctgggccaaggacatcagctaagaagggaaatcggggtcctagggtctgggactttccaacccggacagacccgcaagacaaacacacggggttctggccagcctctagagaaatcccagaaactcagcccggacacgttaagtaccagggggaacagttaacttcaatacaggtcaaaatcagcaacaagttctacaatccagtgctgatatcagatacaagcttcagggacaatttcttttcgaaggcttatcccagtttcgtgaggctagcatgaggggtgtgcatttggccaggggcaaaatttctattctcaataaacccaggcagaaaggctacgcatcggcggagtccgtaagaagcatggcgggggacgatggaggggcccgatcgtcgaactcctgggtggtaaatccacatctgctgcagggtggacaggtgaggcaggatggagcaccgatccacaccgagtactggggctcggggggggcgaagatcttggacccccaggggggcggcgctggggggaaaccttaggatctgggggaaagccggaacggggggggcgcgaaagaccggggggggacaggctggcggaggcccgtccctcgaaggggagggctcgggggcggcaaaccaccggagagagggaaggtccca

SEQ ID NO: 722428 - DNA, 465 bp, Homo sapiens
gcggccaacatggcaaaacccgtctctactaaaagtacaaaaattagctgggtgtggtggtgggcacctgtaatcccagctactcaggaggctgaggcatgagaattgcttgaacctgggaggcggaggttgcagtgagccaagatcatgccaatgcactccagcctgggtgacagagtgagaccttgtctcaaaacaaacaaacaaagatgtctaaaggaatggggaggtttgacataaaagatatgtgaaatattttcatgactggctacataatttgtggggcccagtgcaaactgaaaaagtgggtccccttcttcaaaaaagtattaagaatttcaaaatggaatggctgggcatggtggctcacgcctgtaattttagcacttttgggaggcccgaagcgggccatatcaccctgagggtcggggagttttcagaaccaggccttgacccaacatgggg

SEQ ID NO: 722429 - DNA, 363 bp, Homo sapiens
tttgtatagcacaatctcaggaatagcccaatgtttaacgcaaaaaaaaagacaaaaaaaaaccaaaaaaaaaacctacaaaaaaaacttggtggctaggattaaggtaattctattggctttactctcaggaaagtgtaataacgcttgggaattctgtacgttatcactgtaatggaatatccaattaacagatagtatgatttacttttcatcatttaaatgtaagggtatcgaaaacttttcaatttggctctatctggggctgatagacttttctgtctatttaatgtaagggtatcgaagacttttccaatttggcttatctcccatctggggctggatcccaaaattctggagatg

SEQ ID NO: 722430 - DNA, 3822 bp, Homo sapiens
catcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtgggtgggggcactactccccactcagagcacaaatgcaactccttcccctacaatcccatcctgagccattgcagggggcagggaagttcacccccccccaccacccccccgcccccccgaagccatgtcactgaaaaggcctgggggggatggtatatggccctttccccaccaggcgctaaggggaacacccccttccccaggtcttttatttgtttaagttatttttgcacaaatgactcttttatatttaattcgatttcattgcctcccttcttaaagccaacaggctcagtttacaaacctgtgagctactgttggctgctgccctccttcccagtgaaaggtacaaagcaataagcatcatgcatcctccccttacccctccaacacccctctgcctctggctcaggttgctcaaagcacagatcctctcttaccccgtccccaggtttgaaacacatagcctcatttcaaggtgtagccaggttcccccgactttcctctgggatataaaaaagggggtaagggggcaaagagagccctctgggcctctcctcccatacacactacactgccccttctccccccatcaaaacgctcagagacgttgtgatgatgcgactgaggattatgcaacgtggtccaaccggagcggccagcatgaccagctgtccaggggctgcctcctgccttttctttggtaaagacaagacccttgggagttttaattctgttttgtacttgccctgtggggcctccactgcttttctatgggagacactcttaatttaacagatgagaatattttgaaactctgaaa

SEQ ID NO: 722431 - DNA, 214 bp, Homo sapiens
  misc_feature (4)..(4): n is a, c, g, or t
  misc_feature (170)..(170): n is a, c, g, or t
  misc_feature (185)..(185): n is a, c, g, or t
ggangatgagcgggatggcagagttatggagcagcttggaagccttgcaactgacaagggtaccgcgagacatgcgtcgttgctgtttctgtcatgaggagggtgacggggccactgattgggcctgccctgtctgctgaaccttggacctgtgaccctgtgggtgcacnctcaacgtgtgcccntttggtccacggagggttgtatgagaccc

SEQ ID NO: 722432 - DNA, 495 bp, Homo sapiens
tccttaacaggctgatacaggagaatggcgtaacctgggaggcagagcttgcagtgagccgagattgtgccgctgcactccagcctgggcaacagagcgagataccgcctcaaaaaaaaaaaattccagcaaacgaaaaaggaatggccctatagtaaggatggtaggcttaagtagctgggatcaggattcataccctcttcaacctctgctgccttctgatgttcctttggccgaccagcacgccggcccagcctttcttgtatactctaagggtactaggtcacaactctttctccttcaccttggtcttggtattaaacctcccccctacaatgtttaccttgaggctttttaatctaaatctgcttcacatcatgatagggtgagtgtaaattttcttgccgaggccaggcacagtggtctcttgcttgtaaccccagcactttgagatatcctaaaggaaggaggactggcttgaggctgggagtccgc

SEQ ID NO: 722433 - DNA, 3228 bp, Homo sapiens
catcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaccctgattggggagagctgagtgctgagccttgggagcccctgccagccacctgcacctgtggacagtggccaacaggctcagtttacaaacctgtgagctactgttggctgctgccctccttcccagtgaaagagacgttgtgatgatgcgactgaggattatgcaacgtggtccaaccggagcggccagcatgaccagctgtccaggggctgcctcctgccttttctttggtaaagacaagacccttgggagttttaattctgttttgtacttgccctgtggggcctccactgcttttctatgggagacactcttaatttaacagatgagaatattttgaaactctgaaa

SEQ ID NO: 722434 - DNA, 717 bp, Homo sapiens
  misc_feature (378)..(379): n is a, c, g, or t
  misc_feature (384)..(384): n is a, c, g, or t
  misc_feature (386)..(386): n is a, c, g, or t
  misc_feature (410)..(410): n is a, c, g, or t
  misc_feature (412)..(412): n is a, c, g, or t
ctcttaaagttatcttgaaatatatactacattgttacttgctgtagtcaccctactgtatagtggaacccagaacttactcttccagtctaactgtaactgtgtacccactgaccaacctttcctgtccttcctccccatgctggcatattatttaaatccacagacacatatcgaatagccactttgtgccagaaactcttgacactggggtaccagacaaatccaaaatctgtgccctggaagaactcatagtctcagggggcagatggtctgttcctagggttgctgtgagactggagcaggccggatgtgggctgtccgtgggagtggggttcaggtgggatggtatggtacctgtgaggccagggtacaagnnacctnantgagtgctttgtggaaatagaaangngaccatttcagaaaaaaaagatgaagtccaagaatttaattattcattcaatcaattaacaaatatttatggaacacctactatgtgcaagtactattccaggtgctcagaacaaagcccattgcatatggaacttgagttctgctaggggagacaaataggcagatgcatgaatatttaatatgttcttaggtaatgaaagcactatgaagagaaataaagcagagaaaggaaacttgggaataatgaatcctgctggtttctgtagatacagtagggagagggatcctctagaacgcttcacc

SEQ ID NO: 722435 - DNA, 364 bp, Homo sapiens
ggtggctcacgcctgtaatcccagctctcagggaggctaagaggcgggaggatagcttgagcccaggagttcgagacctgcctgggcaatatagcgagaccccgttctccagaaaaaggaaaaaaaaaaaaaaaaaaaaaacaaaagacaaaaaaaaaaaaaaaaaaaaaaaaaaaaaaaaaaaataaaaaaaaaaaaaaaaaaaaaaaaaaaaaaaaaaaaaaaaaaaaaaaaataaaaaaaaaaaaaaaaaaaaaaacctcgaaagaaagagaaagagaaaaatataatataaatatctacttctttattacatcgaatcatattttaaccttggggggtcttccatctccaatttcccccg

SEQ ID NO: 722436 - DNA, 159 bp, Homo sapiens
  misc_feature (56)..(56): n is a, c, g, or t
gctgttacctcctatgttttttgattcatccaccctcggtttcacttgccccaggntagacggccacgatttaccccgttgggaatacaacaatggacgaaaaattttgcacgcggtaccggcagcggccaggccatgtcagtttttttagacggctaa

SEQ ID NO: 722437 - DNA, 472 bp, Homo sapiens
atagaactgttttgcttgatactgttaatagatgaccttttagagaaattggtagctataataaatctgaacggaagaagtagtacagtagaattcagtatcataattcacaaattggaggctgttgattaatgattcatttaaggtttaaaatctttcttaatcgcacacagtgcaattatttatacttacacagtgccttcccagacctatccaccttaggttctgctgcaaaaagcaccaggtaagcacaacctaaggacatatataaataaatatttcaatacattaatgttgtccctgtgaggttttagtggttagtgtattcaaaggcaatctgctactgcttccccaacatgtatatagttatattatgctaccatcttagtggaaagtctgtaagttgttcaagcaactgtatacatatctgggtaatgtttaatattttaccttagtatgtgattaagagaag

SEQ ID NO: 722438 - DNA, 942 bp, Homo sapiens
tcggatctgatcaggactttcctttatcccatttgattgtgctgaatacactgcctgtcgcttgtcttctattcaccatggattcttctgatatccgaggtgaaagaacttggagaagctgtgccgtcatggcctacgcgcattgtctcgatgcgtgatatctcatcccttcgtgtccaaagaaagatatcttgtatccattgcaattcccccgttatctcaccctccaataggagatgaaaggatcttcccctggcagggaagttcagatgaattattagaagctggcgaagacacagtcgcccgtcccatgaagctagaggtctattgaagcagtcctggcgtagatgatacgagagcacgtaagaaagaagtgcgttcagacaggcattagaagagaacgataacttcattatagagattggcagaagagaacactagacccgagcaaaatggaggctaataatgagaaccgagttaggcacaaatgggctgccttgaactggatacgtgttgcgaatagaagtataacgcacattgaagaagtgcggaagaacaaaggaatccgggagaccctgctgcactgagactgaagctgactaatttgttctgggaactgactttctccccatccccttcttaatatccgaagactgtactggccagtgccattttatttgttccctcctgacaatttttgaagctatgtgactgttttggtgatccgatccgcctgtaccatgtggttccgggcctaaggggcacgtgacggtttcccctttctacgggggcttcaagtcgcgttcctgtgggcttcactcccctggggcggggggggggcccatttggcccgacatttgcacgactttgcctcccggggggtgttttttcccggcccccccgcggggtgtccgcgtcggaaaaacggcgcttctcgcgggt

SEQ ID NO: 722439 - DNA, 112 bp, Homo sapiens
ccggctcttatgagctttacaaggctgttatagcgcttgacaagacgctgatccaggccagagatgttaaattgaagagcatgctcttcaatttaacgcaaagttcaggaat

SEQ ID NO: 722440 - DNA, 951 bp, Homo sapiens
agcggagtccgcagccgccgccggcaccgacgcgcctcggcctcggtgcaggcagcggccgccgccggcgagacagctgcgcgggcgagcatccccgacgcagcacctaggaagtggttgacgaccatatccagctctttgccgaatacatcctatctggcactacatccagcgtgaggtccctccagtcatactacggtgggcgacctatggcggagaagtttgacgtgccacgtacatgcatgggatcccttgcaggggaagaagtatgtgcaataaggatggccaccactgtctgcctgaaatgctttgacaagttctgtgccaacacctgtgtggaaggccgcgaaggccgcaatcgtgtgcaggagcgtacctaatggtagggtgcatctcataaggaacccgcattcgtggcgtgacacactgacttaccgcatgatgccaatgtgcctgtcaaccccttggaccaattgagacctattgtgggcaaggacaacaagatcctgtgcaagcaagtgctaccacatcgggaggatctcccactcaagtgcaaggggtgctgtcaaggccgttgtggcaggagatcgaaacgtggagtacaaggggacctgtctggcacaacagtactgcattcacgctgtgagtaactgctagcgagtcatcgggactggaagcttcttcccctaaaggggaggacttctagtgcgtgacttgccatgagaccaagttgccaagcatgcgtgaagtgcaacaaggcatcacatctggaggaatccacttaccagggatcagcccgggcatgccggatggagagtgtggtacctggctctaagaagctggctgggagccggtcaccgctgtggaggaaccgcgtgacggggggatgcgccagacaacctgggccacaaacgggcgcgaggcaaaaccccaccagggctgcgaagggcc

SEQ ID NO: 722441 - DNA, 141 bp, Homo sapiens
cctttacatatagatcagtggaacaggagagaaagccagaattcaaccacgcacctacagcctactcatctacgacaaaggagacaagactatacaatggagaaaggacagctgttcaataagtggtgctggggaaaccgg

SEQ ID NO: 722442 - DNA, 190 bp, Homo sapiens
ccgcggcagtatctcgtagtctgaccactggagaaccttcagagcataatccactcccaccgtgacttgtagtgtttgctgaagctgtcctgggaatatcgccgcaccgcgggtgcaaagtgctggtggtgggggacgccgcagtgggcaagacgtcgctggtgcatgaatattcccaggacagcttaca

SEQ ID NO: 722443 - DNA, 855 bp, Homo sapiens
taggtctagacagtgtcatatttggtcatagttgcaacatgttgaacatgtgaattatagggttcatgctggtttccagattttattgttggctacgtacaatggaactttatagtcatatatacatacatatatatatatatatatatataatatctaggggggggaagtgttatatgttctctgtctctataagagagatagaatagagtagggatactttgatctagggggtcagtcgagcggagtccacctcttacagaaagacctgctctttctctgtcgtgagtctatgtgaaataataatcgggggcccttgtggaacaccctgggaaactctaggagtcgtgtgagaaataccgggttaaagcacatctccagagagatcgtgtccaaactcactattaattgtgtatacttgtggggtgccagagaaagagagttaaattatgtgtgagaaatatatgctattgatcttgggaaagggtgtaccgcgctgctgactttactaattgggagtacgaagtgagtgtgatctgaacgcttgattgtgacgaccactctcaagaagccacccagacggtgcggctccctcagacacccgacggctccgcccccccccgcaccagcggtgccattcaccacaccatggtcctccctacaaccctgccgaggcgtacgccacccgtcgaggcgcacgcaacccaccagcgggcgggcaaaaaaaacatcactcccgctcagaggctgccccagaccacaagccgcagcccccccggggaggccagacacaccagcagcagaacccaacggcgacacaccagcgacggcccccacaacacaccccaccaccac

SEQ ID NO: 722444 - DNA, 321 bp, Homo sapiens
gaatcgagctcggtaccagcaggggtggcgtgatatgggaaggctacattgtcgtcctgcgcctcgagggccatgattggacacaatccgactcggatgaggctgccccagtgaaccataagggggtgacttcacctgttcacatcagcaggaatgtcatccacgccagcgactccgtgtagtgggcccatatgagagatccaactgtggttcctaggagcagtgcgtctggtgagctgggctgactggggctcagctcgaggagcgtccacccatcctgaggcctcaagctgtcctttgcacgggtggcccctgctgcgt

SEQ ID NO: 722445 - DNA, 360 bp, Homo sapiens
tatggcttggaacagatgaatctacactagtggccttcgggaaaaatcttaccttaaaataaatttctggtagtaaaacctattcatcaccatcataagactggatatctagttcagctgtctctgctggaggagtggaagcctccaaagatttaagaagaaagctgtcggccgggtgcagtcgctcacgcctgtaatcccagaacttggggagtgcagggagggtggatcagggggtcaagagatcaagaccatccgggccaatatgtggtgaaaccccgtctctgctaaaaatacaaaaactagccgggcgtggtggcgcatgccttgtaatcccagctactcaggaggctgaggcag

SEQ ID NO: 722446 - DNA, 710 bp, Homo sapiens
agcggaagagccgggctcgggccgcaagcggggcgaggggttcggggagcggcgcggcctgggagacacagagccttcaggcgccggggcggggtgcacaggcgaagactaggcggcgccgggccccacagcagcagccgcagcccaagcgagcgcagcagcgcggtggctagccgcgggagcccccgggcagccgctcgcccgcgcaagccgccgtccgccgcgggggaagcccgttgcccgggagcaggagcgggcggaagacaacggaggggccgagcgtccgagcccactccgcgggggaccgaacgagcagcccgaaagcggcgggggccgaggacggggacaagcgacgaacgcggaggccagagaaggggaacgcccgggcccaagcccggagcacaggcggagtgcagcggaggccccttgccgttggccggtcatgccgttcccgtttgggaaaagtcttcaaaatctccaggcagaacttggtgaacgaatctgaaggagagcaatgggtggtctggaaaagcaagacattttctgattcaacaagcgggaaaagggtaacagaaggaaagtttccaaaagatctggttggccattgacctaaattccggtatgggcacaacttgacaacgcagcctcagacagaagccgtaccctcaagttggcccaggaactctatactagtgggctccttagccccg

SEQ ID NO: 722447 - DNA, 712 bp, Homo sapiens
atatgattaaaaaaaaaaaaaaaagatgggtttgggcctgccagcaccatgagtgcaggtgacccaattatagtacttggagtcctgtggctatatgtggcagattatttttttactgtgatgacttgactcttacttcaggttgaagggcatttggaacacagatttaaagtggctagattgaagttttctgtggacattgtgtcaaaagtcttaaacttaggcataggtttttcgtgaaactaccggttgtttgtgaagggtattagcattcctgtgtgtgccttgtgtgataacgtgcacacccatatagactactttattatatttattatttgtgcacgggtgtgaagtctcactcgacactctgtgttgagcacgaggctgtggagagtgtgccaagggtggatgtgcactccactagtggccaaacccattgctgtggcacctctgttggggggtttatcacaaaggacatagtctctctcacgtgagcccctcaaaccccttctcgccccagagatgaaattagcgcatgtgggggcatatataacgggtgggtatcacccccattatcaaacacaaacgcggcccgccggggcttataatataaatagtgggaatatatttaacccaatttaataaggctctctgtttggaagagatatatataactctataaggatatgtgagaatcagtgtggatatatat

SEQ ID NO: 722448 - DNA, 123 bp, Homo sapiens
ccagaacacaggtgtcgtgaaactacccctaaaagccaaattgggaaagggaaggcttcatatcaccattgttcgtcattggccacgtggatttcggccagagtccaccactactggccatct

SEQ ID NO: 722449 - DNA, 222 bp, Homo sapiens
cccttcccccccaaacaaagccctttttttggcagtcccggttttttcccccccccaaaatggtttttcccccccccccccctttttttttttggtttttacccaaaaaccccggtttttttttttttttttttccaaaatgaattgttttttttttagggcccacccatttttttttttttttttttttttaaataaaaatttttttttggttttttttta

SEQ ID NO: 722450 - DNA, 683 bp, Homo sapiens
  misc_feature (49)..(49): n is a, c, g, or t
  misc_feature (77)..(77): n is a, c, g, or t
  misc_feature (86)..(86): n is a, c, g, or t
  misc_feature (99)..(99): n is a, c, g, or t
  misc_feature (110)..(110): n is a, c, g, or t
  misc_feature (114)..(114): n is a, c, g, or t
  misc_feature (145)..(145): n is a, c, g, or t
  misc_feature (148)..(148): n is a, c, g, or t
  misc_feature (184)..(184): n is a, c, g, or t
  misc_feature (192)..(192): n is a, c, g, or t
  misc_feature (220)..(220): n is a, c, g, or t
  misc_feature (266)..(266): n is a, c, g, or t
  misc_feature (284)..(284): n is a, c, g, or t
  misc_feature (371)..(371): n is a, c, g, or t
  misc_feature (405)..(405): n is a, c, g, or t
  misc_feature (454)..(454): n is a, c, g, or t
  misc_feature (471)..(471): n is a, c, g, or t
  misc_feature (536)..(536): n is a, c, g, or t
  misc_feature (543)..(543): n is a, c, g, or t
  misc_feature (545)..(545): n is a, c, g, or t
  misc_feature (547)..(547): n is a, c, g, or t
  misc_feature (550)..(551): n is a, c, g, or t
  misc_feature (559)..(559): n is a, c, g, or t
  misc_feature (583)..(583): n is a, c, g, or t
  misc_feature (594)..(594): n is a, c, g, or t
gcttcgtttgtatacatcgtatgggcgcagcctaatgcacatcataacnttatcttttccaaagaagtgtgctaagnttctgctcncataattggtgtnattttttttgntttnttcccatttagataaatcttgtcttcagttnttnttttttgccttttcttcctcccagctttttgtactnactggtcnacatttaggaataataaattcatgaganaagaacaaattttttatggaataaataacttccaggaacaacagtntataagtattcagttgtntaaataaacacaactattttccttcctaaaatgtatacatccagtatatgacacatacatgatattccaggtatagatatcttagtnactcacttatgaaagaggtgcattttggtatgtntggtggtaaggtttttgtttatcttatgtataaaagtacattgcacaanaaaaacaagcagtaatnactatataaaattctattccttcacccagttttctcactcaagtagaaactcatgaatatctgtngattttngntntannttttattntcggaaagggctgaaatatctctnaaagtgagggnaaagtgttttcttgagactggaggcagtaatcatcacttgtgcttgaaggcattctcagcaactctctcgagtttcagagtaagcacag

SEQ ID NO: 722451 - DNA, 1123 bp, Homo sapiens
  misc_feature (743)..(743): n is a, c, g, or t
ggtggcaaaaaggatatgggtcatgaacagaaccaaggagctgcgctggctactagatgtaaccagttctgtaggcatgttatcgccacatccatgtgagccgctcccgtgtaagtctcctaactcacaatgtggccgaggatgaccttgcaaagatcatcgacattcactgcaacacgaagtgtactggccgagtgatgacgaggtccccaagttgtggagacatctcctgagcgcacgtacgattgatgcggactagactgtttctgtcttgggactttttccacagacacactcggggtggcctcagccctgtgccctgaaatttgtgctggacgtggggcatcacggaacacaggcgcgagatcgcgtcactgcccgattgtaaatttgcgaccacaagaagtcactcgcagagttgggaatgactccaggcacaattaggcgcccaaacactttgaatggcgacaaattccctggtcgtccacgaaggcgtttccatatacgactgaagctggttcaacgcctgacagcacccttggcagttttgggcaatgccccaaccaactcttgcgctcgtgtcttcggtcacgctcaatcgtacttaccacaaacgcaatggctagcacaagctgggaactgtgggcgacgcattccatatcccagtcacccatgtgcgaacagcgatcttcggaggccataactatttgtgctccagactgatcgaatgggacctccagctntcacagcgccattgtcctttaccttcaaacttgcaacaccaagaaaaccattctggaccattttttcttcactggcatttgtggaactcacggaaaattgggacaggctacaacagcaaattggcctaatagtcgtaaccacgggaacgcaatggccttcagatttggttgggaacatgtgcttgtgtgagcgttgtgccttttgagacctgggatgtttctggagcctcaatcgtggacattggacatcacaatataactttcacggaagccttgtcaacacggattattcaaaaccaacaatttggagacacaagattcgggacatcaaaaaaagattacacgacttaaaatatcgcaagaataactaggggaaaagt

SEQ ID NO: 722452 - DNA, 184 bp, Homo sapiens
  misc_feature (170)..(171): n is a, c, g, or t
ctccccttatggcgctttctttcggctgcgtgcctgaccacaaaagctggctgagttcaccttatttatctgctagcactaggcgtgcggctcccgttgctgagcggtttgctgccttcgcgttcttcgtcctcgtcatcgctgtccctggtcatagctgttcccagggnngagcgggtcggcg

SEQ ID NO: 722453 - DNA, 915 bp, Homo sapiens
gcatttaccatctcacttctaggaatactagtatatcgcgtcacacctcatatcctccctactatgcctagaaggaatagtacgtatcgctgttcatgtatagctactctcatagacccgtcaacgacccactccctcttaagccaatattgtgccgtattgcgcatactagtcctttgccgcctgcgaagacagtcggtgggcctagccctagtagatctcaagtctccgaaccacaataatggcctagactacgtacataacctagaaccgtactccaatgctaaaagctaagtcggtcccgaacaagttatattacgtagcactgagatgactttccaaagaacacacataatttgaatcaacagaaccacccacacgcctaatgtattgagcaatctattcccgcctactattttagtttaagcccaatagtcaaactaagcaacgctgatttaggctgttcgcccaaagcctttgtcgctcgcggacaccctcgtaatcgaaagcccccgcatccgtaaaggacttgaacttagctggaacttccgtacccctcgtcaaaagatcactggcaacaagccgaggggccacactttatcccaggtgaagcccatgtattgacgcaatcaacaacttctaaccatctactattacataagttcatccccatacagagagtctccctataaacttagtacggattcaggcagcgccactaggaacgctcacatcacgagttattagtaatcctatcttccgaaaaagcagacgaaataagtaacccaattttggggttagtaagtcacacccggaaggagggcaaagcacagtgccatgaaacacgctgtggagacggcacgaggagcacttaggtcctgtattcaaacacccttagatagggttccctgttcc

SEQ ID NO: 722454 - DNA, 848 bp, Homo sapiens
  misc_feature (131)..(131): n is a, c, g, or t
gaatttaaaaacctttgcagaagctttgactgtttgtgacacagcgatattctcacatggaggccaatgtccgcttgaaggatgcgcctcgcaatcacggtactagaaacataactagtatggccacaagntgttaacgtcttttgacagtcacgggcaggacttcatggttatggcaacgcgaaggtcatggttcataattcacggagtgaaccgccctggagataatggcatggtcccctcaatggaggatgacccacatgatagtgggaatgatcgatgtgaggctagtatgaacatcatgtgagggaagagaatctctgatggaatcggacataggttattgttgtcaagaataatcttttcaaatgcctgatacgctgtggtacgccaaagatagaagggtggtacttggtgattgtaagaacagaagggatatggtaacgaagagctagcatgtatctattgaaatgcgaatggtagattaatggcaagagattggctcagaaaagtagatgagctgtctatggatggtaggatgggttttagagtagaaagaagggagaaaatcataacggttgtacaaggaggaaggggagtggaacactgccgagtgtatcctgagtatatttgttatactggtggagtcttgggagccatagtaatgtttctcattgccccccaaaataaattaaaagtcaaagcagggatatgaggcaggagttcaaaattgaatttaggaaactgtaggcaaatgacagttaaactggtatttcagatgcataattagaagcacattgaatgatgtgcgaaaaaaataaaaatttatagatttggaggggaacata

SEQ ID NO: 722455 - DNA, 492 bp, Homo sapiens
  misc_feature (17)..(17): n is a, c, g, or t
  misc_feature (46)..(46): n is a, c, g, or t
  misc_feature (60)..(60): n is a, c, g, or t
  misc_feature (63)..(63): n is a, c, g, or t
  misc_feature (71)..(71): n is a, c, g, or t
  misc_feature (82)..(82): n is a, c, g, or t
  misc_feature (87)..(87): n is a, c, g, or t
  misc_feature (90)..(90): n is a, c, g, or t
  misc_feature (92)..(92): n is a, c, g, or t
  misc_feature (103)..(103): n is a, c, g, or t
  misc_feature (129)..(129): n is a, c, g, or t
  misc_feature (133)..(133): n is a, c, g, or t
  misc_feature (138)..(138): n is a, c, g, or t
  misc_feature (142)..(142): n is a, c, g, or t
  misc_feature (144)..(144): n is a, c, g, or t
  misc_feature (151)..(151): n is a, c, g, or t
  misc_feature (162)..(163): n is a, c, g, or t
  misc_feature (167)..(168): n is a, c, g, or t
  misc_feature (189)..(189): n is a, c, g, or t
  misc_feature (194)..(197): n is a, c, g, or t
  misc_feature (207)..(207): n is a, c, g, or t
  misc_feature (209)..(209): n is a, c, g, or t
  misc_feature (223)..(224): n is a, c, g, or t
  misc_feature (235)..(235): n is a, c, g, or t
  misc_feature (245)..(246): n is a, c, g, or t
  misc_feature (269)..(270): n is a, c, g, or t
  misc_feature (329)..(329): n is a, c, g, or t
  misc_feature (359)..(360): n is a, c, g, or t
  misc_feature (370)..(370): n is a, c, g, or t
  misc_feature (372)..(372): n is a, c, g, or t
  misc_feature (375)..(375): n is a, c, g, or t
  misc_feature (377)..(377): n is a, c, g, or t
  misc_feature (380)..(380): n is a, c, g, or t
  misc_feature (383)..(383): n is a, c, g, or t
  misc_feature (389)..(389): n is a, c, g, or t
  misc_feature (392)..(392): n is a, c, g, or t
  misc_feature (481)..(481): n is a, c, g, or t
atctgtgggtacccggngcacggagatctcgccggctttacgttcncctcggtgtctgcngcnccctccgnttcctctcctnggcgncgngnccccgtggctngacgttccccctgtatcttctcccgntccntgccngggngntctttgnctctcgcgggnntccnnctgttgaggttgatctcttcncctcnnnnggtctcttcngngctgactagtgccnngtggtgcttcncctggtctcnntacggccctagcgctccgggccnntgatcacgcctcgctctcatggggccgggtgtatccccggctgttgcgaccctccctcnccctcttgcgcctgccctggttcgcccgcnnctgcccgtcncngcncncgngcngcttgnccncctgctagctcgcacaggcatggccccgcccatccatctacgtttggtgcgcccgcccttctgggggtgtcccttgccgtctgcccacnggtgccgttgc

SEQ ID NO: 722456 - DNA, 216 bp, Homo sapiens
tgactcgtctctgtatttgtattaagccttaacacttttcttaagtgcattcggtgccaacattttttagagctgtaccaaaacaaaacgctcctatcaaaatgacattgtgatgtgagtacaggctttttgataggagcgttttgttatttttacaaggcagaatggggtgtaacagttgaattaaacttagcaatcacgtgctcaaaaaaaaaa

SEQ ID NO: 722457 - DNA, 101 bp, Homo sapiens
  misc_feature (5)..(5): n is a, c, g, or t
gctgnctagagttcccagtggcatgaatccacccagactataaccgaagtccgagccagacaggtgaatgacgctgatgagcgacttcagcaaggcgatgg

SEQ ID NO: 722458 - DNA, 415 bp, Homo sapiens
  misc_feature (134)..(134): n is a, c, g, or t
taattaaataagggcgggtattggcgtctggcggccatttgggcgcggttgggcagcgggttcaaccagggcagcaaggtaacagcagaacggtaagtattgtatattaccaacatatagggcatagggttaangcaacggtatacacaggcggtgcgcaagcacaggcggcggcaagcaaagccaacacgtggagtgcgtggggcgaaggcagataaagcgcaacgtacgggttgttgcacactcctacgcttttctgttgtggttttactaccccgtatgcgtttcagctatcctggcttcgcacctgggctagcatacttggcaactttacccttatctactatattcgctccacctttctttagtctgacgcttgggatctcccacacacacgctctgcgagtagtatgct

SEQ ID NO: 722459 - DNA, 275 bp, Homo sapiens
gtgcgacgttgtggctcatggttggccctcaagggattttagctgttagtattataatataaatggattggaagggcagcctattgtggaaggatatacgtcctttaaaagcctaataggtctggcacctggattttaaggatgaaggccggttgggcgcggtggctcacgcctgtattcccaggacttttggaggccagggcaggtggttcacgagttcaagagttcgagaccatcctggccaccatggtgaaccctttctctactaaatttcc

SEQ ID NO: 722460 - DNA, 283 bp, Homo sapiens
cttagactctgtaacgacaaaattaaccaagttcttaagaacagggtttcagtatttattacttcacggttagaacatgaagttctaacgaactgtttctcccaaggttttaaaagcgtcaagttattctgtttgataaaaaaataagaagcctgtttaagcaatagattttgcttgtgttttcttatttaaaaacataatactgtgcagacaaggcactgtaaaagttttaattccttccagaggaaccatgtgaagaatttaaatttgacgcttcgatcaa

SEQ ID NO: 722461 - DNA, 143 bp, Homo sapiens
tggcaggcatgttagcgcactaaaatgaggttgggggtaatgctaacgtcacctcacaggatggcacggggactgttattcgcaagctggttttctagaactgttagctggaaccatggtgagcaccatttctggacgccccc

SEQ ID NO: 722462 - DNA, 245 bp, Homo sapiens
tccccggaatagccgacaggctcatgcaacaatgagtagacatggaggtggcactggaaacgtggcttggtgcccttggcgggggcgggaggactaaatggggccatgctgtggacacagcgggtccaaatggaagtatctgcagtgtacatacatggagggttggagagaggcatacttttcccctaggttgtgcctggtgacaagagagaggggaagtacatgttggcactgtctgttgccag

SEQ ID NO: 722463 - DNA, 308 bp, Homo sapiens
  misc_feature (20)..(20): n is a, c, g, or t
  misc_feature (171)..(171): n is a, c, g, or t
cctgggcaacagcagcaagnacttcgtctcaaaaaaaaaaaaagaaaaaaaaatattgtagtcctatcactcatgcacacagaggtgacaattaagcatcttgttgcttctcccttgtgagtacacaaccaactatcaccaggcttttggagaaaacttcttaacaagaanaagatcaaaagaagcaaaaggacctcaacagaagcagaaaattcaaccattgacaaaactatgatataatattcttggtgagatgagaggagattttgcacctgtggaaacagtgctatttaaaagacattttagcc

SEQ ID NO: 722464 - DNA, 161 bp, Homo sapiens
agctcatgaccaggtgcagacagacacagaacacatcaacagaattgtttgatggttcccaggagagagctgctgctctttctgctgaagctctgggagctggcacggctgtaggacttccttttcttagctgtgccagctcccagagcttcagcagaaag

SEQ ID NO: 722465 - DNA, 195 bp, Homo sapiens
aggcgctcgtgggggcagtataagcttccttaggcttttcttaggaatgaaattcctcctatccccccatctcttagtggacggtaagcccaccaatctgccctttgcagtgtgctgggtggaaggtaagaggttggtgtggagttggggctgccatagggtctgcagcctgctgggtgtcactgtggggcaagg

SEQ ID NO: 722466 - DNA, 148 bp, Homo sapiens
gagatgagacgagatgtacaagagaagagacgagatggagctttaatttattaatgcaaacagtacctaacaaacccacaggtctaaactaccaaacctgcattaataaattaaagctccatagggtcatctcgtctcttctcttgta

SEQ ID NO: 722467 - DNA, 166 bp, Homo sapiens
gcgaggtcccggctgtgctttggcttgtgctgccgttcagggcaaggtcgagacacaagggcttggatgagatgtcgggtactggcggtcctcttcctgtaagccctgaggcgcatcggcgcgtggctttccccagcttggcctgggccacacaagttccaccatt

SEQ ID NO: 722468 - DNA, 771 bp, Homo sapiens
gccctaacaggcacagagagcagggcaactcctggcacacatcatgggcttggaggcacacaagcctggattcgaatctgggctctttcacatactagctgtgaccctggacaaagagctttaacctgctgagtccccattttctcatctgtgaaatggagatgataacactgtgtcttaggttggcattctaggtcacatgaaaggtgtgtggaaagtggccagcattctgcctgcagaccctgagcactgagtcaacaaggttgtgatgatgtctgtactagttagctattgttattaacaagatctccatgggcagaccagctaaagacgttctgtgctatagtcgtgagatctgtgggtggggtcagcgtgtagactgcatgcatggttgggtggtggttggcaagaatctcctaataggaattatcggatcaaagtcatattcgtttacttcttcggctggtgggctacccaagagcgagcacgctttctctccgtggtcatgccaagaaccacaggagggtgagtctaacaagcacacctcaagcctcctgcttgggtcacattgccaaatgtcctctcagccatacaagtggcaggaccaggcccatattaaggaggtggaaaaagggtaaggctgccttggtgaagctgtgaccagggagtgacatcatccctccacaggaggtgaggattgggacagcgtatccagcaatactggtccataattttcaaatgggagtttgatcggggataaaacgtccaaac

SEQ ID NO: 722469 - DNA, 203 bp, Homo sapiens
tatgaccatactgataaccgagatagtcttcaaagacatctgcataggctggcatgaacccggccatgtcccgagaaagcatggagtcaaaggtaggtcgaggagggacatctgtagagtgaaatggaatggctgtgtcagcagatttcgcttcctctgcttgtttcaggttcagcagggaagatgtaaacagagttctattg

SEQ ID NO: 722470 - DNA, 166 bp, Homo sapiens
  misc_feature (60)..(60): n is a, c, g, or t
acgcctttgctttgtgacggcggtattgcttccactactacttcattgaggcattgcacnccactgctgcaggagtcatgaaggatcactgggacaacctggagttcttactggctggatctggaggctgcacctactcaggcattgacgccgtcccacagcacag

SEQ ID NO: 722471 - DNA, 805 bp, Homo sapiens
gaggatgtcgagttgcgctggtgtggggggcgggtgcgagggccggctgatgcttgtgcagatggtgaggcgaccagtggcttgcgtctgcttcacgactccttccttcttccttctccctgcgaggcgcgtgaaggttgtgcaaacccggattggggtctgtccagcagcgctgggtccgaggatcatgcaatgcatgctcgtcaccataattggaccgacttggtcaaagacatgaagatcaagtctcctggtagttgagatctatctcttcttccctgcccgattaaggaatcagcagatcattgatttcttcctgggtggcctctctcaaggatgaaggtgtgaagattatgccagtgcataaagcagacccgtgccggtcagctgcaccaggttcaacggcgatattgtatgcatatcgaggactacaatggccagcggtccggactagggtgttaatgtggctccaatggaaggtgggccaaccgcatccgtgggggccatctatcctgggccaagcctctccatcgtccccgtgcgcagaggctaactggggggaacaaagatcggcaagcccccacactggtccccttgcaaggtgacaggccgttgcggctctgtgcttggtacgcctcatccctgcacccagggcactggcatcgtctccgcacctgttgcctaagaagctgctcatgatggcttggaatcgatgacttgtacacctcagcccggggctgcactgcaaccctgggcaacttcgccaagccacctttgatgccatttctagaacctacaggtaccg

SEQ ID NO: 722472 - DNA, 1016 bp, Homo sapiens
  misc_feature (9)..(9): n is a, c, g, or t
  misc_feature (485)..(485): n is a, c, g, or t
  misc_feature (499)..(499): n is a, c, g, or t
  misc_feature (503)..(504): n is a, c, g, or t
  misc_feature (512)..(512): n is a, c, g, or t
  misc_feature (515)..(515): n is a, c, g, or t
  misc_feature (517)..(517): n is a, c, g, or t
  misc_feature (519)..(519): n is a, c, g, or t
  misc_feature (528)..(528): n is a, c, g, or t
  misc_feature (548)..(548): n is a, c, g, or t
  misc_feature (552)..(552): n is a, c, g, or t
  misc_feature (555)..(555): n is a, c, g, or t
  misc_feature (578)..(578): n is a, c, g, or t
  misc_feature (611)..(611): n is a, c, g, or t
  misc_feature (650)..(650): n is a, c, g, or t
  misc_feature (657)..(657): n is a, c, g, or t
  misc_feature (774)..(774): n is a, c, g, or t
  misc_feature (794)..(794): n is a, c, g, or t
  misc_feature (799)..(799): n is a, c, g, or t
  misc_feature (814)..(814): n is a, c, g, or t
  misc_feature (818)..(818): n is a, c, g, or t
  misc_feature (873)..(873): n is a, c, g, or t
  misc_feature (885)..(885): n is a, c, g, or t
  misc_feature (891)..(891): n is a, c, g, or t
  misc_feature (933)..(933): n is a, c, g, or t
  misc_feature (997)..(997): n is a, c, g, or t
tgcctaatnatttcaagatactttattttaaaaacaggtcacaacactaagcttttggcccattctgccattgtacaagctacaaatgcttgttcagcagctgaggggcactcttgagtagcgtgtctgaagagtgaataaaaatccatataaaacaaatattcaaatagtttccataggaacacagataagtgtgacccatatcctagtcttccatatggctgcatcatggcgaccctactcttacaaagacatttcaaaactagcagtaattaagttacatggtccccccaaatcccttaattcaagctaaacttgcagttaacagctaccagagtgctatctacacattaatactagccgaagcacaggctgctctgtggcgtttcatcccactctcccaggcacaagaaacagggggggtgctggcatcctgttcctctacttggggtgggtaagtgggggttttggaattgctgcatganttgccacgcaggcnctgnnatcacatngtngntngtgggcctntggaagccattgaacgtagnggcngcngcgacagtgtgagcgcccatgtnttcaaagagcatccaataacccaaatgcatttnagggaggtaaaagcgctgaaaaattcgatggagggcatnaaatgtnggtccccatatgctggatgaataatacttctgatctggtttaggtctcttttgcagaaggggctttacatgtccgttgtcatagagtatgccattaaatgatccatagacgccatcnttcacataatacataaaggnctgcncactcgactcacctncgtnatcagagcccgtttgtccctttaatacaattttcttggcaatgatattaactgcnagcgtgaaagcngatgcnacacagtatctgccgggctcagctatgattctcactccagantctgaaggaaagtatttgtccaccgctgggttgattacgccggtgatctcttcaaatttaagtntcacatcctcagatccagg

SEQ ID NO: 722473 - DNA, 1022 bp, Homo sapiens
  misc_feature (9)..(9): n is a, c, g, or t
tgcctaatnatttcaagatactttattttaaaaacaggtcacaacactaagcttttggcccattctgccattgtacaagctacaaatgcttgttcagcagctgaggggcactcttgagtagcgtgtctgaagagtgaataaaaatccatataaaacaaatattcaaatagtttccataggaaacacgagtatataaggtgtgtgacccatatattcctatagatctcttctccaaatagtgggcgtgccattcccgtggcgcgaaccctatacctctttacaaagaacatttctcaaaaaactatagccgagagtaattataaagtctttacaccatggtgtgtcgtctcccctcacccaagagaatctcctcgccttttttaaaacttctcaaaagggccataagaaaacctcgttgtggcgcagaagaagttataaacccagaggcgctataaccccccaagagaagatgtggcctcttatcatctcataagcgcagccccatttattaagaagatgcatccgtattaagcggccccggagaagaggcgccacacaggaaggagggagcctgttggagcactaccggatggaggggacgaggcaggatgtttttcctccgaattccttccccgcccgcaacttcttcctactttccgcgcaccgaaggaagtgcgcacccaaccggaacaaaggaagcaaacccacagacagaagggaagatgcctaacagaaggaggacaggctggcacgcagagtggatgggcgcctatatgttttccaccctggatgaggtagattaataccacccctgctttcctcatttcaatgcctagtttcatttaggaaggggaggtggatacggattggtagagatagaaaaaaagaaaaggtgatattacggtatgggagggtatggtagtgtcgattttgattccctatatagttgaaggggaaggtaaaaacagatagattggtagggctggatgccgacgaatctatagagaacagtttacgttggc

SEQ ID NO: 722474 - DNA, 232 bp, Homo sapiens
cggctttctctacgactgactcaccctaggtggacacgctaccgtccagactcacgtcccacggacacgacactgggcgacggactggacttcttgggttgacgtaccgttctgacttacgaactacggaccgtctccccaccccacgccctggccaagaacgtgcactcacattggaacgtttgccccggggcatgcacgactttactgctgccacttgaaaacgcacggt

SEQ ID NO: 722475 - DNA, 517 bp, Homo sapiens
  misc_feature (9)..(9): n is a, c, g, or t
  misc_feature (409)..(409): n is a, c, g, or t
  misc_feature (420)..(420): n is a, c, g, or t
  misc_feature (422)..(422): n is a, c, g, or t
  misc_feature (464)..(464): n is a, c, g, or t
  misc_feature (471)..(471): n is a, c, g, or t
  misc_feature (478)..(478): n is a, c, g, or t
  misc_feature (492)..(492): n is a, c, g, or t
  misc_feature (495)..(496): n is a, c, g, or t
  misc_feature (501)..(501): n is a, c, g, or t
  misc_feature (512)..(512): n is a, c, g, or t
  misc_feature (517)..(517): n is a, c, g, or t
tgcctaatnatttcaagatactttattttaaaaacaggtcacaacactaagcttttggcccattctgccattgtacaagctacaaatgcttgttcagcagctgaggggcactcttgagtagcgtgtctgaagagtgaataaaaatccatataaaacaaatattcaaatagtttccataggaacacagataagtgtgacccatatcctagtcttccatatggctgcatcatggcgaccctactcttacaaagacatttcaaaactagcagtaattaagttacatggtccccccaaatcccttaattcaagctaaacttgcagttaacagctaccagagtgctatctacacattaatactagccgaagcacaggctgctctgtggcgtttcatcccactctcccacccacnacacacacgcncnctcctcccatcctcttcctctacttcccctcccaactcaccnttctccnattcctncctcacttcccacncannccctnacatcacatantacan

SEQ ID NO: 722476 - DNA, 103 bp, Homo sapiens
ttgtgcgtcccagcgatctggtgaggaggctgttgggtctccccgcagcagagagaatggtctttaagggcattttggccaggttgctggtccaggttgtgct

SEQ ID NO: 722477 - DNA, 680 bp, Homo sapiens
tgtttccttctcagtatagtccgcataataggggttaattacgatcacagatcaggttggtcttcaaggtcccaaggcataccttttcctcataaaggaagaatcactgtggtccatggactcatgagctcgttggtgacgtgagtcaaagggttctttttaatcacctagataatcgtgagatacaccatgaggtcctcggtctcttcagacagtgagcgctccacagactcaggtatctttgacctctccagtgtcgggttctcattagtgtgttcattccagagttagataacaggtcgtgtaaggctcagctccccacgttcgtgcacgtgctggtcacagtatccgtagaacacttctgggaccttgagcttctacagcaagctgtcccaggtcacaggttcagggtgcacctgggcaatgtggtagaagcgcgtattaggagcctgcgaattcctatgggtcaggtgcaacataggccactttgactttgtaatccaacaaagtctgggcaaacatagccagggacaggtgtgtcttcagtagtagtgggaccggtgtgtctctcagagtctccatccatgagggaatcactggggctttgatctcgcgcaagctctcccgcatacagatgtgagctcggtcatatctctacaggtcgccacaggggtagctct

SEQ ID NO: 722478 - DNA, 984 bp, Homo sapiens
  misc_feature (29)..(29): n is a, c, g, or t
ccagaatcgacgaacgatctagagagganagtaagacgacgaaggtgttacactggtcacaacgattgttgcagccgtttcatggacactccggcgccttccacaattttccgcggcacagtgcgggttatacccagcggttcctccctggcggtttcggaacctctgggcctcgcccggatactttttttggaggcaccccacaggaatacttgtggtcttcgataaccacggagcctacttcccaagagcgccccacctggaaaactggcgccgacaaccacaaggtttttttctgagagcgacacccattgtctgattgctcccccccggcgtttaatccgcgggtgttgccggcccccagttccctgccgggtatctactatcccctgtccacaaggcagttgttcgccacaagaccacccgcgaacccccccgggaatgactgacaaatctctagttccccggaactttttaaaacgcgttctcttctaaggccacaccctggctttgcacacccccataaaacaaaggttctctccttgagaggtcgggctaggcccccgacaactatcaccacgtgggagacaacagacgctgtaatcacacaagaatacgcgtgcaaataaatcagcgcggtaaaaatatatgcaaagcgctctgagactcttggtacactctcttactgcatattcgtggagcagtgacccccaccccgcttacaccattacatcaggaataaatatagtattttcatcgagaaaaaaatcttgtaaaagtacaatattctcccagtcatgacaaacatgcgccagcagaaagtaacatacaggagcaacataaagaagacgcgtatatcacccacctgcgggtaaatctggaaaaaggacattttgttcccgaaacacctggtggtgatgaaaaacccccccttccaaggttccaaaaaaccaagtaaaaaaaatttccaacctttaacaaaaa

SEQ ID NO: 722479 - DNA, 826 bp, Homo sapiens
ggtcactgctcaacaatgccataaagggaggagtagaagatgaagtgagcctctccgcctatatcaccatcgcgcttctggagattccgtctcacagtcactcaccctgtcgtccgcaaaggcgctgtcattgcctggagtcagcctggaagacagtcgacaagaaggggtaccagtggcagccatgtatataccaaagcgctgctggcctatgcttttgcccatggccaggtacaccaggacgaacgaggacacggaagtatctcaagtcaccttaatgaggaagctgtgaagatagacaacgctgtccatgtgggagcgccctcatgaaacccagggcacctagtgcggcatatttacggaaccccaggactccctctgctgaggtggagatgacatcctagtgctccgtcgcttatctcacggcctgccagaccacaagctcggaggacctgacctctgcaaccgacatcgtgaagtgatcacgaagcatcagaatgcccagggcggtttctcctccatccagtgcacagtgggtggctctccatgctctgtcccagtctggggcagcacgtttagccggactgtgacgctgccaggtgcttcccggctcagggcttgtccagtacttccagtgggagaggaccgctgttctgcgcagtcatggcagctgctgggaacaccgccgtagacgagcgggttcccgcaccttggattcccgggagctgctgggcccgcgtggggcacccacctcttctgcgcctttcgctttcttcactctgggggttattttttccttccttgcggcagcccactacgcgcgcgg

SEQ ID NO: 722480 - DNA, 202 bp, Homo sapiens
gcacgagctctctctctctctctctctccttatctctacaaaacattgataaaaattaactgggtgtgggggcacatgcctattgacccagctatttggaaggctaaagagggaggattgcttgggcctgggagggcgaggctacagtgagccgtgattgtgccactgcactgcaacctgggcgacagagagatcctgcctc

SEQ ID NO: 722481 - DNA, 466 bp, Homo sapiens
  misc_feature (147)..(147): n is a, c, g, or t
agtgtgctagcatgacatgcgtctggcgcgctggtgcccaagagtagcgtctacagcctgtagacagtgaggtcagtaggcatggtgtgtcccatgaagcgaaaggcaaatctcaatgggattccaatttggcacacttcagcctgncgtctgtgcaaattccgtcgaaccgagagttaacaaaaagacgtcgcccggtccgttgtcaaacccccggcacgaccgattctagacacgaagaatcgcaggaacttggacagtctactaggaacagaggttcaatattctaacttcgggacactatcccttcaaatttcacaaacaccccaacgggaggcaacggtttcccccaaaacacggggccctggaacggacccttccccgggaaacttcaacttttgcgagaaaaaaactttttaaaacccagggccccaccagacacacgggaacagcccacccattgggc

SEQ ID NO: 722482 - DNA, 708 bp, Homo sapiens
  misc_feature (587)..(587): n is a, c, g, or t
cggggtgaccgtcactgacacctggacagtcctcgttgtgttcggggtgggaagcccacggtgagtctggggacccaagatcttattttcctttctgtcacccccgcttggttttggattccatgacagctggacccggcttctgcgtgatcttcagagggaaggcaccaggagtggactgcgggacacccagagtggactgcaggaggacacagaagctaggctgaagcgggaggaagctgggaaccctgcacggggccactgcgcactgggactcgttactggtccccaagactcagggagaatgggtgagttgaactggcaaggaggagcccactgtcattacgggcctctggaatcccggcaggaggagattaaccacatggacattcgaggtggcagagagagctgcctagagaaggtgcgggggcagcagccagctgaggcagagcccggagggttggtgcaggagcgtctgtagtggagggccatcccccaggctcaaattcctcccataggagattttagccctagtggagctgttgtatgtgatctttgtggggtggtcttgcccatcagatggggcnagtctgaccgagcatgcttggtctgtggctctccaggcccggctggcacgctgttgcggcagtccggttgcctgggggctgcgctagcttggctgcaacctgctgatgtggaccccggcgc

SEQ ID NO: 722483 - DNA, 120 bp, Homo sapiens
  misc_feature (59)..(59): n is a, c, g, or t
taaccagcaggtggccttaggggctgtgaggcagtggggaccttatagatgaaagaaancgtctttgcgttacacccgagtctgactctcggatcagggagctcaccttctgcgacgtgt

SEQ ID NO: 722484 - DNA, 179 bp, Homo sapiens
tatcccgcattgccccataggctatttttgtgtgtattttagatagagacagtgtcttaccatgcttagccaggatggtctcgatctcctgacctcgtgatcctgcccgcctcagcctcccaagtagctgggattacaggtgcagtagagcctgggcaacaagagtgaaactgcctctc

SEQ ID NO: 722485 - DNA, 391 bp, Homo sapiens
cgtatctcatggaatgactaactctgggagatcccgccttacggctcttatgaggaaaagcctggtttttcggtacttgtggcaaggcctttggtacagaagctccccaagtccccagagtggtagcctcaaactcctgggctcaatgcaatcctcctggctcagcctcctgagtagctgggactactggcgtgcacaatcagacctggctcatatatttgatttgatctaatattggtagagacagcatcttgctatgtagcccaggctgatctcgaactcctgtcctcaagtgatcctcccacctcggcctcccaaaaggctgggattacgggtgtgagccactgcacctggcctctggcaattcttatggtaaccaggtcatgtggtt

SEQ ID NO: 722486 - DNA, 200 bp, Homo sapiens
catccccccttctgcccgctccttctgccagctctcgcactctgttcttccgccgtctccggccgctcgtcgtctctctgcccgggcgcaatgcaagaagagattgccgcgctgggtcattagacgactgagctccggacactgtgcaaagctcggttttggctagaggacgacgactccccgcatccgtgtttcctgga

SEQ ID NO: 722487 - DNA, 134 bp, Homo sapiens
  misc_feature (89)..(89): n is a, c, g, or t
agccatcttttgcatttgttcctcattccgcctcctttgctcggcgcaggccggccttccgccgcggggccttccttccggccggccgnggaaccttccggcaggctttattcggccaagagtcccttaaacct

SEQ ID NO: 722488 - DNA, 620 bp, Homo sapiens
gagcggggtgccagccgccagtggtcgcacttgagagggtctcgccggcagctggaaggagccaccgcgccccggccgatcatggccgagggagctggtcttagagaggtgtgatctggagcgtggagaccaaatgggcgagaccaccacacggacaaccagtgccgggagaagctgcgtggtgcgacgggggccgagcccatgtcgtggcatgagcccgtggcaacttggagggccgtcaactacggaggactcagtgtgaggacaggtgctgcaccattcaggtggtcgatgaccggtgccagacgcctatgccaggaggccgaggatcaaggagcgcaagatttgaccagctaccggagagtgactgatgagacggagagggtgaactggaacaggccaccgaaggttggaacctagggcagagatctgacatgcctctcggctgggcaggctgcgaagcacgcccggccagagcggtcgctcccatgcggagcctgtatgcgggctgcagacgctgggagggtgctgccgactggtgacttagcgcagggacattccttgcctgtttggtgctgggggcccacttccaattgtgtggctacttgcaaacggcctgg

SEQ ID NO: 722489 - DNA, 1222 bp, Homo sapiens
cttgtacaggtaggcttgccttagacatgtccacagctgcctaggtaagaaagactacacaggagactatgcccagaagatgcccacaatggaaaattaccattacccatgagacatgcgcagtaaggggaacaaagccatatggagtaatctcaagctaagggcctgcatgcacactggtgaggataagggtagaactaccagaaattcatgctattatgcaaagtgagatgccctagcaactacatcaatattcttgacaagagagcctctgatatatcaactgtgaaatggcgacactactatatagggccccctctatggcagaggggagctttctatgtatcactataaaaaaatataagagctccaaggctacagcgttaggggtaccatgctccttaatgaatctacggtctatgagacaaagaactctcaggtgataacctcgggcaatgcagagactagctacattgtggtcgcatatggtgagactgtaaaatatcagagtgatagctgaatagccccaacataagaaaagatgcttatggagaaagaagaacaaacccttgatgatcagactggatccttataatagtaagcaaagatgactcaaatactacaactatccagaactccatgatacattggctgtgtcaactaatgaagtagcatctagactgtgtggagcactaatcaggcaacattaagaagaaagaaagtgaaggcgtgccacgtaccaagagtaagaccaagagggcaagagaggacacatatgtacacgaggagctccaaatggagcaggacaaagaacagcaaaaacaaaaccggcggcgaatcaccaatatagaaaacaaaacatgaaacccagagaaggcaagcaacaataaataagaacaggacgcgcaccgaacgcacagcacgaaacacaacaccagaaggcacgccaaagacagacaaaaccgaaaaagaggacaaaggagaaaaagaaaaaaaaaagaaacaaagagagtacacaacagagcgaggaaagacaaaaggaaggagaacaaaagagagaccagcgaaggcgacgaggcgacgaaagcgagaaaagagagcaggacgacaaggagacaagagaacaggaagacgacaacagaaacaaaaagaagacaacccaagacacaacagagaagagaaaaagaaaagaggacaacgaaaccaaagacaggcaaaacaa

SEQ ID NO: 722490 - DNA, 201 bp, Homo sapiens
aaaggggggttattagcacggaagccccaccctgccaccaggttggctggggacagggatcaatccaccaggctcgggaggcttggggtggggcagggaagtcttcctccatccctcaaatttagggaaccactgggagccccagactcaggctgaaaatgtctttctgcaaatataaaactctttttaatgaataaaaaa

SEQ ID NO: 722491 - DNA, 108 bp, Homo sapiens
gccggtccgggttgactggaatgacatgctcggagctcccctgtggtcatcgacgcctccactgccattggtgcaccatccaacctgcgtttcctggccaccacaccc

SEQ ID NO: 722492 - DNA, 100 bp, Homo sapiens
tgctgggattacaggtgtgagccactgcagccagccagttaggacaatttccggtgacaccaatcagcgacagtgaggctgggggtacccgagctcgaat

SEQ ID NO: 722493 - DNA, 253 bp, Homo sapiens
ttgcacgagatctgagtcacatactctgaacatcaatgtcactgatagggaggagacctgtgatatatactagagaatatacaccgctggtgttccattagagtgcgagagaccaaaccaagctttgggctaaccttaaatatgaaaggtggttctcaaggttcgcttaggtctttgttgctgccatatgatgagagtggggcctgagtgataaggagaacgtggatgtggttcacaagttcttggcatgttg

SEQ ID NO: 722494 - DNA, 374 bp, Homo sapiens
  misc_feature (45)..(45): n is a, c, g, or t
  misc_feature (58)..(58): n is a, c, g, or t
  misc_feature (80)..(80): n is a, c, g, or t
  misc_feature (91)..(91): n is a, c, g, or t
  misc_feature (126)..(126): n is a, c, g, or t
  misc_feature (167)..(167): n is a, c, g, or t
  misc_feature (267)..(267): n is a, c, g, or t
  misc_feature (272)..(272): n is a, c, g, or t
  misc_feature (300)..(300): n is a, c, g, or t
  misc_feature (320)..(320): n is a, c, g, or t
ggatgtgactgtgcccctgcccagcttcccccacctcccccatgnctgccacccccgnactgtgcgctgcaccgaccggncccttcgaggnacctgctcttaggttcagaagcgaacctcacgtgncacactgaccggcctgaggagatgcctctggtgccaccttncacctgggacggccctcaagtgggaagaggcgctgttcaaggaccacctgaggcgtgacctctgtgggctgctacagcgtgtccagtgtcctgcctgggntgtgnccagccatggaaccatggggagaccttnacctgcactgctgcccaccncgagttgaagaccccactaaccgccaacattacaaaatccggaaacacatttcg

SEQ ID NO: 722495 - DNA, 186 bp, Homo sapiens
ctcatagagtctgtaacagagcaatggactcttctagcttaagcacccctacgccacaggaaggaaagccacgaagacggcagaagtcacaccctcatgacaaagtaggcacaagtctacacataagctaaatcagaatttacaaatcacaagtgtcccgaggtagccattgcactcccggtcatt

SEQ ID NO: 722496 - DNA, 229 bp, Homo sapiens
tggcctccccaacactctttacaaacaaaatgatgttctatgggcaggttttttgggctccctctcttcccgtcagagtccccgggctgtttgaattcaggactgggaccactggcccttgggaagcttgtggacgccatctcctgtggctgggcatcttcccccttcatctggtgtcgggtcgcggaggtgctttcagagtacttagcaggatcagtgttgggcgata

SEQ ID NO: 722497 - DNA, 895 bp, Homo sapiens
gtcttggcacttccatcctctcccacttccatctggcatcccacgcgtggtccccgtgcacttctggagggcacagggtgctgtgcatcccgtgtcttgtgccttgtgctgcgccttctggtgcaaggacgctcagcctcagggctcacgaaggtgcccagtcgcggtccccaggtccccttgtccctttccacagagggcttcctagaagattgcatctagaagtgtccaggcctttatcacggtgttcagcgatttctccttcccactctctcccactttttcgggagacaggaagtcttccagcgtcttctccgcccaggggccttggagggttgcacgcgggaagcggactctgtggcatccagtgcaaacctttcggccttccgtgggttcacaaaaggcgatctcttcgttgccctacaggcccttcgggagatcagccttggggcatttggcaagggcaccccggacaaacaccaagcggcctggctcaatttcctcccgtcatttccaaaggtcagaagcacggggcgattcacaccccacggtcggcccacgcgccgtcgctcctcagcaactccctcgaacctcaaggtggtggcataccaaacctgtgccatcaggcaaagtggctagcgaattaccacggcgcgtcggcagcacacaacgcacaaggcccaaagatagatcgttctaaaacaggtacagctttcctggccggcatttgaaactaccgcggccggcgtccagggccggcccaaacgtcacacatacaagggctctggatacaattcccccgagggccaacattagctttgtggcaccacgcgacacgcccataggaactcggtggctgcaccactcgggggatgagcgtggcctatcacatggg

SEQ ID NO: 722498 - DNA, 350 bp, Homo sapiens
gtctcgatctcttgaccttgtgatccgcccacctcagcctcccaaagtgctgggattacaggcatgagccaccaggcccggccgataattctatttttatgtttatttttagagacagagtttcacactgtcactcaggctggagtgcagtggtatgatcatttgagcccccgcagtcgaggctgcagtaggctgtgattgcaccactgcacactaccctgagcaacagagtagacctgtctcaaaagaaaaagaaatatattctatagccatcatgcctaaacatactagtggattagggtttagttgggttcagatgatgtccccactcacttctgtagtgtaggcca

SEQ ID NO: 722499 - DNA, 205 bp, Homo sapiens
aggggggggggggggtttgccccttttttaaaacccccccttttttttccttggggcccccggtccttttttccgagggttgccccccgaattgtggccctttgggaagtttttttttggggtttcccccttacccccccccggggaattttttggtggggttttcaaaggttttttgaaaaaaaccctttttttcccccccgga

SEQ ID NO: 722500 - DNA, 446 bp, Homo sapiens
cgtgtgcttacggggcctctctgcttcgttctttcgctttgggctgtgcgctcttgcggtccttcggttgcgcggtcaccctggcgttttatggttcgttctgtggctatcggttaggtgttgtgcccgtttcatgtctcctcgatggtgttcacacctgtgctatttccctgtgttccgtgtgcgttaacattgtgtttgcgggtctgcatcaattgtccacccaatgtggaactgttccggttgtgggtctacttggtgcaaacaaatggtgttcctcccatgggagtgcacaccccgggggtctcagggtttatttggccccccttgtagcatgtccattagttgtatgcctggcatcttcactggcttgtagttggccctgttctcgacgttgtaaccctcgcagttcttggccacacccttttttcaccgatttcctatcc

SEQ ID NO: 722501 - DNA, 1087 bp, Homo sapiens
  misc_feature (112)..(112): n is a, c, g, or t
  misc_feature (512)..(512): n is a, c, g, or t
  misc_feature (523)..(523): n is a, c, g, or t
  misc_feature (527)..(527): n is a, c, g, or t
  misc_feature (561)..(561): n is a, c, g, or t
  misc_feature (617)..(618): n is a, c, g, or t
  misc_feature (673)..(673): n is a, c, g, or t
  misc_feature (693)..(693): n is a, c, g, or t
  misc_feature (703)..(703): n is a, c, g, or t
ctatcacactgaaggacatttactgttttttacttagcacagagaatcatccaaagttccctatgaaaaatgtgttccattgccatagctgactacaaattaaagttgaggnggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgatttttttttttttttttttggaaatggagtttggctcttgtcaccaggctgaattgcaggggcgtgacctgggctcactgtgcaaccttctgtgcctccgtgagntagctggaatntacngggtgcccgccaccattacccagcatagtttttnggtattttaagtagagacggggttttcaccatgtttggccaggcgtggtctcgaanntcctgtgaccactgtgttccacccacctcggcctcccaaaggtgcggggattacnaggcttgagccaatgtgccnggccatccgnggtgatttttcaaaattttccactttccatataaagtggcatttatatcatgaggcaaaagtgttctgggctgaaaaaattatgccccaaaaaaaacaaaacacacactccggtttccacacatattttcccacgtgttgccctaaggggaaacgctgtcccccctgtgaagccacgcgtgggtatgccgacgtgggcccatatatgcggaaattaacgcgggcctatcaagggggacgttatcaatgtccgcgtcacgacaaacaactgtttggctgtgaacccggatataaacccgtgcgctaatgaattctggtcctcaactttgtgcccccagggtaacccttagaaacctcccctttttgggccccttttaattcccca

SEQ ID NO: 722502 - DNA, 503 bp, Homo sapiens
atgaaatctctgatgccttacattcttcgatttcgaagatcctaaagaagatccatagatgactatatgttgatgggcgaagctgatgatgagaagctcgccttatttcactacgctgtaacgccagagttcacagtcaggtgacttcagtactacagttattcctacaatgtcaactaaggcgcacagtgaagattcgagcgaaggaacacgataatgtatacagcgtgttacgtttgcccacgctattctgaagcattaccaatgatacggaactagagccagttactgaactgactcgggttccagcccagtaggtgggggaacagtttgagcttaaacttccacggagcgaattaatgccaaaagcagtggcaactaactggtggaacttaggcttctctgacagaacttctgtttcgtgaactttggaatgaccggcttcttacagataaaccgaacaggtcgttgtaaatgcccattgacccatgtcatcatttccc

SEQ ID NO: 722503 - DNA, 614 bp, Homo sapiens
  misc_feature (198)..(198): n is a, c, g, or t
  misc_feature (367)..(367): n is a, c, g, or t
cccgtccccgcgcccccgcccccatattttttagccggccccggccgccctttggtgccccgtctttgttgtccccccctggcccttttttggggagggtgggggggggccccggcctcccccgggccttttttttttctgttttccccccaagttccccaacatttgggggggtgtgttttccaaattggggggagnttgtttttcccccctcccctgccctccttttgggaaggggggtttgggcccccgcccccccccccgggggggggggggggccgggggggaggggccccttttttttttttttttttttccccccgggggggaccccaaaatttggtccctcccttttttttgccccccngcctttggggcccccccccccccggggggtttttttccccccgcccccggggttcctgttttttttccccccccccaggggggggttgggggggttccccccaggggggtttttttttttttggggccggggggccttttttggggggggggggggttttttccccccccgggtccccctttttcccgtttttttttttggggccccctttcccctttcccccccccgttgggggggggttttttta

SEQ ID NO: 722504 - DNA, 186 bp, Homo sapiens
  misc_feature (146)..(146): n is a, c, g, or t
gctctcgacgactccccctacggtggacccgcgacggtggttcctttgggacgcacgcacctacgtcaccacgactcttgggaacggggtcgacgactacttacgcgtcgtggtttccacctttgggacgccgcactacgtcacanacgtacttcttgggacacggggtacccgacgtctcgacac

SEQ ID NO: 722505 - DNA, 637 bp, Homo sapiens
  misc_feature (278)..(279): n is a, c, g, or t
  misc_feature (282)..(282): n is a, c, g, or t
tttttgaagttggatggccgctttactcatggccttgacctctcttggccgaaattttcttggtgggtcaaaaggtaggggggtttcccttttattttacccccaaatatgggccaggaggtttctggttaatttaattttaattccctgaccttgtgggttttcttaactggatgaaaaacggcctgtgtccatttgtctacctgtgtacacatatgtacatgtgtggctgcaaatgttctcagtgatttcagagttcatggacccttttcaaaggnntcncagtggtaactatccaaaaatggatgagtatgtaggctacagtttattcacagttggcttcagtttataaaaacaggctgggcgtggtggctcatgcctgtaatcccagcacttcaggaagctgaggcgggtgatcacctgaggtcaggagttcgagaccagcctgcccaacatggtgaaaccccatctctactaaaaatacaaacattagctgggcgtggtggtgggtgcctgtaatcccagatacgttggaggctgaggcaggagaatcacttgaacatgggaggtggaggttgcagtgagctgagattgcaccactgcactgcagcctgggcgacaaagtgagactctgtcc

SEQ ID NO: 722506 - DNA, 249 bp, Homo sapiens
  misc_feature (79)..(79): n is a, c, g, or t
  misc_feature (86)..(86): n is a, c, g, or t
  misc_feature (116)..(116): n is a, c, g, or t
  misc_feature (133)..(133): n is a, c, g, or t
  misc_feature (140)..(140): n is a, c, g, or t
atagggtatttgttctcttggattgaaatttatgcccacagatttttcttttcatttgaaaatgaatgtgaaaatactntggggancggggggggataacacttttcatcactctnatcaatttcttataaantgctatnggaattatttttcctgtgaatattaatgattttactactggctccgaagttttaaaaaagggtctgtagacagaaaacagttggtgcaaccaaaaacaggggggggggg

SEQ ID NO: 722507 - DNA, 891 bp, Homo sapiens
ataaagaaacagagaaacatggacattgttgacagtatcactctctacatattatgaccctcccaatttcacagacataccgtggtgcaaaaagcaccgtgtactagtccactcacaaacccatacctaatacatggtggaactatacggcttatattccctttcgcccgccaatttcgcatattattccttgtcttaacccctgtcacccttcctttcttagttcccaaattactaactttcgcacccgttttcatcaagccgccttccccttgcaaattcaggggcccccatatgtatccaccttaagggctaattggggccaatcacaaccaccggtggtttctgccgaaaacacttttgccctcgttgagtgtaaatacataaaccgtgagttatttttggggcccataacactgccacctgtgctaatatatgactgctccccctctccaagtatattactgggacacagatttcccccttgcacaccacagggcacatattcttcctttttttcacccgtatcaacataagcgtctctatatttctgagacccacactaaagggttacaaattttatctctttaacaaaattcccaaaattgttaatgcactccacccccttttgtcaacttgtatcccccacccttattacaatttgcactcttcctgttctaatgcaatacattattgtccacccaaccccctgcaaacaaccactgctgcttaatactcatcccgtaaaatctgttcctcgccgcacagattacgtattatcccgaccgcatcaggcgcggaggaacccctaaacacaccctcaaccgagacattgccccgctcccccccaaggggggccccccccgtaaatcaaacaataccacacaaaag

SEQ ID NO: 722508 - DNA, 320 bp, Homo sapiens
cctatgtatgcagtgtgctttttgttgccagcttggccagttctgccttagacagtcagcatttgtctcctcctttagcggaggcatcgtctggctccaagtaatgcagtcggtagcaatgcgtagataggagaagccgagcgggagccaggatgggactggtcgtgtttgtgcttttctccaggtcagcacccaaaggtcaatggacagagaccccgggggggtgagcgctggcttctggagacggccgaagttgcctgttttaggaatctctttggaatggggagcgcggtgactctgagtttgggctattaaagtac

SEQ ID NO: 722509 - DNA, 317 bp, Homo sapiens
  misc_feature (131)..(131): n is a, c, g, or t
  misc_feature (145)..(145): n is a, c, g, or t
  misc_feature (286)..(286): n is a, c, g, or t
  misc_feature (293)..(293): n is a, c, g, or t
taaattaaaaaaatatatagacaggggtctcactctgttgatcattctggttttaaactcctggcttcaagtgatcctcccatctcagcctcccaaagtgctgggattacaggcatgagccactgcacccnggccacaattaatntatatttattttactttattttatttatttttgagagggggtcttgctctgtcgccaagctggagtacagttgctcaatctcagctcactgcaacctacacttgccaggttcaagaagattctcctgcctcaagcctcccngaagtangctgggactacaagttgccgcacc

SEQ ID NO: 722510 - DNA, 1380 bp, Homo sapiens
gttactctcgggttctgctcgtgctcctttttgtggtggtggccacaacgctctgtactcaatacacggcggtcgctctgtgcgagtgcacacaagtggtgattggactgtctcgtggccgcgagagtcccgtgttttgctcaaccccggtgttgggcacacccgtgcgcccatcagcggtacaccggaagttaattctcgtcgcgaaatgccccccatgaccttttgatgtgaagctctttccctggggcacacaaatggggctttccaaaggtcacagaaaatgtggttgcggtcacaagatgtgttcctgctggggcccaacactttgcgtgggtggcccaaccaaagaatggaccccccccaactggggaaaccaagcctgggcattcacatggctaccaaaggtggaattaatcccgtggggaccccatctccagcgcgcccaaatatgagcgcgccccggcgttaatggcgccccgtgtgatttggaatatgcccaccccccgggcgtctcacccaattggccaaagccaaagattttgcctgggaagcgtgggacagagaaataagagatttgggattcccccccgtttctctgtgttatcaaaacagaccttggggaaagcataggcccccctcagaagatatctcttggaaaaatctttcggtgggattgcctcgcgcccaatttggtttggagatatagggtttcccctggggccaaagaccccacacagtgtggtggtttgggaggagaccttttctcccaggacactgatgccccaccctttgtggggttccgccgtgtttggcctgtgtttctggtgaataaatgtgagcacccaggcaccgagatttctccgggtttggggtggtgtcactccccaaaaggcacgtggggacccacaagaagagggctcgtctttggaagctcggcgcacaaggtgcacaccacaagtgctttgcccacagagaaagcctccacagagaaggcgttaaaattgaatatatttatagccctcaatataccctcgccacccccaccttcttaaatccacagtgcgtgggaaagagacccggttctccacgagaactcgttttgtgtgtcacacttgggccacatcttaaagtgttatagtaagtataaaagagctcggtgtaaatagagtgaaccacaatgcactcgttaaaccctctcacgaaaggaaaaggagaaatgttttgtggacccacctcttggttttcttttttgcgctgtggcacgttttaaagttaattatgtttttaaaaatcacgtaactttttaaatggaaaccacaacttgacccaaaatttgtcacaagaattttgagacccccttaaaaaagttaaatgaga

SEQ ID NO: 722511 - DNA, 151 bp, Homo sapiens
caacgtatgtgcggctccgacccgaccgtgctgatagacttatttcagcgtccgatagtaccctaactggagaggagccggatgaagacctacaccatcgcctgtgatggatcctgtcacaacaaccccggcggccccatgggttggggct

SEQ ID NO: 722512 - DNA, 365 bp, Homo sapiens
caacgatggtcctcagccttctatttctcagaaaaacagaagctgaatttcaaaatatccggggagctgtcttggagatggtttggagaagaagccagcatcacgagaagtggaggtggtttcatgcctccgggagacagggcttaacttcatacagttgggtttggtggcagtaaaatgtcacggggatcctgtaaagacaagaaggagaaagggtgtgtggcctttctttcatttcctttttttttttccaaagacggggtctcgcctaggcgggaggtaggggtacaatcataactcacggcagccttgacctctggggctcaagcaaccctttcacctcagtttaccaagtagctgaggac

SEQ ID NO: 722513 - DNA, 387 bp, Homo sapiens
  misc_feature (78)..(78): n is a, c, g, or t
gggcaaattccctttttcaagttttgctaccagtgtggccgctccatcggggtccccctcttgccctgccctcgttgntacgggatccttaccttcagcaagtattgcaaaaccaaggcctgggccgagttccccaaaaaggacttcggggacctggtggccattgtgacccaactggagcaagtttccaggaggaaaaaaaaattccagttaaacaccacctgcccgtcccaggcttggggaggacccaggactgtgtgggttttttacctgcctgagcccccccagggaattttccagcctaatgcaggcatttttgcccctttggggtcatgctttgtaacagtgtttcccttgcgccctcccaataaattggccccccgggga

SEQ ID NO: 722514 - DNA, 311 bp, Homo sapiens
acctatgtgctatgggctcgatagggtagtacatagggcatgttgcttttgatatatggattgattttaaattatggcaaattcttgtgctgacaaaagtggtttagaaaataagagaaattcgcagcctgggcaacatggcgaaacccatctctacaaaaattagcgggacatggtagtgagtgcctgtaattccagctactctgaaggctgaggtgagagaatcccttgggcccaggaggtcgaggctgcagtgagcgatagtcatgccactgcactccagccttggtgatagagcaagaccctgtctc

SEQ ID NO: 722515 - DNA, 323 bp, Homo sapiens
tctcgggagtagccctggggagcctgtgtctgaatctgcacaggagcagtatgctcgagtggagatcgggcgcttcgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgt

SEQ ID NO: 722516 - DNA, 584 bp, Homo sapiens
gataccagaggatcccgcaggaaacagctaaccattagtgacaggattaacatcagtaatactgagagcttcttatatcaataattatggcaaaatgtcattttgtaatatagtatatgctttccaggtgtgggggtggtaaagtaatgaggccaaaatcatcctgccccaagactaatatcttctaatggtgcattagcaaggaaggcagaaatcaatatttagatatcagtagagtacataatactgtagaaagaagaagagcacacatgagacagagaaggaggtggatgctcctgggttgagagcaaggggtgggggtgtggaagggactaggccagaatccccagcagttctctggtttacagctccaagggacagaacagctggtgtcaagacctgggttagaggtttgtcaaacagaggcagggcccagtcacctctttggaggggagtgatgagaaggggattatggtcacctgagagggttgagtaaacttggatcagggcacaggcttctctcaccatactcagctttttgcactcactccctagttgagcctactggcatcaagctctagatg

SEQ ID NO: 722517 - DNA, 798 bp, Homo sapiens
attttccacattttctatccactgtaattttatgtgtcactgaagtgcctgcccaggactgtatattacagtctctcacaaacactgggaaaagggactgtcatcatcttgagtactctgtgtgtgtatatatatatatagatagatagattttttctttttcttcttgagacagagatctctaagtggtcacccagggcgtggagatacaggggcacaagtctgggcatcacgtgcaacctccacctccgtgggtacaagtgattttcctgccgtcagcctcccaagtagcgtggggtatagaggcacatgccaccattgccgggctaatttaggggagtctttagctagagagggggttacaccagtgtgggaccaggcgtggtctcaaagcctccgtgaccatcaaggtgattccacccaccgtgcggcctccccaaagggcggggactaacaggacgttgagcccaagtgacgccgggctgagatacaagtatcactggtagacaaccccattgaagttttaattaccttcagtatataagacacataacgggttggtgttttctctgtgcatgctcgtgtccaccataagggtcacaagatacgtctcgggtaagcctatcttcctagttccttatactccatattgggactccccagtttcgggagagtacctttaattaaaccacgtgcatgtctggggataagtataaaccttaatgcataaatttataccgagactcatgagtttactctccataagagtattgaacactaactgtatagcgatgaccc

SEQ ID NO: 722518 - DNA, 592 bp, Homo sapiens
  misc_feature (31)..(31): n is a, c, g, or t
  misc_feature (505)..(505): n is a, c, g, or t
  misc_feature (529)..(529): n is a, c, g, or t
aattcgcggccgcgtcgacgtcgacgcgcgngggagagcacaaatgtgtagtttagcaatatgctttaaaaaaaacatattaaataaaaagatctggaggtaaatctaatgctataactctgagggagggatgaatgtaaatggtagtttgaaatatctgcaataactctaacttgatttgacaatacctgtgatttctatttgggacagagtcacaggtcctggtaatattactgtagtctgtttcctacattccataattgaatagatgttaaatttcagtgtgaagttagtgaaaactgcaatcatttccttatccggttcacagatcagcaagaggacatagactccaggttaagaacacctgtcctatgggaagtgagtggtagggactgagttaatgaccctaagggaggctgtgatggacagagggaaggaggatggcaggctcagcctaggacagcaggagggtgagcaggtgtttctgaaggcatataagaagacntagaacgtggttgactcattcacntcaattctaccactcaggactgacaaggagccacctttaaggcctggcggtttagaggttttt

SEQ ID NO: 722519 - DNA, 898 bp, Homo sapiens
ggcagcgcccagcaacaagacatgagctggcctggagtccgcggctggccgcgtgagtaggtgattgtctgacaagcagaggcatgagctgggtccagtgccaccctactggcccgaggcctctgtagggcctgggtgaggcacctgcggggccgccctcacaggaacctccatctctcagtgtccctcgccggctccctcggggcctccactgcagcgcagactgcccatagctctgaacacgtccctggttcccagcccacctggaaccccggcagaggcccaccaatggctctggtgccctttgagggacctgttatgggcagagcgcactggtggggaacgggacaatggcgagcttcctgcagacggtgctggaaattggcgcgagcgcatgcgtgctgtaatagcggggccagcattgatcttcactcttaccctggcccgtgaggcagagactgccgggatgtatggtgatcagagcgggaccatggctatgtgttaacaagcctaggctgacgtcaatagaatcttcacaccaaagggaaggttcatatcctggtcacatcgcaaaccattcaattccaggcagacaatcgttcggatccaactaacccatcgggagacgacacagcgcacggtgctcggcgactgtggctatggtacccgtgtggcagaccaagtaactgcgcaggaaaaacccaccggtactgctgcagttggcaccacaaaacacaacgcggcaggaaccgtcgaaggatatcccatgggcttgggaatttcgaggtcacttgccctttgtggaggaaccgggccagagaacaatgtctgtaaacgcccctagtgtgggcgttccaaagtatatcaggggatggccgtcgctttgaaaaaggcatgg

SEQ ID NO: 722520 - DNA, 109 bp, Homo sapiens
tcccgaaaaccccccggaaggggccccccatccctggtaccccccccggcaaggtgggggcgggtttttcccccgggttgacaagggaaaaaaaaccaacctggtttga

SEQ ID NO: 722521 - DNA, 233 bp, Homo sapiens
gaatcggcatcctgagctgccgagggttctcccaccgacataccggcgggcacggctttgcgcagggaggccatgacggacttctcgtcggaggcggacgatgccccctggaagaactgcagcagatttcctgagtactccgggacgaggttgaccgaaccgtcttgaagggccttgacgtagacgtctcgggcaccgatctgcatgcgacgtttgatcgtgatcccgaccgt

SEQ ID NO: 722522 - DNA, 582 bp, Homo sapiens
taggtttgtgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttgggctagagttctccactattcccaattcaaagaattacagatacacattccccagaaatccataaagggtgttccgggcccattctgtaatagttcagtagaattaccattaattacatacagattgaacctatccacaatagtcagaaaacaactgggcatttctatactttacgggaaaaaaaatccggtggtcccattttatgcagaagcatattggcgggttggaacagattatgattgcatacagttttctagcaatttccttggttccttttaacagcatggtcttggcgggtactctggctgattggctggctagatttaaattacattggtgtccctactggataatatcagggatccggattacg

SEQ ID NO: 722523 - DNA, 106 bp, Homo sapiens
ttccctattccctgcactctcctcatgctcgggtcctcatcactatcccagtcagtcccacatatcatgcccggtctggcaaccccgttctgctcggcccgacgtt

SEQ ID NO: 722524 - DNA, 883 bp, Homo sapiens
  misc_feature (244)..(244): n is a, c, g, or t
  misc_feature (275)..(275): n is a, c, g, or t
  misc_feature (291)..(291): n is a, c, g, or t
  misc_feature (510)..(510): n is a, c, g, or t
  misc_feature (763)..(763): n is a, c, g, or t
  misc_feature (832)..(833): n is a, c, g, or t
cttcctccatctctcccccgggggaggcaatttgtcaaagattgttgttggattttacacacagggaaatctaaggaaggtgtggaaaccagaccaggactccagactctggtctccctgtttacagggtcttaaatggcggagccactttgggttctatccacaagattgctttgtaaaaaaaccaagaaacaaacaaacaaaaaactcaaaaaaacagccctgacctaaatattcacaaggnaccttaggcaatatctgcaaacaaaagtgantgatgagtggaatctntcatctttacaactaagacagctccagagttgaagcaagtggaaatatctctagacagagatttgggcaggttttgccagttacaaactatgagaacctgggcaggtttacctctctgagcttctgtgaccttgtaaaataggctgcattgcactaaacgtgcaggaggaatcccaggatcctcctgtgcacagggctggtttcttcccatccttttcnttgttctgcctctctcctcctctccaagagatgaatacatttggacccagtaggggcctatgtttgcaaaagctcgcaggtgattctaatgcagccagcctggctctggcagtgagttcttggacacttctagaggcacatttactagtgaggaaggtcactgtgtgctgaaggcatgactcatcttccattcctttcttccatgaagcaaggcgcatgggtcgactgagctgggagagtccacagtgtcagnctcccccacgcttccctccctccttattccttgtgtgctgtactttgtcttgatttcctgtactctgcnncaagccaggagatggtaagatctcaaaacaatcatttttgtgggaaatgg

SEQ ID NO: 722525 - DNA, 454 bp, Homo sapiens
agaatgtctggtgctataaatatcttaaacctgagggataacttcctagtggtgggagagtgggatcccttgctggtgcagagtggggatggaatgaaaggatttgggagagagttggacggctataaaaggaagaattttattcccgctggggatgactctggattcacaaaacagacttttccagtacaaacagaatattttggatttgcttggtagtttctccctgactgctaatacatctaatgcttcacctttgccctttctagctacctagatcccattctatagaatcccacctagttcttgctcattcataggacagagttgtacaatccgagtccagtgaattttgaaaccctcccctgctctgtttatactttccactttcccaggtatactccagagaacctgacctcagggaaatggtcttccaaaattctcgtgccgaatt

SEQ ID NO: 722526 - DNA, 917 bp, Homo sapiens
aaataagtaagctgagggttgcctctccatgaggggcttctgttatattgtggaggcatcaactcgagctgtaatgttcacaggataagggccaccactaaatgttaatgatgcaccatgcagaagtcaatattttgcactcctccacggctgtacagaagtagagtcatatcgggtgtaatgcgcgcacagcctggcagtgcaaaaggtattttcgagggtctcgatcttctgacacagcagctgcgcatcgggatgcacaatacggtggattcgactcgcttgacccggccagttggcattctagagcccactaatggagtgcactcggatgctatgtgtcacccgtgagggtgggcccaggatctggccagtctgatatgttagcataaacggcagtccaccatagagccactccgtagcgtagcacagagcaacggtacatacgtgtggaagcttctacatgtgctcactatggtcccctatgcaataggagcctgtatttcgccagtcatagggaggcttcattcagctgagttgtcccctattctcaggctgacaaccgtagagccaatacctacgccaaaatccaggttcgactatcatacttgcatcggcgtaaatctaactgttgcttgcccacaacactttgctgcggcctactccggaatgccccgacgttagctcggactaccccgatgcatacaccacatgaaacatcctatcatctgtaggctctattcatttctctaacagcagtaatattaataattttcatgatgtgagaagccttcgcttcgaagcgaaaagtcctaatagtcagaagaacccttcgatatacctggagtgactatatggatgccccccaccctaccacacattcgaagaaccgaatacataatctaatacacacgatg

SEQ ID NO: 722527 - DNA, 597 bp, Homo sapiens
atgtccctagcgggatgaatagatctgtttcttatcagtgcacaatgatttgtgtcatagacgtaatatgatcaatttgcacttgttttcttgacaggtcgttccaggtgtagaggaggcatgaaggatgaccgtcgggacagatactctgcgggcaaaaggggtggatttaatacctttagggacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttacaagtatatgtaaatgtctgtttttcataattgctctttatattgtgtgttatctgacaagatagttatttaagaaacatgggaattgc

SEQ ID NO: 722528 - DNA, 459 bp, Homo sapiens
taggtacagctcacacacctctgccaactgtccatcggctgagagggcgtcagaattatatccttcttgctcatcagttgatgatacgcccgcacagatgacaacacagcagccattcaagcaattctctacaacacctgtatcggcgctatcggtatcatccatcgccttagcatgatttatcctacactccaactcatgagcaccacaaaaacatagcccttctaaacgctcaatccaagcctcaccccactactaggcctcctcctagcagcagcagtgcaaatcagcccaattaggtctccacccctgactcccctcagccatagcacggcccaccccagtctcagccctactccactcaagcactatagttgtcgcaggaatcttcttactcatccgcttccaccccctagcagaaaatagcccactaatccaaactctaacacaatgcttagg

SEQ ID NO: 722529 - DNA, 428 bp, Homo sapiens
  misc_feature (139)..(139): n is a, c, g, or t
  misc_feature (158)..(158): n is a, c, g, or t
  misc_feature (177)..(178): n is a, c, g, or t
  misc_feature (196)..(197): n is a, c, g, or t
  misc_feature (215)..(215): n is a, c, g, or t
  misc_feature (235)..(235): n is a, c, g, or t
  misc_feature (392)..(392): n is a, c, g, or t
  misc_feature (412)..(412): n is a, c, g, or t
  misc_feature (425)..(425): n is a, c, g, or t
aggagcctgaatcataaacagtatccaatttataggaaccttgccctctggttatagtagaccgtgtgccctcctccagtgcctggcattattagacatgccggtcatttaccctcagaccgactctcttattagaatnctgagtgcttcagttatancatgtttgaatttttaaannattctgttttagaaatgnntcttatgctctcatgacnatgcagtttctaaacatacncatagaagctgagtctctcgatccaatatgtttttattagttccatttaatttatcacatagattgggaaggcaagctaaaagccttaaaaatgccctttatattttggagtgatttcagcgttgaacactagtatactatctaaatttgctggctncacttcttttaaactgtggncaatttaaagggnatg

SEQ ID NO: 722530 - DNA, 500 bp, Homo sapiens
cggaaggagacgcatctctgcacccttctctaaaggctgcaatgccaagacgccgaatggctttaaaggccaatgaaggcagtgttgaaaggtgtacacagccgacaataaatgatatgaagatccgcactgtcacccaccttccggcggccgaagacactgcgaactccggagacagcccaaatatccctcggaagagcgctcccaggagaaatcaagcgttgacgcactatgcgatcatacaagtttccgctgaccactgagtctgcacatgaagaatgatagaagactatacaacacacttgtgttcattgtggatgtttatagccgaacaagcaccagattaaaacaggctgtgaagaagctgtatgacattgatgtggccaaggtcaacaacctgagttcggcctgatggagagaaaaaaggcatatgttcgacatggctcctgattacgatgctttcggatgttgcccaaataccttcgggaggatctaaactg

SEQ ID NO: 722531 - DNA, 106 bp, Homo sapiens
gagctggggtagcttccaatgatgattatgatgccatgatgatatcaccataagaatggttgatatttatggagtgcttgctaattgccagatagcactcgaagca

SEQ ID NO: 722532 - DNA, 173 bp, Homo sapiens
  misc_feature (80)..(80): n is a, c, g, or t
  misc_feature (117)..(117): n is a, c, g, or t
tgcacgtggacggaccccctcccagcctcagctccgggcgacgtggagtggggcggtctggcggccgagatgccgtcctngctgcgaggacccatccccgacgtcaccttcgagctntgcgcgagggcgagacgaaggccgtgaagttggtcgcacccccggggccgcggcga

SEQ ID NO: 722533 - DNA, 310 bp, Homo sapiens
aggtcgtatactgctatagcgcagtgcggtcgcagaggcgtatacttatactctttgtctgtacccgtcagctgtgccgaggcgcacaacgcgccgacgcggacagaggactggacgacagcctatactcgcttaggacccaagtacagaggtgcacttacatggttcaccattaatactgacttaacacccttccatagaagggatgtattgaagcttggcaaggcaccaatgatataagggtatagctggatattctgaagaatatgatatatgcattcgcgccaagagtgcctttcgtggcggatgc

SEQ ID NO: 722534 - DNA, 506 bp, Homo sapiens
acggtagcccgcgagtttcgttctccgtgggcggcccggttgtcgaattgtgcattttaggcatattttatacacatccctcagcattatatgcttcagccttaacactgtcatagcagatagtcgagaatgaagtttcttattaataattaaattgttggttttaaaccaaactcagacgtgttttaattgaggagtacaaactttctaatattgtaggtttggtagattaggttcttttcacccttaggccaaagtttgacatttaaggttttagctaccacttagattacaattaatttgcttaagttaaattgctgaagtgtatttcttgtttaaggttgccaatttccaattaaatgccacctgaggtgtatactacttggggatccgtgcacgttaacgattactaggactatgcagaaaccagagagtttaagaatacccgcatggccccccttccttccccccccctccccctcccccacctcctcccccccccctcc

SEQ ID NO: 722535 - DNA, 108 bp, Homo sapiens
gatgtgattctatgaggatccccatcaaaacctggggcataagcatgatgcagccgtttgcgcagtatcatgaagcatccgattttgcgagtgacagatagcaggaag

SEQ ID NO: 722536 - DNA, 470 bp, Homo sapiens
tagacgatcgcttatgttgtgttcatgcagtgtgacaaagaagtaaaagtgaggctgcttcagagccctggccatgtgtccatccagactccaagtggagtgtagggctcccaggcagagaggggtgggaggggcagaccctgcccagggagtccttcaaattgggacagggcatcagacggcatcccaagggctcgccttccctttcccccccaacccaactcaggtggagggggagcagctgtcaccagagccgatgttggtgacaggttcggcttcaagcacggaaggaaccatcagcggtgaaccctgaggggcatccagcattggggagcaggttggagaagggctgtgtcgctggggtcactgaaccaggatttgatggggatggcatggtctggatggctcctgtaagcccctggggaagttatccagtgatcacaaatgctggagaggtcactgtggaccac

SEQ ID NO: 722537 - DNA, 87 bp, Homo sapiens
cttttaattacaaaagatgtaaaatgatgcattataaaacttggaagcaactttatacatcttttgtaattaaaagcatcacaatga

SEQ ID NO: 722538 - DNA, 333 bp, Homo sapiens
gcacgagaagctcctaaaaaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccctggggggggggccgggaaccaaatccgccctaaagggagggattttaaaattaacgggccgggttttaacaacgtcgggacgggaaaaacccgggggtaaccaaattaaaaggcctggaaaaaaatccccttttcacaagggggggaaaaagaaaaaaggcccccaccgaccgcccttccaaaaagtggcccacccggaagggcaaagggaaaatgga

SEQ ID NO: 722539 - DNA, 337 bp, Homo sapiens
cacgaggagtcgcggtcaggagaatgtgcataacaagctgccggcgtggcatgtgtaatccttgcagtagttacaagcccggtagatttccctgcttcttcggcatatgccaaaatgcttttttcttcatttcctccggctgatttgtaatcgccgcgaatcgccttattgttcaggctgataataccttcatttgtcttgactccggtcactattgcgctcatgggcggggccgagtcagaggtttgctgattggtactgtaagtccgcgaaaaagcggtaaaaggaaaattctcgaatgcaagacgattttcctcgccgctttcgccgcggagct

SEQ ID NO: 722540 - DNA, 314 bp, Homo sapiens
atcagtttctaaaaaaaaaaaaagttaactgtaaaacaacctcaggcaggtccttcaggagggattccagaagaaggcagtgttatcataggagatgacagctctatgcgcgtattgcccctggagaccgtccagtgggacaagatgtagaggtggaagacagtgatattgatgatcccgaccctgtgtacacctaggctaatgtgtatttgtgtcctggtttttgccaagaaaaaattaaaaagtaaataaatttttaaaaattttaataggaaaaaagcttacagaatgacactataaagaaaatattttta

SEQ ID NO: 722541 - DNA, 465 bp, Homo sapiens
accctatgtagatatggactctagcaatatgattgcgctgtactcctagggtaacttgtacgttgatacaacgttacttgatcatagagtctagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacagctgaaccctcgtggagccattcatacaggtccctatttaaggaacaagtgattatgctacctttgcacggttagggtaccgcggccgttaaacatgtgtcactgggcaggcggtgcctctaatactggtgatgctagagg

SEQ ID NO: 722542 - DNA, 938 bp, Homo sapiens
  misc_feature (1)..(1): n is a, c, g, or t
  misc_feature (201)..(201): n is a, c, g, or t
  misc_feature (792)..(792): n is a, c, g, or t
ngccttgtctatggttgactgcgtcacgtctacaatgtgtcgttcgtgtgttcgctgcaccggagctatgactgcctccccccgctttggcgccccctcttatcctaagtcccgctcctattccgtcctctccccctctaccctctttgtgcctctctcaccaggccttttccccccccggtgtattctctcccgtcggcncccaggtggcccctctccctttatcgtgggccaaacgttccccaagaccccgaaccgcccagtggtgtatccccggaactctttgggctcagactcagcttcctccatggtgaagcatggcgtcaaatgacatataattgcggggcgccataatacacatgggccccacaccacaccccctgggtctaaacacgaccccacgataaaatcgcccccacccccctctcccgcaaaatcatgacccccctggcccttcccttttaccaatgacacgtgtctcacctgatgcccccaagaccctttgtaatcacggattgcgctccacaccccggattatctccacaatttattactccaggttcaaattagtaccaccccccccgttctattatacacccaacgagggtccctcaatcgtcccccgcacgcgaaagtgtcttaattaaagcacgacaccacctctattaaagaaatggtgagaagttaatgatccatcttaataattccgtacagatcaaccaacagtgggtgaaatatttaacgtcctctatattataccggcatttagcaaatggacaaataaaatacatngtaagttgtccacatccttcataaagatttaaccccccgaggggtggttttaaaaaaacatcaagcccgcggaatccccaccccaccccaggtgccccccccccatccggaaataaaaaaaaaaaatggaaaattcggacaaaaca

SEQ ID NO: 722543 - DNA, 292 bp, Homo sapiens
gatgtatggctgcgacctggggcccgacggctgcctcctccgcgggcatgaccagttcgcctacgagggcaaggattacatcgccctgaacgaggacctgagctcctggaccgcggcggacaccgcggatcagatcacccagcgcaagtgggaggcggcccgtgtggcggagcagttgagagcctaccgggagggcctgtgcgtggagtggctccgaagatacctggagaacgggaaggagacgctgcagcgcgcggacccccaaaagatatatgtgaccaaccagccggtc

SEQ ID NO: 722544 - DNA, 145 bp, Homo sapiens
attgcaggcagtcatgctaagtcattttgcgtagctgggttttggtttaatccacctcaactgcctgctatgactggactaacgacttgacgacgacgtgacggacgaacggcttaccgtattacgtgacgggacgacgactttg

SEQ ID NO: 722545 - DNA, 146 bp, Homo sapiens
tggagaaggcatgatgcacctagggaaaaggcccaaccccgtggaagacctggcctggcgttcacagatgctctctgaaagatcagtgtcacactcaggaatcactgactgctggcacagccgctaaaatatcctgcttatctcct

SEQ ID NO: 722546 - DNA, 1782 bp, Homo sapiens
taattatatggcagggttttggttagccaaaaaaaacttctttttaaataatccagtgaaggattttttaagcttttaaaatgttaaattctgatagtcttaaattgaagtcaaagcatttctttttttctttttcccttagacttctttatgatctaagacacttatgaaggtaccaggtgccctaattgaccttaaaaggttagaaatgaatctttgccttgatgcaaagcatcagacttgatgcaaatcaacatataaataactgcaagcaaatatagagtcaactctggactatttaattttggtttatctgtggctaatcttgttttcaaatgcatggacagaacctattcaactacaatgagtatgggctcaatcctaccttgttggtatctcaaatccccctgtttacttttaggcagtaactgcctttgaaaacagaacatttcccttttccagagcagaccttacctcagtctctgaaatgggttgactttcagggaagactcaacaggcttccaggtgtgaaaacaggaaggtcatcttaaattagattttaatattatggcctcattgcttcatcattttgctagaaggaaattccctgaatatcagatacacccctattcaaataaaatcacaaaaccatctactaaagctaaacagtttttcaaaaccattctgaattatgcagtaatatttccttctgtaagaatatgctctgttctgtaaaccgagtattgagagaatagagaataaaaccacttcgcagatagcatgaagaggaaatgaggtaatgaaagtattttggaagttagagaagtcattaatgcaaaatatttttacctcaaatttcagttttgaagcacaaataattttacatgttgtatcagtgagaacagaaaatagaaaacaaaagatgtgggttgagtgaagtttccctgaataaaaggaatgcgttgttcattttaattattgtatagattagaataaggagcgagaaaaaaaaagctattcattattgtgattctagagtagctaataggtctactaactatccaatgaactcagtaaatataaagacaaaattgcaacatagtatggcatttttagctattcctgcccctgacccctccccgatatggaattttgtatattctccatggaggtaaaagtataaaatcatgctttttttggtgtacaaggatgttcattatagcatttttttttgttacagaaaaattttctacagcttaaatgtctgacagtccctagagttgaaaagatttccatgatataatattaaagcaattttccaaaagcatgtcttaaaaaataatacatatacatttatattcacaaaaatgcctagaaagaaacatcaaattgttaatggttctgcttcagtggcgtgggattgaaaaactgtcttgtatttgatcattttataatttatgtgtataatttttgtaataaaacaaaaaaaattaagatctggttttaaaactcaaatccattaagacgtttgagcactttaaaaagaagcttcatatggtttttagggatctgaatagtatgttttttgccttgctaataattcaaatcatagtattggcagaataattcttcatttctctctgttattatttattttcaattctgtaaattctcattcatctttatacctaatttacacatttgtccaaaaagtatacacatttattttaaaacttttttggtaggatcactaatgactgagttttagaagttaaaaaaaaa

SEQ ID NO: 722547 - DNA, 772 bp, Homo sapiens
  misc_feature (308)..(308): n is a, c, g, or t
  misc_feature (364)..(364): n is a, c, g, or t
  misc_feature (411)..(411): n is a, c, g, or t
agaaaatctggaggcagctatcacctatcgacccaaacctggaccagccagaagaagccgtaagtaccgccattcaagatccaatcagtcggcttatgcagtatgtgcgtagtcacatgctgcgtcatagaaaaggccattaatggacgacggaaatgttccagcaaaagaggaagtgtatgcacgccgtcttccagttactctccagctcagtcggtgtctacgtaatgatcgacacacaggtatgagagagtattcgatggaggagtaggaagagaaacgagcacgtagaaagctaagacaagatncagacataggttcacatcagaagacaacaagattgcgtggcttcatcgcgcgaagnatgccgacttcgcgataggcgttactcttgagttatacaagagagcnaggccaaatagtgagatacacgcccacaaccagatggaatataaaggggcgaggagcactgcgcgcatcgcatggtacagagacacactaggggttgtgtccctcagagcactaaattaataggtaaatagctatcaaaaaatagaacagcgataagaatccagagtaatttagaaaaaccttgcgagtagtagcgacgcgagcgtacagggcgtgactgtaccaatcagatgagaccgtgggaaggtcaccgatttgtacccgagaggcgcacccgacaaaacccataatcttccttgtacatctctgcggcctgttcttctattacaccctgattgaaacgacctttgcttatggccca

SEQ ID NO: 722548 - DNA, 1950 bp, Homo sapiens
  misc_feature (539)..(539): n is a, c, g, or t
ttagtcggaattcgcctctcagagtatactctaccagtatgagggacctacagtctctatcgcagctatcccacgactccccattcgctacatacgttcggtcactcgtaataaatagcagtctcggtatacatccgtctgtagcgcaactgggcctggatcgctccaacataccgcccagtaggacatgtgagtaccatacatgcctaaagctactgtgacactcatctagcaggacacgcaaccctgtcacttctgatgcgatggtggaccactacaattcgagcatccgaagcacagctaataactatggatgagagtctttgacattccatcctcagcgtgatcacatatccatccagacacaatattaggcaagcgcttgcttataaaattagcttgttatatacatgacacgtccttgtcccttaatcgccttattgcgtttggcccttgtaggaggacgttaattaatggcatctgacgattgcaagtttattcgtaatttaaccattcggaagaaaaaatcactttagatnaacgcactatcggggaacaccttaagtttcggcattcacttgggccattatagaccgaaaccctagataaaaggcaagaacgagaggacgcttttgcgaaataacgcgacataaattagatgccacctaacacgacagagtagacagggtgcggcacacgacattaattacgaattgtgaccataggaaagtggggggacaccgagaccacggagtaagctgttggacaagagaagcgtatcagcacgtatagatacacctgaacccaaaattcccgcacgagttaagcaatgttattggagggaggcagaccaagggaaacgcccataaagggttatccacaagtagtgaacacatgtgcgttggaaagatggaagggtgctataagccgttacacaggtttaaaggcaaacagagggtgtaccacaagcgacgcatacacaccgaacaggaaaagtatacctgatataaacaccgtgtagacagcaatgtgcagattcagtaataagccacaccgattacaaaatagacagataacgagcagacgcaccgcagtaacaagacgaaagaccaagcgaagcacgcaagaccgaatccagcatataagtatcaccgtatatggaccagccaggaaagacagcaaggcagtgcatagtaccaagagagcaaagaggcacgacacgccatacagagacagagtacaacagccagtacgcagaagattcgcgaggagtggaacaagccagccgttgtgcgcaaccgcaagagagcggaccacgacaagtccaaaagaggaacagcacacatacacgaggacgtatgaacgagacagccgtagtacgcgaggtaagctcgacccgtatacaggtggtgaagtataagcgaaggagaagtagcgatccgaaagccaagaagagcgtccagaaagggcggagcagccacagaaacaaagaacagcacggcagaaagggcacagaccactagaaaaagaagccgctgagccaagacgagtccagagccaggaatgggaacaatagcagaagtaaagcgccacaggaagtagcgagcgagcccacgaacgacaataaacagagtaggagagagacgacacgggcagcacaaaaggagaaaacaacgagacgagcagacgagacagcgcgcgcagccgcacgatagcgaccagcacacggagacaaaaaggcgcacagagagaaagcaagagatgacacacagagggcgaagccacaataacgcgcaccgagcaaagcgagcacacgacaagaaagacgaggcagacgaacgagcagccagacaaccagcgggagaacgggtgaacacacaagaggagtgagacggaagcacagggcgacgcgaattatccaacaagaaacgacagcacaccgagcaagat

SEQ ID NO: 722549 - DNA, 455 bp, Homo sapiens
  misc_feature (76)..(76): n is a, c, g, or t
  misc_feature (212)..(212): n is a, c, g, or t
  misc_feature (222)..(222): n is a, c, g, or t
  misc_feature (279)..(279): n is a, c, g, or t
  misc_feature (285)..(285): n is a, c, g, or t
  misc_feature (346)..(346): n is a, c, g, or t
  misc_feature (403)..(403): n is a, c, g, or t
  misc_feature (408)..(408): n is a, c, g, or t
tgacttcatgtggcccgcccaagcagcagtacactacagtgaagctctgtctttaggtagagcccatgcctgaagnctgtgttatttaaaagcagagatgatgaacgagaagcaggaagtcagtggtaggcatgggtggcgtgctcttagaggcaggcagtgtctgaagagcatgaagcagacagggtactgagagttccaggcccctgcangctgaggctnaaaaaggctgggactgtcccctcagctaccaagcctaggactgcccaaccaccccanagcctncagagaaacttcagcaagggcagtttgtcccaggacagtgaaaagagcttgttgagaagtngggagtaggctacaaggggccgttccaggggggagcctgaatgtaatccccagcttncaagnaaggcggggaaacttggggaaagtttaaaacggaatcgtcacctaac

SEQ ID NO: 722550 - DNA, 101 bp, Homo sapiens
gcggccgcctactactactactactgctcgaattcaagcttctaacgatgtacggggacatggcataataggtgttaaaaaaaaataaaggacctctgggc

SEQ ID NO: 722551 - DNA, 80 bp, Homo sapiens
acagcagcttctgaggaaaccttgttcaacgcgtcccagccatcagcgagttagagaggaatgtggaagaacttaagcgg

SEQ ID NO: 722552 - DNA, 262 bp, Homo sapiens
aagcgcttcagctggggtgctgatttcaggcagacccccaaagcaaagtgagacagatgcccacgttcaacgtgattagtgatactgtggcagggctgacagagaaataatcctggaggtctccacagctgctgggactggcactggcgatgaaaagcgcaggagtgggcacgggtgtggtgggtgatggtggcctcactcagagtggaccaaggccccagctccttgccaaaaccaaagcccttgggctcgaagttataag

SEQ ID NO: 722553 - DNA, 325 bp, Homo sapiens
agattggaatcaacctgtgtctatcagcaaatgaacagataaaatgtggtatatataccccgtggaatactatttggccattaaaaaaacaaaattctgttattctcagcaacatgtatgatcttagaagacattatgttaagtaagccaggcacagaaagataaatactccatgtactgtacttatgtggaaggtaaaaaagatctcatagaagtagagagtggctcatgcctctagtctcggtgctttgggagtctgaggtgggaggatcacttgaggcctggagtttgagaccagcctgagcaacatctctcaaaattaaaa

SEQ ID NO: 722554 - DNA, 266 bp, Homo sapiens
ttgttctccccacgcgccttctgctttcttctcctcctcttcagcttctttggtttcctctccttcttcacgcttcacctccttcttcttcttcttgcgctctcttcagactcttccttgagaagtttcttcctcgctcagctcgcctcctcctgcctcgcgcctctctccttgtgccttctcctcactcctcggtcttctcctatcagacagggggctcatcctttgtgcttcctacagccttggccagccctcaactggtttcc

SEQ ID NO: 722555 - DNA, 767 bp, Homo sapiens
aaaaaggctaggacaggctgtgttgggctacagattaacctttgccatgtacccgccatccatgatcgccacgggcagcattggggctgcagtgcaaggcctgggtgcctgctccatgtcctggggatgagctcacagagctgctggcagggatcactggcactgaagtggactgcctgcgggcctgtcaggagcagatcgaagctgcactcagggagagcctcagggaatgcctgctcagaccagctccatgcccagcgcccaaatgccccccgtgtggctccagcagccaatgggcccagccagaccagcactcctacatgattgtcacagccatacacctgtagccctggagatggccctctggagtggccactaagcagagtgagggtgcacgacttgccagcgcactccgctgcctccagtgaaccacaccacatctaagcctgaaggggcgtctgttcccccttcacaaagcccaagggatctggtcctacccatccccgcagtgttgcactaggggcccggcgaggcatgtctgcatttcgggtggctagtcaagctcctcctcgctgcatctgaccagcgggcgcctttcccaactctagctaggtgtgggccaggctgatgggacggagttgggatcctcagcagcatcgctttgaacgccccgcgcaccctggggggtctcatgtttccgctgccaatgctcagtgctctacggtttggccctcagggtatggctaggctgggcctctaactaggtg

SEQ ID NO: 722556 - DNA, 304 bp, Homo sapiens
ttacaggatctcacactggtcgagtctataagcctccatccttcatttacaatgagatcaaactagagcgcggtatgacttactaagacaaatgggttgttgaaattgggcttcactagaatccaggcttgctggctaacaccaatgctccctccatcatttcatgttatgttttcatttcccctctgtctgagagatcgctctgatgtctttccttccataagtcctacggagatcgagcttacctcatttttctcccaggcctaggagctcaattaccaggatcactttcttccccagtgtg

SEQ ID NO: 722557 - DNA, 100 bp, Homo sapiens
  misc_feature (57)..(57): n is a, c, g, or t
gcctacaatctccgcactttgggagggtaagtacggctggatcacgagtcagagttntacaccgcggaccaacgtatgacatgtctgttgttgtgggcga

SEQ ID NO: 722558 - DNA, 181 bp, Homo sapiens
gtctgctgacagtgaccaggattttagcctaggcgggctataatctcccagcccatggatgccccctgattttaacaaaagggataaagattaccccactgtaccactactcttcatatccttcagaccttaaagaaaattcatacaaagagagagaggagtttcaaaagaggagctagct

SEQ ID NO: 722559 - DNA, 477 bp, Homo sapiens
cctcactagtggcttatcaattttgtttaacttttcaaaaaaccaacttttatcttgttgattctttgcattttttttgtctctgttgcatttggctctgctatgttatttatattttttctttctactaattgtgtgtttgatttgttcttgctttttgagttccttgaggtgcatcattaggttgtttatttgaaatctttctacttttttggcgtaggcatttattgctataaactttcctcctagtactgcttttgctgtatcccataggttttgcatgatgtgtttccattttctgcttaaaaaatttttttgatgtccatcttaatttcttcattgacccaatgattattcaatagcatgtttaatgtccatatatttgtacagtttccaaatttctttttcttattgatttcaagttttattccattgtggtctgagaagatacttgatatgattctaactttaaaaatt

SEQ ID NO: 722560 - DNA, 180 bp, Homo sapiens
ctttaacatgaattcatgggatcccgggtattttttttaagtcctctgggggaaaacctgtttatccctcccgtgattttgagtttgcagtttccccatcagtttttcctttcatgatttttgtagttgccctgaagtcctctatgtggaaaaaaataaaaataaaagtgatttcccgga

SEQ ID NO: 722561 - DNA, 337 bp, Homo sapiens
tatctcaagaatatgcgttatataacatctgtgtcaaggagttgatgatgctcctggagaagatgatcagaaaaaaagattgggagtgtgtgatctgttatggactttgttatggggaccaattcgatttcttggcgtgcatgcacatctatcaactggactgtatagatgactggttgatgagatccttcacgtagccctcctgcatggagccagttgatgcagcactgctttcatcctatgagactaattgagccagggtctcttatctgacttcaagtgaaccaaccattttggtggttttgatcttttgtcactgagcccaaagagccaggga

SEQ ID NO: 722562 - DNA, 366 bp, Homo sapiens
tataccagatccttatatgtactcgatcgttaaactcgtacttacttgcggaggattacaccatgagatatcaatagtcacttgctgcttctatgcttacgcctacaatatagtaaagcagaccctatattaataaaatctcacattagaatataactaacactagagcaaaataattttaaacagtcttattcctgccctataataagattaaaatcttaccagctcaaaatatagggtattaatactaagattagctctttcacacctcacatatcctgtatcttagtcataatgagaacttaataactctccagaaatacacatgttggagctaagtatcagaaaatatctatacaggctgaa

SEQ ID NO: 722563 - DNA, 117 bp, Homo sapiens
  misc_feature (10)..(10): n is a, c, g, or t
acaggtcatnccctagtgacttctgagcacaccagaaggagacacatccaggtagcaaaccatgtgatttcttctgactctatttcctcttctgccagtagtttcctgagctcaaac

SEQ ID NO: 722564 - DNA, 766 bp, Homo sapiens
  misc_feature (766)..(766): n is a, c, g, or t
tgccaagggatttccttggatcgtggagacccctagagaaacagaagatgctaatcaccaaatcagtgctgactgggccagcaagatatcaacggagccctaagccgtccgtggagatgtacatctcagcaggagagcacgtcaaggtccatcgagatctgtggtgaccatgtgctgggttgatcatgttagatcgacatcgcccgcaaactggacaaggctgagtcgcgagcccctgctgctgtgcgctacctactctcaagaagctgggaacaggccgctgagctaatgcttgcctgagatcctaccatgaagaggtgactcatccctgtcagtgccgtgagaccagcgtggatgaggctgcttgttgagaagatccgagttaggtgagttactgccgatgctcaggctacagaaacatcgttgaggagccataagcgtcccaggctgggacagaagagcggtccaggtgcgagcatccaacatgccggggagagcaggttatgatgtgctatatactgatgtgtcatcaggcctgaatgtcagatcgcagagccatgtgcagtctacatcaggtgagatggcatgtactgctcacgcaaggagtcgagcatgctgacttaattcggcgggagtgccagaccccggttaagaactcctgaaaaaagccgcaaggcggcttaagggaccccacacggggcgacccacacggggtgccacagcatgagaggtctccgtggagaatctggcgacgttcctttctggn

SEQ ID NO: 722565 - DNA, 254 bp, Homo sapiens
  misc_feature (80)..(80): n is a, c, g, or t
agaacccataaaacagtggtgttctcctctgatgtgattttactaagtattccttcactcttcagtttaaaaagagcctnaggggcgtgagggagataaacaacaaaacattctgtacttcatcaggtccaggagctcaaatgttggaaaggagccagaattgttattgccccctgtgaatcaagcaggatgtgcacagtcaaaagaagctgctcactagaagtttatctatattaaataacttatagaaggtt

SEQ ID NO: 722566 - DNA, 124 bp, Homo sapiens
tgactctacaggagttagggaattctcctgctgcttcagaacgtgaataagacgtaccaaaatatgtaactaatgtggtactgtaagtagcactctgagtataggatggcaccacagtagccgc

SEQ ID NO: 722567 - DNA, 793 bp, Homo sapiens
ggacagtatctgtgggtacccggagcacggagatctctgcctggctttacgttcacctcggatatctgcagcacgcctccgcattccatctcctagcgcgaccgagacccagtgcgcctagcaacgttcacccatgtctattctcaacgatccatgccagggcagatctcttggactctcgccgggacatccccacattggttgacggattgatcatcattcaccctcaacaaacgggtctccttcacagagactggctggtgccccagacggctggcctgtcaacaccttgggctcatcttacttgcacgggccacctcagacgctcccggggacacccaacgtgactacacgaaacttcgcctcattcttgcgcgcgcacacggacgcggatggtcccatcacaagccaagggccttgggtctggcagacccaaacaagttacaacttacaccaacactcaatctgggcgccccctggaccgcattggggcttctacagggcccaacggcaaagaagcgctggcgacaagccgcgtcccgcccagcggaaacccgcacagcgacaggacaccgagaaccccggaacagcacatagattgtgattgtgacaatttggacatttactggagaagaggaaattaggaggagaagtttgtgagtaagaaggacatagtggaaagtaagaaaagctttataacctaaattctatttaagccaagcagaattatacctatggtggaattggtgcatagatggcaacagtggttcggtcaaagtatttcccgttgggg

SEQ ID NO: 722568 - DNA, 228 bp, Homo sapiens
tggagggtcgagtcatataaggatcccccgaggaacaacagtattgatattgtaaatgcgatatatggaattaacaagtgtgaccatatggaagcgaagttattttggtgtctcgaaaggagttatgcgtgcagacttgtgtttgaacatttgttactgttttctactcataatataaaggtgatgcgcttctgggttgtgacttacgacgccggggctgccgaggct

SEQ ID NO: 722569 - DNA, 514 bp, Homo sapiens
  misc_feature (4)..(4): n is a, c, g, or t
ctgnagatcgctttgagttaaaccaggctattaggaggggaccttttgtcttccagagactgccaggagcttttaccagtggtatatacatgcttaacgctgaggacgaataatctatgcgcagtgaaaacccaggccccagagagatgcgagtgtgctgttcgagagctctgcttccagtggagaatggccgtgaatggttgcgacactgttttgcagcagtcaagcattcctgggtgcttaccagctgtcttgagacccaaggaacccctgcctattcctagctacctgaggctgctaagatgccctctagataacgtaccactgacccattgaaacaccgatgcctgcagtctaaaggacaattccactttccttatccccgccaacttccgaaacacccctttttatctcatctgcccatgacattaccccgccttaccctattaccatctagctactctcttcttaccactaccccctctctttgttcacacaccctcgcccttctccg

SEQ ID NO: 722570 - DNA, 157 bp, Homo sapiens
tatttgcatcataggacgcttcattcactgagtttccccatattctcattgctacacccttaaaactaaactctacgccaggaatttcagtttcactatcatattcatcggcgtacatctaactttcttcccacaacactttcttggccttatcgag

SEQ ID NO: 722571 - DNA, 143 bp, Homo sapiens
tttaaaaaaaaaaaaaaaaaaaaacttgatgttaattcctccctttcctctgggttaatgaaaatcctttattcaggataaaatctttatatgttccccctgttaagaataaatggcccttaaatcttgtttagccctgtgga

SEQ ID NO: 722572 - DNA, 430 bp, Homo sapiens
gaagaagaagagaaagaaaaaaagggagggaaagaaaaagaaaaaaaagaatgagggggaaggagaaggggaaaggaaaaaaagagaaaaaaaaaaaggaaggaaaaaagaaagaaaaaagagaaaaaaaaggaagagaaaaagggaaaaaaggaaataggaaaaaagaaaaaaggggaatatagagagaagagagaaagagaagaggagggaaggggaaagggaaagggagagaaaaaaaaagaagggagataagagagaaaaaaagaaagaaaagaaaaagaagagagggagagaaaaaaaaaaaagacaaaaaacgaaagaaagaaagaaagagaaaaagaggaggggggggggactgacaaaatctaaaactctcactctctctctctctctcactcacaaacacaaaacgtgccgaattcctgca

SEQ ID NO: 722573 - DNA, 434 bp, Homo sapiens
ccaccttggactcccacagtgctgggattataggtgtgatccaccatgcctggccttttcatgcaattaacaaaatttttaggatataaaattcttaagcacatcttcctggttactaaataattaatatgattgttaacacacagttgcttcctatgtaatgacatgtacattccgtttgttgatactgaagcagctttttcaaagctttgcttgttttatttggagtgtatctccagacatctcacacatcgttttaagaacattgtattaagttttgggattgaaataaataaatgtaaaaattttactttataaaatcattagccaaaaaatatgttgagagagatgaacattctctgtagcttgtgtagtaaaactgaggcattattgtgaaatatttacatggtacattctgtgggcctacaggagtt

SEQ ID NO: 722574 - DNA, 533 bp, Homo sapiens
  misc_feature (332)..(332): n is a, c, g, or t
  misc_feature (380)..(380): n is a, c, g, or t
  misc_feature (396)..(396): n is a, c, g, or t
taagctacgatcctattcccgtttccgtggatagcgtgattaatccgctgttgccggattcccggactgaccagggcaggcgcagcgcctcggcgtgaaatatttcccggccatgatgctggttgacccgaaacagggcagtgttcgcccgttatcatacggctttatttcgcaggacgacctggcaaaacagttcctgaacgtttctgaagattttaaacccaatttttaatcgcggatttgatttatgagtgaagattatttgaaaatgtttacaggtgttgttctgttaatatttgtcattattgccggttatttcttttctgagcgtnatgacaggaaaatgtttctcctgagctcactggttttccttgttgttnatatcgcgtgtttatntgtgcttaccgccagtctctggtttctgtgtggtgcaattatgagtcagggcgcagcactggttgtttcaatagttgcggccgcattaccggacgttacgagcttcgacaggttcagaagagtggctctactctaga

SEQ ID NO: 722575 - DNA, 154 bp, Homo sapiens
gctgagtaggaggattgcttgagaccagaaggtcggagctgcggtgagccacgatcatgccactgtactacagcctgggtgacagagtgagaccctgtctcaaaaataataacaagtaataatttaaaaaccacttaatattgatttaccaaga

SEQ ID NO: 722576 - DNA, 225 bp, Homo sapiens
tggctattttttgtatttttagtagcgatggggtttcatcatgttggccaggctggtctcaaacaactgacctcaggtgatccacctgcctcggctcccaaagggctgggattacaggcgtgagccaccgcgcctggcctccatttatttgtaaatagataattctcagcagtatgtttactctggataaacatactgctgagaattatctatttacaaataaat

SEQ ID NO: 722577 - DNA, 759 bp, Homo sapiens
cggctcgggctgcggggcggctggcgcgcgcgcgccgcggggcggagaagcgggcccggcggcggcgagcatggaggagaagtacctgccggagctgatggcggagaaggactctctggacccctccttcacgcacgccctgcgcttggtgaaccgagaaatagaaaagtttcaaaagggagaaggcaaggaggaagagaagtacattgacgtggtgataaacaagaacatgaagctgggacagaaggtgctgattcccgtgaagcagtttcccaagttcaactttgtggggaagcttttgggtccgcgtggcaattccctgaagcgcttacaagaagaaacgttgacaaaaatgtccatccttggcaaaggttccatgagagacaaggcaaaggaggaagagctgaggaaaagtggagaagcgaagtactttcacctcaatgacgacctgcacgtgctcattgaagtgttcgcacccccagcagaagcatatgcccggatggggcacgccttggaagagatcaagaaattcctgatccctgactataatgatgaaatcaggcaagcacaactccaggagttaacatattttgaatggcggttcagaaaatgcagatgtcccagtggttcgagggaaatctactttgcgtacgagaggtgtactacaccagcaataccagggaagaggaggagtcccagccagggcctgttgcgttggggtaccccgtgggaaccggatcccgaggagtctttcacccg

SEQ ID NO: 722578 - DNA, 161 bp, Homo sapiens
ccgtgcacgggacacggtcaaacttgtcttcctcagaaccgttcatccatacccaggatgccacatgatatcctggagggatttgtagtcctgcaggatcttttgcaccccacgggcaaacatcgtaaatgctcacatgcacaacaagtgttgaggatcca

SEQ ID NO: 722579 - DNA, 874 bp, Homo sapiens
cccgctcggacgttgctttgtgtttggtcctggaacttgttcgcctcgccgactttgctccctccccgttcggtgttgtctttttgtgaccccctctgtgtggaccaccctctggtgtgttgtcgtcgcggcgcggttttttacagaagcggggtggttggtgataccgcgaccagaagatgttcgttctttgggatgagagccccccctttggtcgtcgcctcgtcacttcagatccgtcaccctcacccctcgtcttcgtcggaagagatggttgggcgagccgcccccctgcgaggacccgcccactctcgtcgacaaaaagatgtgtcataggcgctccccaccggattctcctctcactaggattaattaaggagatgcgcttctctctccccccgccggctgacccgcccccggcctgcatgaggaggggcctcctactatagttcttctcctcgtccatcagcgggcgcatagcttcaacgagcctttgtggagaatgattatgtcgcgcgcgacacaccaagctgcttgtctatgtgcgcactctcacacgacactctcccgcgggacagggtttggcgcccctcgtcacgctccctgtggctctcgtgcgcgcatcgatggggtgcttgcgcgcgtgataaaatttggacatgtttactgtggcactgttgcacgcgggtggcccacactcgagatgaggcactcgcatcttggaacccatgatattacgccgctatgtgcccccaactccatatggcttatgccaacttacccacggttgtcacgctaaaaatggctaggagcccgtcttcgcacaaattgtcttaaaaaagggcttcttgctgccaaggggggcccaaataac

SEQ ID NO: 722580 - DNA, 399 bp, Homo sapiens
acctggatgaatcaccagggaattaggctgagtgaaaaaaaaaattgcaaaatgttgtctactaaatgattccacttatataacactcctggaatgccaaaactatagagatgaaaattaataattgctgtgttaatgaagaagtggaaatgggagggaagtggctgtggctacaaaagggcaaaatgagggatattatagtgatgaaagtgttctttattttaattatatcaatgtcaatatccagactgtgataatttactgtagtttacaagatgttatccttgggggaaactgggtaaaatgtacatgagatatctctgtaacatttcttaaaagtgtctgtgaatcaacaatgatatcaaaataaaaagtataatttaatccagcaaaaaaaaa

SEQ ID NO: 722581 - DNA, 432 bp, Homo sapiens
tgtaaagtctgcaagtgcatatttggacttctttgaggccttcgttggaaacgggatttcttcatataatgctagacagaagaattctcagtcacctctttgtgttgtgtgtattgatctcacagatttgaaccttcctttagactgagcagttttgaaaaactctttctgtggaatttgcaagtggagatttcaagtgatttgaggccaatctttgaaatggaaatatcttcgtgtaaaattagacagaatcattgtcagaaattactttgtgatgtgtgcgttcagctcacagagtttcacgtttcttttcacagagcagtttggaaagactctgtttgcaaagtctgctagagaatacttggaccctttgaggccttctttggaagtggaattttttcatatactgctagacagaagaattctcaaaaa

SEQ ID NO: 722582 - DNA, 1024 bp, Homo sapiens
  misc_feature (9)..(9): n is a, c, g, or t
  misc_feature (130)..(130): n is a, c, g, or t
  misc_feature (158)..(158): n is a, c, g, or t
  misc_feature (163)..(163): n is a, c, g, or t
  misc_feature (189)..(190): n is a, c, g, or t
  misc_feature (216)..(216): n is a, c, g, or t
  misc_feature (233)..(233): n is a, c, g, or t
  misc_feature (242)..(242): n is a, c, g, or t
  misc_feature (246)..(246): n is a, c, g, or t
  misc_feature (249)..(250): n is a, c, g, or t
  misc_feature (268)..(268): n is a, c, g, or t
  misc_feature (272)..(272): n is a, c, g, or t
  misc_feature (276)..(276): n is a, c, g, or t
  misc_feature (285)..(285): n is a, c, g, or t
  misc_feature (292)..(292): n is a, c, g, or t
  misc_feature (296)..(296): n is a, c, g, or t
  misc_feature (303)..(303): n is a, c, g, or t
  misc_feature (314)..(314): n is a, c, g, or t
  misc_feature (352)..(352): n is a, c, g, or t
  misc_feature (365)..(365): n is a, c, g, or t
  misc_feature (372)..(372): n is a, c, g, or t
  misc_feature (387)..(388): n is a, c, g, or t
  misc_feature (394)..(395): n is a, c, g, or t
  misc_feature (415)..(415): n is a, c, g, or t
  misc_feature (438)..(438): n is a, c, g, or t
  misc_feature (440)..(440): n is a, c, g, or t
  misc_feature (459)..(459): n is a, c, g, or t
  misc_feature (492)..(492): n is a, c, g, or t
  misc_feature (495)..(495): n is a, c, g, or t
  misc_feature (693)..(693): n is a, c, g, or t
  misc_feature (860)..(860): n is a, c, g, or t
  misc_feature (995)..(995): n is a, c, g, or t
tgacaaaangaggtggacggccggattcccgggtgcgcagaacggggctgtggggggcgcgtcgaagatgggaccagggctacggaggctacggggcgtggagtggcgtggacctgccaacacccagggngcatatggaactggtgtggccagctggnaaggntatgaaaactacaattactatggggnncagaacaccagtgtcaccacaggggnaacctacagctacgggncagcctcgngggnggnngccaaggcgaatgatggngggntggngggcggggngcctgcnatgnacatggnctcttacgggncagagccatgcaccgacaattccgactccctcattgcnaagatcaaccagngtttggncatgatgtccaaggnngggggnnggggggggggcggggggggnggggggggcatacaggaccgggngngctccttccgcttccagcngttcgagtcctatgactccaggccctgcctgcnggngcacaacccctaccgccccagctacagctacgactatgagttcgacctggggtcgcgaccgcaatggcagctttggggggcagtacagtgaatgccgagacccagcccgggagcggggctcccttgatggcttcatgcggggccggggccagggccgcttccaggaccggagcaaccctggcaccttcatgcgcaganccccttcgtgccccccgctgcgtcctctgagcccctgtccacgccctggaacgagctgaactacgtgggtggacggggcctgggagggcctcccccagccggccacctccgtccctcttctcccagtccatggctcccgactacggcgtgatgggcatgcagggggngggcggctatgacagcaccatgccctacggatgtggccgctcgcagcctcggatgcgggatcgggatcggcccaagaggagagggtttgaccgcttcggaccagatggcacgggcaggaaacggagcagttcaantttacgaggggcagacacaaactggccaa

SEQ ID NO: 722583 - DNA, 699 bp, Homo sapiens
gaggctctctctgatggggcagggcaagagagtgatcgtgtgtagtgctgtgtgtgtgcactacccttctcttgtgagctggggtcccatccgattttcaatattcttctgtccatagacctgaagcagaggatgggggggcccacagccttaccatggtgccgctcatgaagcagttggtgcacagggttggaaggaagataggggatacgttcagggaccttcgggatcatgtgcactggagtcagaatagccttcttgcgcagcgtagggatgtgggctgcaagagcagtttctccacctctggggccaggtctcggcacatctcagcagagcccatggtgctcaaagtgcacaaggccaggccttgtcctgtctgaatcccctggctcaggtcattcttgatgctgttggtaatgagcaggtgggcatcgtgcctctcatccaatagaagcatggcccccaggtagcccaccctcttgtctgtgactctggaggaggcgatcagtttcaggcactccatctgtccaaagtgggcggggtagcccaacatgtgggcgtacagcagtttggcagctgccggtgctgtgccggggtcccgtcccgctggcggccggcttgggccctcttttgctccctccggcctggcctggtctgcccgccatcctcgagcgccctgactaccaggccacactgagg

SEQ ID NO: 722584 - DNA, 128 bp, Homo sapiens
accacatgccactggagaagggaggtgggggagagggcaggtgggaagagcctcggggaggaagtggatctcacagtgtgcccacggagcccttctccggtgcgtggtccttctccggtggctgtggt

SEQ ID NO: 722585 - DNA, 379 bp, Homo sapiens
actacatacttccgtatcataattcctgcagctaccacctttttaataaccatgcttaatgcaaaagaccttctgcaggacctgaaattggtcccatctgatgaaatgaagaaccatggttgttaacgagaaattgaaactctaatacaatgaagacaggaccagatgcacccagggggcactgcaattagtgttacagtaccttatagagtagcagaccagcccttaaaacttatgcctcaagactgggaccgcgttgtagccgtttttgtgcagggtcctgcatggcagttcaaaggtggaccatggcttttgcctgatggatcaccagttgatatatttgctaaaattaaagccttccattggaaggtgtagtcgg

SEQ ID NO: 722586 - DNA, 154 bp, Homo sapiens
  misc_feature (50)..(50): n is a, c, g, or t
  misc_feature (56)..(56): n is a, c, g, or t
attgtgctggggtgactagaggatcccgggagtatgtcaacatgagtgtnggaggnaacattcaaaccacagcagtatgaaaacaatattcaactccaaggtatatggtcaagattacagggtggtaaggaatatggctacgagaatacggaat

SEQ ID NO: 722587 - DNA, 758 bp, Homo sapiens
ttatttcaattccgggccggcgttcattgtattactggccctcgtcttacaattacaaccctgacatgtatcagttggaagggctgaactggctacgcttctcctgggcccaggtagtgacaccattctagctgatgagatggggctaggcaagaccatacaaaccatcgtcttcctctactcactctacaaggagggccacacaaaaggtcccttcctggctgagtgccccacatctctacctgcattcaactgaactcgcgcacccccccccccccccccccccccccccccccccccctccccccccccccccccccccccccccccccccaccccgaagcgcgcccggcaccgcacgcagcgacgcgcaagcaaccggctacgcgcccccagccgcgagcgtcgaggcagacgcacccccgcgcgcacccgcagccgcaacccccgcacgcgccgaccgcgcccagggacaccagctcggagagccggcaccaggaccaccaagcgcccagccccactcgcaagctacgcaccagccgagacgacacccagcgtgcgccacccgccgcgacgcccgcgccgacaccccatgcacgcccgcaccccagcaccaccgccccaccacccaccacccacaccaccgacccacccgctccaccgcccacccccgcacgacacacccacacacgcgacacgcccccacggctcacgcagcgcccgctgccccaccgcgccacagcacacacagcaccacc

SEQ ID NO: 722588 - DNA, 102 bp, Homo sapiens
gcgggcgctcagacggatcccttcgatggggggcacttatgcacgcttactatcttaacaagctatgagtgcgagagatgaagagttcaaatctgaccaaga

SEQ ID NO: 722589 - DNA, 342 bp, Homo sapiens
  misc_feature (99)..(99): n is a, c, g, or t
tatctagagcgatcttcagtctggaaaagggggctactagggttgtgaggtctctggatagaggctctcttctttggttgtcagatccttcattgcggntgcggggttcggaggaataacttcttgtgggcagatgatgaagggctgccctgaagggctcagggctccgcctggtgatggagttgtggagctggggagaacttcctccctgggacttggccctctcagtggtaggagagggctggcgcctggggcgggggcccaatttgccagggctgggtagaaggctcatcttcctcagaggagcttgcttcagatccttccttctctatttcctcctct

SEQ ID NO: 722590 - DNA, 563 bp, Homo sapiens
ggccggatttggctgagagtagaagcagatatacatttgcctgggtccatagcgtgtgatcactggatccctgacaggagtccttatgtcaaaactgagtatgtgccaagaactctgggaatcccagcagataatttccccgtgtgaacatgcacatatatgctataaaacattactccacatgcaacactgtagaacatgtaagagttgacgaggaaagaaacacgaaatgctgctggcagttatagacaggttttcttcagtgaaaacctgagagacactcctggacaatttctatcaggagtgctttctcttacagattaagagtatgtattagttttagggtgagggggcttatcagaagcttcgaatgttactgtttgagggagaagttttatggtggggttggaatgtctctgggtggaggggagtttgccttggggcaggcatctttctggccagagggatgtcatctcgagactggcatcttcccagctggagggggtttatctcggggctagcctgtctctggctggggaggagtttggaatgttctggttaga

SEQ ID NO: 722591 - DNA, 318 bp, Homo sapiens
aggtatccgacgaggaataaatagcaatgccctgaattccaactgtaccttctacagaaaagtgcttgactgccaacttggtcttcccagtccttcagtgaggctctatctagaatgctccatactcctacttggatgatgacatcaagatctctggtacaaatacgcttgttcttgtgcatttcttcctgatcaatgtattgctctttgactcttctgagtcctatactactgatacttaccgatgtcatctacctcatctgaccccacatcttcgatcttgcgcatctcttcatcatctcaatcttcctctgctat

SEQ ID NO: 722592 - DNA, 211 bp, Homo sapiens
tatagtgttagtattggagccctttgaaaatagatattttcaaaaaaaatgtaggatttaaaagtttaatttttaattttaaaaaaaaatatgatggccattggaaatagtcccaatgaagtttttcatccagtaggtgtttaacagtgttattttgcccctggtaatgtgtaaactgtgagtgatttccaataaatgattatgaattcca

SEQ ID NO: 722593 - DNA, 422 bp, Homo sapiens
  misc_feature (112)..(112): n is a, c, g, or t
  misc_feature (146)..(146): n is a, c, g, or t
  misc_feature (207)..(207): n is a, c, g, or t
  misc_feature (252)..(252): n is a, c, g, or t
  misc_feature (261)..(261): n is a, c, g, or t
gcggactagaggatcccgagcgagatacatcactgcactacagcggggcgacagagtgaggcttcgtctcaaaaaaaaaaaaaatctgggggccaaatctccagacagcacnggcgggtgcagaaccccaccaggaagcggccggngtacctcgggcagatgggagccgggcctaaagcggcctttaatgcagctggggtcagggtnaaacatcatggtcacagtggatttttctcactatgtggtgagacntgggagaangggctccaagtactactctggtccacgggtgggctgggactacggatggtgcaccattctccattcctctcacccggcagggggtcagggccccgggcgggggcagaggagaaaaaggggcggccttctccaggacaaaccctcactccaactcacctagg

SEQ ID NO: 722594 - DNA, 434 bp, Homo sapiens
gctcgacgtggctctcttagtttttgcctgtagccccagctatttgggaggctgagactgaaggactgcttgagcctgggaagcagaggttgcagtgagtagagattataccactgcatgtcagcctgggtgacggagtgagaccctgtctcaaaaaaaaaaaaaagaaaagaaaagaaaaatagtagattgctgaagagtagaagtatgaccaagcatggtggctcataccagtaatcccagtacttagggaggcccaggcaggaggattgcttgaacccaggagtttgagaccagcctgggcaatatagcaagaccctgtctctacaaaaaacaatttttttttaattaaccaggcatggtggtgctcacctgtacttggaagggtgaggtgggaggatggcttgagctcaggagtttaaggctgccatgag

SEQ ID NO: 722595 - DNA, 224 bp, Homo sapiens
caggactctgagctgcgatgagctttactcccggtggaaacaagggagcccagccggagccatggccagtacagtggtagcagtatggactgaccattgctgctgcaggatttgcaggccgttacgtttatgcaagccatgaatgcatatgtgagcctcaagataaaacaagtttttcaaatgcctaaccaaatatcttgcctatcagtaggtgtgctacttac

SEQ ID NO: 722596 - DNA, 193 bp, Homo sapiens
  misc_feature (181)..(181): n is a, c, g, or t
gtgcatgtactcatcgttcagccaaagtcattctcagagccaatgtcgctttgctcgatctctgaagctgaagaaggctcgccgctacatgtctgcgtcttgtgagagaagaacgggagccagcggatgcgtcagtaaggacgtggtgtggaggaagaaaatctctatttcatatggtcangcctacgttccg

SEQ ID NO: 722597 - DNA, 241 bp, Homo sapiens
ttgtacagtacaatgtttctagaggttttagtgtctcagatttagtcctgtaccatttatgatgatatgcatttctgtattgcatcactatgtgaatatgcattcaatgtgtctactaaagtgtcaaattgtagagagtcacttgaactgtattcaggtaatatgcctaaagatctttctttattgccagacaaatatttaacatttaaaactgctaatacatgtactgacatcagaatga

SEQ ID NO: 722598 - DNA, 100 bp, Homo sapiens
agtcggtaccatgttcacagctggttggagtgctctgcaaatgggcagctatcaactagggactgcaaaatgctgctcactgctccacccgacggggtgg

SEQ ID NO: 722599 - DNA, 178 bp, Homo sapiens
gatgggtcagataggacaggatgtaacatactagacaaccttactgtggggacgaagtctatccgggtgcgtctcgagagtaggagtcactcatgtgaaatatactagactgttcctatcttcccaaaggggaaggagacggtacagcccctacgtaagggcagtcacctatcaccac

SEQ ID NO: 722600 - DNA, 143 bp, Homo sapiens
  misc_feature (9)..(9): n is a, c, g, or t
  misc_feature (20)..(20): n is a, c, g, or t
  misc_feature (60)..(60): n is a, c, g, or t
  misc_feature (73)..(73): n is a, c, g, or t
  misc_feature (88)..(88): n is a, c, g, or t
  misc_feature (94)..(94): n is a, c, g, or t
  misc_feature (110)..(111): n is a, c, g, or t
  misc_feature (119)..(120): n is a, c, g, or t
  misc_feature (123)..(123): n is a, c, g, or t
  misc_feature (134)..(134): n is a, c, g, or t
  misc_feature (138)..(138): n is a, c, g, or t
tattccgtnggggtccggcntttaagggttgtcaaaggtaggccaattgttcgtcttttngccctatacaaangcaaggaaggaaggnccaagntcataaatattaatgnnaaacactnnacnaataaatttcntatncaaaa

SEQ ID NO: 722601 - DNA, 140 bp, Homo sapiens
  misc_feature (7)..(7): n is a, c, g, or t
  misc_feature (47)..(47): n is a, c, g, or t
  misc_feature (69)..(69): n is a, c, g, or t
  misc_feature (108)..(108): n is a, c, g, or t
agatttnggagccaaactctcacgtggaaactgtttaagtttgggancgatatgtctggcctcaacccntcattcttcaaaaatctggtatttcgggattccttcccnattgtaagatactgtgcccaggtttttggttt

SEQ ID NO: 722602 - DNA, 195 bp, Homo sapiens
cttaaaattcccgttcctttaaattgggggttttggccctgtgatgttttgctggccccttgcctgttatggaagttccgcggtgtttgtccccctttaccctggggggcccttaacttgggggattttttttctaaaaatgtaaaataaagcctttttttaagttttgaataaaggtttgaggttgccttccca

SEQ ID NO: 722603 - DNA, 482 bp, Homo sapiens
  misc_feature (20)..(20): n is a, c, g, or t
  misc_feature (39)..(39): n is a, c, g, or t
aaggttttgcccagcaaagnaccatcagaccaagagccnacctgttgaatgcaggaactatctgcaaactattcatcttacaagggacttgtatatccggaatatacaaggaactcaattcagcagcaaaataataatgataatgtgattttaaaatgggcaaaggatctgaacagacatttctcaaaagaagaagtagaggccgggtgtggtggttcatgcctgtaatcccagcacgttgggaggccgaggtgggtagattgcctgaggtcagggcttcgagaccagcctggccaacatggtgaaaccccatctctactaaaaatacaaaattagctgggtgtggtagcatacacctgtaatcccagctactcgggaggctgaggcaggagaatcacccgaacctgggaggcggaggttgcagtgagccgagaacacaccattgcactccagcctgggcaacaagagtgaaactctgtctc

SEQ ID NO: 722604 - DNA, 230 bp, Homo sapiens
ttccatgtgacccgcttctcacttggctcggcaatgattcgacagcacagaccacatggaccctctcggggaatgtcacaaagtccctccctgccagtgctctttccctcatgatcccaggagatatgtttgctgtttcccgtctgggaagtccaatgtctccccattccctgtactcggaccgttcttcttcaggagattcctctcccagccgagattcctcagcagct

SEQ ID NO: 722605 - DNA, 121 bp, Homo sapiens
  misc_feature (38)..(38): n is a, c, g, or t
  misc_feature (52)..(52): n is a, c, g, or t
  misc_feature (93)..(93): n is a, c, g, or t
  misc_feature (111)..(111): n is a, c, g, or t
gagagccagcgttgaaccccacgctagcaggggagggnagaatgaaaaccantaagaccgcatatcgacgcgagccacagcgcggaagaaagncgcagaataaacactttngcctgcaaaa

SEQ ID NO: 722606 - DNA, 335 bp, Homo sapiens
aggcccctccacctggaaagtaggatggctggctactatggggaattgaagaaaagtggattaatgacaagagtccttgtgttaatatacaaccaagacagggttctttgtacatggattccatgcagtgaatgaagacatagggtggttacccaacacaaatggacagagcatttgactttctaaagactttgtttgtagacattttgacattgggagaagaaagatggcacactaaccgagattataggtcttatgcctggaattttttgcaggttgatttgtatgcgtgtgacctctagaaatgtaaattattaataaaattgtgatcactc

SEQ ID NO: 722607 - DNA, 313 bp, Homo sapiens
tgatctcacgcattttattactgtatgtatttatcttgctgttaacatcgtaatagttatggattatttcatgtatgtcacctgtgtgaatctgaaatatccgaagtaatggagccgcttttttaaatcaactttgtgtaatggcataaagccagcagttcatggccatgtagcacatattgttcttatatgtattctttttcaaaatcactcatcagcagcatacattcagatgggatgcatgtatgtggttcatcaacatgattaggagaaaacaatatgctcttgatggacgtggtgtcacactgatttc

SEQ ID NO: 722608 - DNA, 388 bp, Homo sapiens
cgatccctaaggtggtcgtgggtagtaggggtggtggtggtggtggtggttgagacaggttctctgattgcccaggctggagtgcaatgatgcaattatagctcattgcagcctcgaagtcctgggctggagcgttcttcctggctcagcctccctagtagctgggaccacaggtgtgtaccaccacgcccagcttatttttaaacttcttgtatagatgaggttttactacgtcgcccaggctggagggtggtggtttttatattccattgtgtgaggggtgtctgtgatatttggaatctgagaatggacttagacaatgctaagctacagtctgctggcgctccgcactccgtcctggcgactctgctcgacggcgctccacccc

SEQ ID NO: 722609 - DNA, 608 bp, Homo sapiens
  misc_feature (5)..(5): n is a, c, g, or t
  misc_feature (53)..(53): n is a, c, g, or t
  misc_feature (61)..(61): n is a, c, g, or t
  misc_feature (302)..(302): n is a, c, g, or t
  misc_feature (323)..(323): n is a, c, g, or t
  misc_feature (351)..(351): n is a, c, g, or t
  misc_feature (420)..(420): n is a, c, g, or t
  misc_feature (424)..(424): n is a, c, g, or t
  misc_feature (433)..(433): n is a, c, g, or t
  misc_feature (449)..(449): n is a, c, g, or t
ctcanttgagggcaactcttacccaggaggtcatcagttcatagcagccaggntctatttnacagaaggcgcagacttgtgagtctgagaaccattgagcagggagatgaggttgtccatagggaagtcatcatggaggaggatgtactggcaccgacagaccaaatgtccccacaaacttcacagaagctgccctggaacttcttcccaggatagacctggagctgtcaagaggatagtcccccgagtcctttacatcccacaagatcagatgaaaaagttaacaagctccagaaatcctncatccctggtcttgcttgtanctaatccagcccactcatctacccaaanactttagggtgccaaacgccgggcgctgggccgccgctcctgccttgcacgttagagagccggtacaanttcncatgggganaagctccaacaacggnatgagcgccgcgcccgtgataaggttttacctggtacatcggcatggcggaaccaaagcaagagagggtggcgcgtgccaaacaccaacgctcagaaaccgtccgaggctacgactgggggcggacatctcccttgtgaccctgctgcggtcgttcgga

SEQ ID NO: 722610 - DNA, 550 bp, Homo sapiens
  misc_feature (112)..(112): n is a, c, g, or t
atgtcttggtcagtagtggtaccaagccaggctccagtgacacccttgagatcagtagggtcgcttcttccataagcgcatcacttaattggatccatcgcaggtacgtagnctcagtgatgaagttacacatttcaacatacacagtacccggctgccggtcaatagcatgaggttctagcataacacaatacacgaatgagacgctattattacgcgatactgtattagggagcagtactgattcacaaccagaggaagtacgcaacgatgaagcatacggatcaatccaaacattaccgacccctgttcccatggagaaggccttccgaataacgggcatcaacatccgctaatttttatttaacccatccaagaaaagaaattataaatgtagaccttccgggcaggggacagtctctagtcacgatggaagaccagttatgtaacaccaacatcaccaaggccataaggcaccatttaagacgccacacaaagtaagaggacgagggcacaatgggcacccaccaaaaaaagaggacagtaaacc

SEQ ID NO: 722611 - DNA, 247 bp, Homo sapiens
ttttttttttaaactaacgattatttaacaacctacctgtatgggccaggcatttatgctgaggaaggacaaaggagatgaagcatgctccttaccttgggaaacttaaagtgtagtcaggaggagaaacagaatattgcaggttgaaaatacaggaagtcaaaaaattaacaagagtaaataggaaaactggtctaacagttcacatattgtactggaaaaaagagagcacagatgcagaaagagt

SEQ ID NO: 722612 - DNA, 797 bp, Homo sapiens
tccccctcagtaacgggagggagttccggttaatacggggagggggaggatggtgtagggatcaaatttggcgggggttgagcgagctggggaggaaatcaaattaagttctcggaaagtgtggaagtttggaagaagtgctttattaacactagtggtgagggagattattcaaatctctggaatttctcgagggttaaaagaggaagggattttcacaagggcaaaagagaaaatagtgcactttcttctagaatctttagaatagtgcaaccaaagaatatccctttttctcgagggtaagaatctattctcatctctgtgggagggattatgtgtaatgtggatctccaaaatgtggattattattctgtgtgtgtggtgtattaaccttctcacattaagggaaaatttactttaaaaaaattttaaacagacagccaaaatttattaacaaaggggccgtggtattcctcgggattagcaggtgaacgggggtttttattaaccatttaggttggttaaggttaatctcttcaggacgagaagagagtatatttcacggtgggaaaaatcttctccacctcttgagtacctcttatgcgagtcacctaaagagttagggcttattctttagacaaaaaaatctttgaagaggttggcacgagctctggaggcccaggaggggaggttagaagtgggggtctggaaacggctttccttaaaaattttttcaacaaacctctttggtggaaccaacaaaattggtggtgcccttccatggggaagaaaaccac

SEQ ID NO: 722613 - DNA, 171 bp, Homo sapiens
tggggaaatatctaatatagcttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatg

SEQ ID NO: 722614 - DNA, 441 bp, Homo sapiens
tacaggctcatttgggggagcatgacagttatgtggtttttcagatgtcactgcagtccaagtccctggaggagaagctcaaatcttccgggataccatatgaagttcacatatatcctggatgttcgcatgccttcatgaacacttcgcccgaggccctcaagaggaagaaggggatgggtctgactgatgagaaccaggaagccgtcgacctggcctggtctcgcttctcttcttggatgggccgtttccttggatctgcttgagccattccccacttcatgtgctgtgtgattatgtgtggagtcagggcccatgaatcaaatgttcagattcaggatgctgtatccaaaccatacaaatggactgggttgtacggtgctttggatttggtcgtccttccttctgtttatggataatatataccgtagtgtcgtttcc

SEQ ID NO: 722615 - DNA, 686 bp, Homo sapiens
gggggaaaaaaattaaaaaaaaaataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactttgagcccactttgcccaaggattttaaaaattacccaaagtttttcaaggggcccaaatttgggccaaattggccaattcccccttaaagggggccttttaaaattcaagggcccgggttttaaaaatgcagtaaaggtgaaaaacctggggataccccatctaaaccccttggaaaaaaacccccttttccccatggggaaaaaaacaaaaaggccccaaaaaaatggctttacaaaaagatgcccaccccaaatggctaaggaaaaatggaagcgtaaaaattttggaaaataccccgaaaaaattttgttaaaaaaggcgatttttttaaccaaatgggccaaattgggaaaaatccttaaaaattcaaagatataacccggaaaaggtgctacagtttttcccaaatttggaaacaaagtccccctttttaaaaaccgtgtctccaaaatcttaaatgggcatataaaccggtttttaaagggattggccccctttggtgaacccaccccctttaaaacaaattttttggaggatcaggtgtacgcaaaaac

SEQ ID NO: 722616 - DNA, 204 bp, Homo sapiens
agttcagtcatgctcagtaccttttaccttcacactgtgtgcaacccatctccagaagccttttcatcctgcaaaattgaaactggacccattaaacaacagctccccatttgtcctcccccggcccctggcaaccgcctttttgcttccttctccatggatgtgactgttttaggaacctcatataagagcaatcccccagta

SEQ ID NO: 722617 - DNA, 348 bp, Homo sapiens
  misc_feature (6)..(6): n is a, c, g, or t
  misc_feature (71)..(71): n is a, c, g, or t
  misc_feature (83)..(83): n is a, c, g, or t
  misc_feature (87)..(87): n is a, c, g, or t
  misc_feature (100)..(100): n is a, c, g, or t
  misc_feature (112)..(113): n is a, c, g, or t
  misc_feature (119)..(120): n is a, c, g, or t
  misc_feature (126)..(126): n is a, c, g, or t
  misc_feature (131)..(131): n is a, c, g, or t
  misc_feature (142)..(142): n is a, c, g, or t
  misc_feature (146)..(146): n is a, c, g, or t
  misc_feature (150)..(152): n is a, c, g, or t
  misc_feature (160)..(160): n is a, c, g, or t
  misc_feature (163)..(165): n is a, c, g, or t
  misc_feature (172)..(172): n is a, c, g, or t
  misc_feature (175)..(175): n is a, c, g, or t
  misc_feature (178)..(178): n is a, c, g, or t
  misc_feature (180)..(180): n is a, c, g, or t
  misc_feature (182)..(184): n is a, c, g, or t
  misc_feature (186)..(186): n is a, c, g, or t
  misc_feature (191)..(191): n is a, c, g, or t
  misc_feature (202)..(202): n is a, c, g, or t
  misc_feature (216)..(216): n is a, c, g, or t
  misc_feature (218)..(218): n is a, c, g, or t
  misc_feature (220)..(220): n is a, c, g, or t
  misc_feature (224)..(224): n is a, c, g, or t
  misc_feature (231)..(232): n is a, c, g, or t
  misc_feature (236)..(236): n is a, c, g, or t
  misc_feature (241)..(241): n is a, c, g, or t
  misc_feature (244)..(244): n is a, c, g, or t
  misc_feature (249)..(251): n is a, c, g, or t
  misc_feature (255)..(255): n is a, c, g, or t
  misc_feature (286)..(286): n is a, c, g, or t
  misc_feature (317)..(317): n is a, c, g, or t
atttcntcagtgacaatgtaactgtgagtgtgcatgtatattcacattagtgtacattttaagcacttcgntatgttcaagtntttntaactgggagggnaaaagtggttannataaanngggagngttangggttgggttngatnattnnnggaggggngtnnnggggaanggnggngngnnncngaggngtgtgaaaatnataacagtgaaaangnantggnggggatnntggnaaaanagnaaaannntggntatagaacaaatctgttcataaaattctggnagtctgtagtacacatacataagattaaagnaaatattatcctttcatttaaagaactatgc

SEQ ID NO: 722618 - DNA, 417 bp, Homo sapiens
ctgtgagtcagttaaacctcttttctttataaattacccagtctcaggcatttcctgatagcagtgtgagaatgtactaatataaatacctagcacttagaacaagccctaaatatacataacagtttgtttccttaggaggactgtgtaggctgcatgcatgtatcctcaggacctaatactggacctagcacattgtaaatgcttagaaaatgtttgtcaaatgaatgttgtatatattatggcagcactatttttaaatgcattctagcttggttatgatagaaagacaaaatagtggcaagaatgagagcttatataaaggaaaaattctaattattttgctttctttaatgtgtacaactatgtaactaacctgcacagtgtgcacatgtaaaatataccctaaagtataat

SEQ ID NO: 722619 - DNA, 120 bp, Homo sapiens
tacactctgcagagctttggcgagatggccgactcctttaaagctgactacttcaacatgcccgtgcatatggtgcccacagaacttgtggagaaggagttctgtgggcaccatatgcgc

SEQ ID NO: 722620 - DNA, 460 bp, Homo sapiens
ggagtcttcggcgggctcgcgagcccggccgcggcctgctggtttcagacggagtcttactctctctcccggtctggagtgcagtggcgtgatctcggctcaatgtaacctccactctccgggttcaaggggttctcctgcctcagcctcccaagtagctgggaccgcgggtgcacaccatcacggctggctaatttttttgtattttttgtagagacggggttttgccgtgttgcccgggctggtctccaactcctggtctcaagctacctgcctcggtctcccaaagtgctgggattataggcgtgggccacagctcctggccgaatttgatttttatttaatttaaataaccatatgggagtagacagtgcggacccctagattctgctctttttagtccatttctcccctttgtcttcctgaaggctgtcgttgcttaatgtctcttgagtacatc

SEQ ID NO: 722621 - DNA, 261 bp, Homo sapiens
atctgaggtacttaaggatcccggctccacttggtgccaaggagaaatgttcgtcttctcaggtggacatgtgccaacggatcacattgctgtggacccgaaggcagattaacagggaagcgttcgtgcagtttgctcgcagagtagctgagaggctctggaacagggaacggaagggtgaggaagagggtgtaggggagcgcggagtaagaagtttgcattgtgttcatgcgcaagggccagtcatagaacttgaggcac

SEQ ID NO: 722622 - DNA, 534 bp, Homo sapiens
  misc_feature (54)..(54): n is a, c, g, or t
  misc_feature (66)..(66): n is a, c, g, or t
  misc_feature (113)..(113): n is a, c, g, or t
  misc_feature (130)..(130): n is a, c, g, or t
  misc_feature (135)..(135): n is a, c, g, or t
  misc_feature (138)..(138): n is a, c, g, or t
  misc_feature (160)..(161): n is a, c, g, or t
  misc_feature (202)..(202): n is a, c, g, or t
  misc_feature (207)..(207): n is a, c, g, or t
  misc_feature (209)..(209): n is a, c, g, or t
  misc_feature (215)..(216): n is a, c, g, or t
  misc_feature (224)..(224): n is a, c, g, or t
  misc_feature (229)..(229): n is a, c, g, or t
  misc_feature (238)..(238): n is a, c, g, or t
  misc_feature (241)..(242): n is a, c, g, or t
  misc_feature (244)..(244): n is a, c, g, or t
  misc_feature (250)..(250): n is a, c, g, or t
  misc_feature (253)..(253): n is a, c, g, or t
  misc_feature (255)..(255): n is a, c, g, or t
  misc_feature (258)..(258): n is a, c, g, or t
  misc_feature (322)..(324): n is a, c, g, or t
  misc_feature (336)..(336): n is a, c, g, or t
  misc_feature (338)..(338): n is a, c, g, or t
  misc_feature (363)..(363): n is a, c, g, or t
  misc_feature (444)..(444): n is a, c, g, or t
  misc_feature (446)..(446): n is a, c, g, or t
  misc_feature (518)..(518): n is a, c, g, or t
tgcggcggggcctggacggaagagggggcgagccccggggcgccgcacgtgganccccggcacggncacgctcacgtgcacccgtcctttcacgccaacgcgtttcctgctgnacccacccctgcaccantgcangtnccagaccccggcccagcctccnngcggtccctaggctgggggagctcagacaggaggctaggangaggngnactttnnggctgagnctttnccaaacgancannantttccnaantnttntaggaagcgggaagggtgcgccaggccgccatggcatcagatgaaggcaaaatttttgttggannnctgagttttganancaatgagcagttgctggagcaggtnttctcaaagtacggacagatctctgaagtggtggttgtgaaagaaagggagacccagagatctaggggatttgggtttttnanctttgagaacattgacgacgctaaggatgccatgatggccatgaatgggaagtctgtagatggacggcaganccgagtagacaaggga

SEQ ID NO: 722623 - DNA, 150 bp, Homo sapiens
tacgcaccaagtatgagacaagcacactagtcatcgcagctgcacggcaacagcgattgacacagccaatattgcgtctgcgcctacttacccttgtgttcttaccgacgagttggctcattggcttgatcgacttgcaacgttggtcag

SEQ ID NO: 722624 - DNA, 137 bp, Homo sapiens
acgctgcaccgcgtgtcaaaagttaagaacgggaagaatgggtggcaaggtggctcctggaagagctcacccagcacagttcccttgagctcggagccttggtttctagtccctggggggatttatatttaagtaga

SEQ ID NO: 722625 - DNA, 134 bp, Homo sapiens
aagtcggtcaggcaccggccagccagctccagacgcaggatggcttgggggagggcgtagccctcgtagatgtgccaccgtgtgggtgaccccgtctccagagtccatgacaatgccagtggtgcgcccagaga

SEQ ID NO: 722626 - DNA, 919 bp, Homo sapiens
ttctgggcgtcgatgatgttctagctgagatgataacgtgtggcttgtgctagttgagtcgatcgtcgttgttgtgtgattatctcgttctgctccgtttctctgcgccgctatgtttgtctcgcttgatgctgatggcggtgcggccgcggagacattctcgggtaccgcatgggggacggtgtccgcctccgtgtgtaccccgcccgagtgtgttttcaccctccctaatgggccgtgttctccgccctccgtaagtcaccgtgccgccgatctcttgtggtggggaccgccgccgaatctcttggtgttgcaggccacttttagcagggtcctcctgtcctggtctggcattattcccgcgggtttctcccttctctgccccggggaacaccaccgcggtggggtgaaactccagccacgacgggaccagtgttgcgcccgaggactgctccgcgggtgtccccgccgccctaatctggggggaagcgcggcgtttagaagcccccacttatgggggacgcccccctcttgctgttcctctccgcgcaaaaagaagtgtgtcttcgtgcccctttattgggaggtgttagaacccgtgaagatgattttgttccccacgggggccacaaaggactctaagaaaaaatgttcgcggagtgggcaaaaattggggccacaaataacgttgttgccccccttttcacacatttcaacattggggggtggaattattataaaaaaatatcgcgggaacgttacaaccacttaatcgcgcaggatgaaatgttccgctgggaccaccatatccgcgcggtcgcacacgtctcagtaaaaaaaaaaaaccccttaattttttgggccaaacccccccttggggttttttcaaaccaaaaaattttttttgggggccccccga

SEQ ID NO: 722627 - DNA, 252 bp, Homo sapiens
  misc_feature (63)..(63): n is a, c, g, or t
  misc_feature (215)..(215): n is a, c, g, or t
  misc_feature (235)..(235): n is a, c, g, or t
tatgctgacaagccagagacgaccaaggagcaactgggagagttctacgaagctcttcgactntgcgcattcccaagtcagatgtcgtgtacaccgattggaaaaaggataagtgtgagccactggagaagcagcacgagaaggagaggaaacaggaggagggggaatcctagcagacacagccttggatcaggacagagactttggccatcctnccctccaacccgacatgtgncctcagctttttccctc

SEQ ID NO: 722628 - DNA, 543 bp, Homo sapiens
  misc_feature (194)..(194): n is a, c, g, or t
  misc_feature (416)..(416): n is a, c, g, or t
gttagaggatccctgatatgcgtctcaactttcttgccccaaccttctctcaactcactcctgttaacttcttttcccaatattctatcacaagtgccttcttccaggtcaccagtgacccccactgaaccaaatcccacagtccaccctcagtcctcataacttccacttctcggcagctgatattcctgacnccacagccatccgcacaccactgatcttctttccacctccttccacgttgtgcttctccagtttcatgacgtcaaataccatctgtatcctgaaggctccgcaaattcagatctctagtcatgggctgcctcatgaactccagctgtatttccactagccatttcagactcaaattttttttttttcttaagatggagtctcgctctcatcgcccaggctgnagtgatgttgcgagactccatttcaaagaaaaaaaaaaaaggaagcccgggaaggggaggtggcagtgagctgacggggccacggcacttcagccggggcgacagagtgagactctgcctcaaggca

SEQ ID NO: 722629 - DNA, 553 bp, Homo sapiens
  misc_feature (50)..(51): n is a, c, g, or t
  misc_feature (63)..(63): n is a, c, g, or t
  misc_feature (440)..(440): n is a, c, g, or t
  misc_feature (444)..(444): n is a, c, g, or t
  misc_feature (447)..(449): n is a, c, g, or t
  misc_feature (453)..(453): n is a, c, g, or t
  misc_feature (455)..(455): n is a, c, g, or t
gatactgaaaacagcaccatgggccagctcacactgagggcagtgttagnnctaagcggcatntgggacagtttggtgtgagagcacacaagcagactcagaccctgatgggactgtggtgtaacagaacacagtcatcaagctcctttagaaagcatctcgtccaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722630 - DNA, 553 bp, Homo sapiens
  misc_feature (50)..(51): n is a, c, g, or t
  misc_feature (63)..(63): n is a, c, g, or t
  misc_feature (439)..(439): n is a, c, g, or t
  misc_feature (441)..(441): n is a, c, g, or t
gatactgaaaacagcaccatgggccagctcacactgagggcagtgttagnnctaagcggcatntgggacagtttggtgtgagagcacacaagcagactcagaccctgatgggactgtggtgtaacagaacacagtcatcaagctcctttagaaagcatctcgtccaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaananataaataaatttgtcacttagcttgtcatcagagagttctgcaagtttaatcttttgttaaaaacacagcttatcattaatacttcctgtgaaacggagcgtccacttaggc

SEQ ID NO: 722631 - DNA, 644 bp, Homo sapiens
  misc_feature (50)..(51): n is a, c, g, or t
  misc_feature (63)..(63): n is a, c, g, or t
gatactgaaaacagcaccatgggccagctcacactgagggcagtgttagnnctaagcggcatntgggacagtttggtgtgagagcacacaagcagactcagaccctgatgggactgtggtgtaacagaacacagtcatcaagctcctttagaaagcatctcgtccaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaagacaaaaaaataaaaaattaaaaaaaaataaaatctatttctagtcaaagtttcttttctgaattcttaatccactgtcaatgggccatgtccacctaagatatccctattgacaactcaaacatagcaagttccatacttaaaacagtaattgtcacccccagatgtgaaatattatttaccatagttaaaaacctgaatgtaccc

SEQ ID NO: 722632 - DNA, 1032 bp, Homo sapiens
agcggctctggttggaagaaggctatggagatccatatggaggaggtggtggtggtggtggtggtggtggtggaggaggtggatatagaagatactatagatctataaacagattaggatagcgaggtggcttgcgttctgtatagtaggactagcagttagacagataggtgcttccaaaataagccgagtagcttgagatagtcaggtcgtgtgtgcaagctaacacgagcccgatggttaggacgtcccatggtgataccacgttctggcaaatgggcttaagtatgtaagaacattgttggtagattaccgagttgatcgtctcgaaatgaagtggatgacgttttgtccgagtattcgtgtgctaccctgtggagctatgtaagtgtcggtttttaaaaaacgagaagaaagaagaacgaaaattattctcggaaagatgtaaatatttattacctatcagaactatggagaatggaaagtagttatactggatcagtgaatggagatttagacttgtaaccttgtgatctggtatcagggtgtagacgagcagtatacagaaggaccccgagccgtgtagagtacgcacaagggaactagtagtacacgcgtggcctcaacgcgggtacttcgccatgatgcgcatggttgtaatgccggggaattcggccattacgattgagagcaaaacctacggggaacagggcacatgtcccaggattgctaaatttaggaaaggccaggtaggtccgcctggaagatccattgttgtgggtactccttgatagtgcacgggaagacttaccgtcttcgtaggcccattgggtcccttggttgagaagcttatcgacttgaggtttggaatgaccccaaaggatttaacgtcattacctggtacaataccttatatttctaaatgcgcattgggcaatacagcccatgcattaggggtggaaaaacgccacagttgtaaggaccgagagcacagaaatatgcttacatcgtgaccaaggaaccattaacaca

SEQ ID NO: 722633 - DNA, 161 bp, Homo sapiens
cctgaattctgttagtctgtctctagagtatccccattcaattgctgtaccatcctggcgtgcagacccgctcagagatccatgatgtgctattgggacagtaagggaatagaggggcagagaaggatgaaggagttcatgggagacgcatcacacagtat

SEQ ID NO: 722634 - DNA, 583 bp, Homo sapiens
  misc_feature (470)..(470): n is a, c, g, or t
  misc_feature (474)..(474): n is a, c, g, or t
  misc_feature (477)..(479): n is a, c, g, or t
  misc_feature (483)..(483): n is a, c, g, or t
  misc_feature (485)..(485): n is a, c, g, or t
ctcggtacccgcgaacatgcggcatgcggcaatgatataatacttttaactctcacggcaaattagtcacttgtcaagtccattgagagaccaatggagtcttgtttcatcattttatatcctgtataatttttttctaacttgagcgaagttttatactgtatttagttcaatattctacgttaaataaaaccagggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722635 - DNA, 230 bp, Homo sapiens
tactactactaaattcgcggccgcgtcgacggagtcttgctcttcggctccagtgatcctatctttcttaccctcctgagtagctgggactacaggcatgcaccaccatgtggctaattttaaatttttttgtagagacagggtcttcccgtgttgcttatgctggtgttgaactcctggactcaagcaatcctcctgctttggcctgctgagtcgacgcggccgcgaat

SEQ ID NO: 722636 - DNA, 195 bp, Homo sapiens
aggaacagagagaaaaaataaaaaattcgaccagagcctaaggaaccataggatgccagggggagaaccaacatatgcatggtcgatgctccagaagcagaagaaagagaaagtgacagagagaatattggaagaaaaattctattggacggggggaaaactttccaatttggaggaaggacaatttaaacccct

SEQ ID NO: 722637 - DNA, 739 bp, Homo sapiens
  misc_feature (626)..(626): n is a, c, g, or t
  misc_feature (630)..(630): n is a, c, g, or t
  misc_feature (633)..(635): n is a, c, g, or t
  misc_feature (639)..(639): n is a, c, g, or t
  misc_feature (641)..(641): n is a, c, g, or t
caggccccgtacaatccatttacagcattgtgtagtttttaagtttgaaactatacagtgggtcagtggtagaactagaacttgaatctcagagcaccatattcccttctcttaccaccacaaagatcaatggatggaaactaaggataagttatggtaccaccctcaccacattgttcggggcctgcaggccccgaacaatattctatttggtgcacgccaattcaagccctcacaatcccacgaccaagtagtgacaatatgatgcttcctagtttggtcttagcaacccatcctacagccatcttggactgaattctgcctctggaaatcaccattaaaacaaaaatcaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722638 - DNA, 1077 bp, Homo sapiens
tggaaagggagtctccctcggtggcccaggcgggagtgcaggggcgcgatctccctcacggcaatctcggcctcccggggttcaagtgattctccggtctcagcctccagaaggtggcgtgggactacgagggtggtgcaccatcagccagtgccgtgggctacttttggacatttaaatagaagaagtggggttctctccagtggtgtgccgccgggcgtggtcttcaacctccgtgaaccctcagaggtgatcgtgcgctgtgcctctgcggacctctcaccaaaaatgtggcgtgggaaatatacagggccctgtgacgcacaactgtggtgttcgcggctccagatataagctgtgtgattattttaaaatctccctcaacaacgggcgtgatatgtcactataggggagaaaaaccgcgctccaatattcgtggcactataacacaattcgcgcgagaaaccctcgtgggcgccctcgtgggagaagaagtgaaagtgtgggtatatgtcgcccacaatgatatgcgctatatagagggcgctaagagcgccttctatagagtgtcccacaacaaattgcgatagcgcgataaccgtgggaagaaactccacgacacgtgtgtgcgcaaacacaaatgctctactatagaaaagaagacaagctgtgccaccacttcctggggcggccgccggtggacaagcaccacaggtgggggggccccacaacgcgaagaaccgcgacgttactccggctgggggccaacaccaggctattccatatactatgaggggggaggaggaccacaaaaccatccccctgctacgcacccaatgatgggtggtccctccccgattcacgccgtgggacgatccaccatacaacagcgtgcctcactagaaaagtcctgccgccagttaattcgtccaccgaaggagaaacatagcctggtgggcaacccaacaaacggaggggggggatacaaactttctccccacccgaacgcacggcgggatgcacacaccactatgtggcggacaaaacaacggcggggtgtattcaactcaaaaacga

SEQ ID NO: 722639 - DNA, 745 bp, Homo sapiens
atgctctttgtgttcttgcgcatattgtaaaggagctctagagcagtttatggaggaggctgttctgagatgttgagtggctcatgctggtgacacagcttgccaatagaacaccaggcaaatagaagctgtagctaatggagtcttatgactaaagtacatgagtaatgttgaacaacgcaatcatagactgacaattgcatggctatgacagtggagatctctgggtggctagcagtgtcaaggggctgcatcacaagtgtaaggcatataccacatgcgtggattggatatgaaggtgaatggcaccagttggagatatgagtatcgctgggtataagagcaaagtttacaagctgaagcgacaggttcttctgagtgcagctggaagcagcaagaggtgatactgcgtgtggacaacatcatcagaagcgggacccaggaaacgtgtcacctgatcaccgaccccctgttaatgcattcccacgtgcgtgtcgatctttggaccagttgtctagcacatagattgtgtttgagaagatactctagttaaagaagactgtggaatctggttgatcggtgcgccgattgatatccttaagttgtggatatttagctgagcttcgatttagacataggtctaatttatttggcggtcagtttccatacaaatcagttgagtttaaaagagttcatgtgtcatactgtgccattaaaatagaaattgaaccaattaaaaaaaaag

SEQ ID NO: 722640 - DNA, 435 bp, Homo sapiens
  misc_feature (34)..(34): n is a, c, g, or t
  misc_feature (322)..(322): n is a, c, g, or t
  misc_feature (326)..(326): n is a, c, g, or t
  misc_feature (329)..(331): n is a, c, g, or t
  misc_feature (335)..(335): n is a, c, g, or t
  misc_feature (337)..(337): n is a, c, g, or t
cgtcctgtctacatggaaacttctactctatttnaaaaccaacagtatggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722641 - DNA, 156 bp, Homo sapiens
  misc_feature (106)..(106): n is a, c, g, or t
  misc_feature (113)..(113): n is a, c, g, or t
gggactagagggtgtggccagcagcggacttagctctcagccctcttggccttgcgtgaggagagctgcttcacccacagacatgccctctccctagggcaagtangtccagngcctcatcaatgtggaaaggaagtgaaggcccagtgcctcccc

SEQ ID NO: 722642 - DNA, 185 bp, Homo sapiens
  misc_feature (32)..(32): n is a, c, g, or t
  misc_feature (44)..(44): n is a, c, g, or t
  misc_feature (76)..(76): n is a, c, g, or t
  misc_feature (134)..(134): n is a, c, g, or t
ctgctgggccttcgagatgcgccggtgcacgnagccccacaggnccgggtgcctggactgctagcaagctgggcgncattccggatgctctgcccaccgtggctgcgccaggcccgtgtgtcagcgctgcggancagccgcttcgctctggtcgtgcaggtgtattgcccgctggaaggctcccc

SEQ ID NO: 722643 - DNA, 620 bp, Homo sapiens
  misc_feature (507)..(507): n is a, c, g, or t
  misc_feature (511)..(511): n is a, c, g, or t
  misc_feature (514)..(516): n is a, c, g, or t
  misc_feature (520)..(520): n is a, c, g, or t
  misc_feature (522)..(522): n is a, c, g, or t
caggccccgaacaatccagtgctccagagatcctgtgcaccattgcccgagaactcctgggaagaatctaattgaaaatatgaataatcattaaaataacatcatcttgctctgttaagaaaattccctctttcatagctcatatttggccaaataatcacacaaaatttacattttaaataattccttgtgtgtcttataggcacagttttacaactattaaaaagttttacggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722644 - DNA, 231 bp, Homo sapiens
acatcaataaatcaaatatgcaataaagtgggtcataggaattttggatttcccagtgcacgtaaaagttacactatagtggtattaatgtgtgcaataccattacatctaaaaaccactgtacataccttaattaaaaatactttatggctagcaatcatctgagccttctgcaaattgtaatcttttggctcgtggagggtcatgcatggatgtggctgcgctgaaacg

SEQ ID NO: 722645 - DNA, 536 bp, Homo sapiens
  misc_feature (423)..(423): n is a, c, g, or t
  misc_feature (427)..(427): n is a, c, g, or t
  misc_feature (430)..(432): n is a, c, g, or t
  misc_feature (436)..(436): n is a, c, g, or t
  misc_feature (438)..(438): n is a, c, g, or t
acatggtgctggaaagcaacaagcagcatttaaaaagtgttcattacagcataatgcatatatgggaaattcttacaaaatattaactgaagaaaactagatagaacatgtagtataaaagcatgaactcatttaaaatgcataaggggggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722646 - DNA, 520 bp, Homo sapiens
  misc_feature (407)..(407): n is a, c, g, or t
  misc_feature (411)..(411): n is a, c, g, or t
  misc_feature (414)..(416): n is a, c, g, or t
  misc_feature (420)..(420): n is a, c, g, or t
  misc_feature (422)..(422): n is a, c, g, or t
caagcgatagcggcctgctttagggacctttggggatgacggtaatgtcctctatattgattgtgggcatggttacatgagcatatacatttatcaaaacttattgaactatacatttaaaataagtaaatagggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722647 - DNA, 382 bp, Homo sapiens
ccctgaaagatactggttccacaagtttattaaaacaaataaaataaaatggccgggtgcggtagctcacgcctgtaatctcagcactttgggaggccaaggcgggtggatcacgaggtcaggagattgagatcaccctggccaacatggtgaaaccctgtctgtactaaaaatacaaaaaaaaaaaaaaatattagctgggcttggtggcccgtgcctgtaatcccagctactccggaggctgaggcaggaaatattgtttgaccccaggaggtgaaggttgcagtgagccaggattctcaccattgcactccagcctgggcaacacagggagactcctgtctcaaaaaagaaaaaatttttaccggtgaaagatgggcaa

SEQ ID NO: 722648 - DNA, 516 bp, Homo sapiens
  misc_feature (403)..(403): n is a, c, g, or t
  misc_feature (407)..(407): n is a, c, g, or t
  misc_feature (410)..(412): n is a, c, g, or t
  misc_feature (416)..(416): n is a, c, g, or t
  misc_feature (418)..(418): n is a, c, g, or t
caatggaaaaatgggcaaaagacctgaatagacatttatccaaggaagataaacagatggccaacaagtgcatgaaaaaatgctcaacatccctgattattagagaaatgcaaatcaaaactaccatgaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722649 - DNA, 719 bp, Homo sapiens
gtaacttgggcttgcggctgtcactggacgtctgcgtccaggtacactgctcagagccaagcccgagatgcggttaggaggtatcggaccgcaccaggtatgcttgactacgtactttcgttggactgactagcgcctgtacgaagaggaggtgcgacgacacgttcctgacggttaacatgaaatcagagttcgacgagagctggaaagagtccacgctgtagcctttgagcaagaaagcttactacgcgtgcggtaactcagcggatgcccttagtagctcagccaaagaccgagctgttcgagcctcatcagcattagttcgtcacttgcagaattctgtcatcacgtcgttagatcacgcgtaacaatacagagccttgtgactgtagtctagtgacaatgtccttgtggagctgtacaagctcgtggaactgcgactcccacgatgctgggatctaggggagataagctcgggtccccaatgcggtctacaacttacaagagtacgtacaatcatggtattttctctcaatcagatcgacttgagatttatgaccgtcgggttgtcactcggggtataactgacgaaattgcaagaccgttaacatcgaaattgcgccacggccaccgagaacgatccctgtaccttgccttctttgttaagcaactgcggctggacattgacacaagcgcgttccttgggaagaggaggcgag

SEQ ID NO: 722650 - DNA, 117 bp, Homo sapiens
gaattaatccctctcatggaagttactggagttttagagggtcgagcaaaacagttatacagtgcaggttacaaaagtctaatgcacttagctaatgcaaatcctgaagtgctcgta

SEQ ID NO: 722651 - DNA, 285 bp, Homo sapiens
gtcgaccgaatttggctacagaacagggcgatggacctcatggccacatggctccaaggagtaagaccctggaccaccaccccagcaagagcacaagaggaagagagagaccctcactgctggggagtcctgccacactcagtcccccaccacactgaatctcccctcctcacagtttccatgtagaccccttgaagaggggaggggcctagggagccgcaccttgtcatgtaccatcaataaagtaccctgtgctcaaccaaaaaaagaaagaaaaaagtggac

SEQ ID NO: 722652 - DNA, 102 bp, Homo sapiens
attagaatcgagctctggtaccccaggtagacctaacccaggtagccaggtagacctaacccaggtagacctaaccatcttctccttacacctagcagtgtg

SEQ ID NO: 722653 - DNA, 393 bp, Homo sapiens
  misc_feature (17)..(17): n is a, c, g, or t
  misc_feature (51)..(51): n is a, c, g, or t
  misc_feature (59)..(59): n is a, c, g, or t
  misc_feature (73)..(73): n is a, c, g, or t
  misc_feature (125)..(125): n is a, c, g, or t
  misc_feature (337)..(337): n is a, c, g, or t
tctgcaaggcttccccntgaacatagtcagtaacaactgtgtccaaggccncagtgccnatgaagagtaaggnctacacacagggaatagtccttcgcagagcaaggattcaaataaccagccgnaaccagacccaggagcaaaccactgacaaccctctcgatagtccagtgaagagatacagccttgaagccagaatggtggctcggtcacaagtgtatgtggtgcactccacaccattctggtatagctcggtcctgaagaaatgttgagatatgagcaggtctgacctctgagagttcgaagccacagagctcggcctcatagggcaccgcangcggcactcagcctacagagacccgacatcgcgctcctgagggctcaaggtcatcc

SEQ ID NO: 722654 - DNA, 304 bp, Homo sapiens
cgcgtgcacacacacacacacacatacacacacacacacacacacacacacacaccccctccccccaaacaacaaaattcagagtatgtcaaaggaaaagggtgtgttattgtatagatcaaaaccgagtggaatcaacaccatctatcttagcttagcaggtatggtgttgagatcttgagtctatattagtggaatctattgttgcattgtgaaatagagaattggggatataccattatgttatagagtcctagaaacaatttcgaaaagcattatagtgtggagtacagtgggatgggag

SEQ ID NO: 722655 - DNA, 5630 bp, Homo sapiens
gcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgagcaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaaggctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaattaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaagctaaggaactgtctataagtcagagtcctgttcctacatatttgttcaaaagcttggcatgcagcaggcccttcctgagcgggtgattcagtgttgagtttcaaataataaacaggcagcattcagttggctgggcgaacaagaaaaacacaatggaaaaggaatgagtttgagacttgtaatgggaatgaaagtagtaagccatattccagctaaataagttaaatgcatttggggaataaagaacaaagagtaagcaagcaataattgcttgaaatattctttcaaattacaacaaaaaaaaatactttcttaggacatttcgtattaacctggtgcaggatacacaaggtatccttacaatgtttccaggaggcacgaatattatcgtccctggcttgctaagtcaggaacttgaaacactggcaaagttaagtactcggtgaagtcgcctaaagctttccaacacagactctctcaattgaggttcgaatccatccgacattg

SEQ ID NO: 722656 - DNA, 5120 bp, Homo sapiens
gcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgagcaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaaggctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaattaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagta

SEQ ID NO: 722657 - DNA, 988 bp, Homo sapiens
tggaaacagagtctcgcttggtggcccaggtgggagtgcagtgactcggttcagtgaaacctctgcctcccaatatcaaaaaatctctggtactacagcctccggagtagcggggaatggcgaggctattggtctaccacgacccacctaaatattgggtatctccaagtaagaagaacgagggttcacgcgcatgatagggccagcgcgtgacacaaaaagctccatgaacaactccagagaaatcaaacaccgaactggacatctaccaaaaagcgcatgagacacataacatcagaaaccatcaagaaacaaacagaaaacaaaagatgaataaaaaataaaaaaacacagtggaaacaacatgagaacaaaaaccacaaaacaacaaaacgcaagaaacaaacaaaaaaacgagaactaaaagaaaaatagaccaaagaacaaaaaacaaaacatagaaatcaaaaaaacacaacacacagaagaacaacacatacaacagatcaacacacaaaaaggacacataacagaaacaaaaaaaaaaaaaagcacaagaaaaagaaaagacaaacaagaaaacaaacaagaaaaaagagaaacgcgaaagatagaaacacaacagaaagaaacaacaacatacaaaaaacaagagaacagacaaagagagagataaaaagacagaagaaaacaacagataactccaacgcagacaagacgatatagaagagcgaaaaaacaaagagaacatcaagagcacaacagaacaaaaaaaaaaagaacaagaaaaaagacacaagaacagcaagaacacaacagaaagaaaacaacagcaaacacaaagaagcacagatgacagaaaacaacaaaagaaagaaaccaagaacaaaaaacaaaacaacagcaagagcaagaagagaaacaaagaaaaaaaatgggaaagaacgaaggagagagacagaaaacagacgatgacaacgcaaagaac

SEQ ID NO: 722658 - DNA, 3954 bp, Homo sapiens
gcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagctacgagcttcagctcactgcctcagacatgggagtacctcagaggtctggctcatccatactaaaaataagcatttcagactccaatgacaacagccctgcttttgagcagcaatcttatataatacaactcttagaaaactccccggttggcactttgctcttagatctgaatgccacggatccagatgagggcgctaatgggaaaattgtatattccttcagcagtcatgtgtctcccaaaattatggagacttttaaaattgattctgaaagaggacatttgactcttttcaagcaagtggattatgaaatcaccaaatcctatgagattgatgttcaggctcaagatttgggtccaaattcaatcccagcccattgcaaaattataattaaggttgtggatgttaatgacaataaacctgaaattaacatcaacctcatgtcccctggaaaagaagaaatatcttatatttttgaaggggatcctattgatacatttgttgctttggtcagagttcaggacaaggattctgggctgaatggagaaatagtttgtaagcttcatggacatggtcactttaaacttcagaagacatatgaaaacaattatttaatcttaactaatgccacactggatagagaaaagagatctgagtatagtttgactgtaatcgctgaggacagggggacacccagtctctctacagtgaaacattttacagttcaaatcaatgatatcaatgacaatccaccccacttccagagaagccgatatgaatttgtaatttcagaaaataactcaccaggggcatatatcaccactgttacagccacagatcctgatcttggagaaaatgggcaagtgacatacaccatcttggagagttttattctaggaagttccataactacatatgtaaccattgacccatctaatggagccatctatgccctcagaatctttgatcatgaagaagtgagtcagatcacttttgtggtagaagcaagagatggaggaagcccgaagcaactggtaagcaataccacagttgtgctcaccatcattgacgaaaatgacaacgttcctgtggttatagggcctgcattgcgtaataatacggcagaaatcaccattcccaaaggggctgaaagtggctttcatgtcacaagaataagggcaattgacagagactctggtgtgaatgctgaactcagctgcgccatagtagcaggtaatgaggagaatatcttcataattgatccacgatcatgtgacatccataccaacgttagcatggattctgttccctacacagaatgggagctgtcagttatcattcaggacaaaggcaatcctcagctacataccaaagtccttctgaagtgcatgatctttgaatatgcagagtcggtgacaagtacagcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgagcaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgttgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacac

SEQ ID NO: 722659 - DNA, 368 bp, Homo sapiens
atcagtcggccctgattatgtgataacctggtcttggtgcacgatggtagtagatgaactgtgggttctgcatgacagtatcactggtgatacagtcgtcactctcgccccgtggatgtcggcgagaacctgatgggatcttcccattgtattcctgtcttccggatggtggaatacacctcgtccccttcaaacagaaacagggagtactcgtccgggctgaagggggcatagcctctcatctcgccaagtgggaccacagtgccattcgaccaggttccagcagctggggtgccgggcgtcggtgccacaggccagtagcccctcactccgcctctccaggagagtgatgtagttctcgcagtccc

SEQ ID NO: 722660 - DNA, 766 bp, Homo sapiens
  misc_feature (393)..(393): n is a, c, g, or t
  misc_feature (720)..(720): n is a, c, g, or t
gaaaaaatgtcccccatagtgcctcctctctaataccacacgccgttgcattctctctcaccaaggtaaccatttctctctcccgcaccggtcctctcccgcctcattggcacacggtgtctcctttaccccccctactctgtaccttcactcattggttatataaatagagaccatctctccccgccctctcgtaccaacatttggttttttttacataacaccagttggccacgcgcgctgccccacttctcttcgtcaagatcatttcgtcttttctcctccccaaatattttcgtctgtatcgaattttttgagacgcccatctagttggcgggtgcatgctgcgcagctttctatcttgtggattgttacgcctcctatatagtattnatttccaaggagtactccgtactattttgataacccgtccgcgagtgtgttagataattaactcacagaatattttcgagggaggtgatgttccatgtggatatgccccctgttgaaaacaatctctcttttctctatcggtgatacaggctggtcccacggtcctgggtcaataatttctggggccccaggcttttgctgtaacccccccccagcccctttaattgtgcaaggtgtgacaacctcccacacaagcgaaataagaggggttagcgaagatatacgagttatcgtgcgcgagtgagagacacgctcagttctaccganggttccagcaaagatctgcagacaccgtgcgccccacccatgacaa

SEQ ID NO: 722661 - DNA, 721 bp, Homo sapiens
  misc_feature (613)..(613): n is a, c, g, or t
  misc_feature (653)..(653): n is a, c, g, or t
  misc_feature (659)..(660): n is a, c, g, or t
gactctcgtctggccgccgcgctttcaggaggtgctttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagctctctgccantcactcaggtcctgggcattgttcaagctgagtggagcgntcttgnncacctgtgacgaaggttggtcctgtccaccgtgccggcatcttacggccctccatccatgg

SEQ ID NO: 722662 - DNA, 246 bp, Homo sapiens
  misc_feature (242)..(242): n is a, c, g, or t
atgttgtacatgtcggccggagtagcgtatcgatgggcagttgaggcggcgcatatgcatctaggctataaatatctggagtatacgtacgcggtacagtaacaaccggtacctctagaatatagctagatgcgaaattaaagcgctgatatcgatcgcgcgcagatctgtcatgatgatcattgcaattggatccatatatagggccggtgtaataattacctcaggtcgacgtcccatgnccat

SEQ ID NO: 722663 - DNA, 1088 bp, Homo sapiens
  misc_feature (135)..(135): n is a, c, g, or t
  misc_feature (652)..(652): n is a, c, g, or t
  misc_feature (1075)..(1075): n is a, c, g, or t
aatcgctacctgctctgtgccaggctggtctcaaactcctgatctcaaatgatccacctgcctcggcctcccaaaatgtcgggattacaggcatgagccactgcaccggcctacacctctttattttgtcatctntcaataattttctctttgatgtctctttctttgcctggagactaagatgtttttcaagacggataccagttcttatacatcttggtcactcccctcagcacagtgcctagcatagaaagagaaaacctttggatgattgaataacttgcccagagtcaggttctcagtcatccaggcaggctttgctgctggagtatctttggttgttttctggggattacgttcgcttgccacagtttttctccccttttccttcttgcatatctggttctgattgagcctgaatttctatgagagcagatgagagaccactggatgtagactgggttagattgagtatcctgttgcatacaatcccacactgtaggatctgccttggcaatacctctgtcactcttttcctgcttctccccagtgtctcgactgcattgtgagagtgaatctttcaagatggatctaatcttagatgtaaacattcaaatttaccctgtagacttgggtaagtattgaatacagncaataataagagactttttgctgcttctgctattctttactctctgatattgctgttattttcaggtgacaagtttcggttggtcatagctagtaccttgtatgaagatggtaccctggatgatggtgaatacaaccccactgatgataggccttccaggtgagggagtggagaaggtaatacttgaaatatgccttgaggactaagtagataagtgatatagaaagactcttctaaaattcctggaataaatgatgatcagcagaatctgagtaaccttaaggaaatttctgcacttaagaattcaaacaggccaggcaccgtggctcacacctgtaacccaagcactttgggaggccgaggcaggaggattgcttgagtccaggagttcaagaccagcctgagcaacatagcgaaacctcnctgctacaaaaaa

SEQ ID NO: 722664 - DNA, 481 bp, Homo sapiens
tgatcagctcgtccagataagagaaccaggcagcccgggcatgagaaaacttcaaaaattagaatccggcctcaaacctcgcaatgggcattatcaaccttgccttcaaggtgtacaatactagagaggaggcagccagacagcaacacatttctgagttacaattacttgcctctgctgtgagacaaaacccagccgcatctccagcatacaagaacttcaaaacgcctgaactgcagcggccaggcattcctccaggaccacctgccccaggatcttgcttcaagtgctggaaatctggccactgggccaagtattgcctgcagcctgggattcctcctaagccatgtcccatctgtgcaggaccccactggaaactggactgtccaactcacccagcagccactcccagagcccctggaactcaggcccaaggctatctgactgactccttcccagatcttctccgcttagcggctga

SEQ ID NO: 722665 - DNA, 1066 bp, Homo sapiens
  misc_feature (135)..(135): n is a, c, g, or t
  misc_feature (958)..(958): n is a, c, g, or t
  misc_feature (998)..(998): n is a, c, g, or t
  misc_feature (1004)..(1005): n is a, c, g, or t
aatcgctacctgctctgtgccaggctggtctcaaactcctgatctcaaatgatccacctgcctcggcctcccaaaatgtcgggattacaggcatgagccactgcaccggcctacacctctttattttgtcatctntcaataattttctctttgatgtctctttctttgcctggagactaagatgtttttcaagacggataccagttcttatacatcttggtcactcccctcagcacagtgcctagcatagaaagagaaaacctttggatgattgaataacttgcccagagtcaggttctcagtcatccaggcaggctttgctgctggagtatctttggttgttttctggggattacgttcgcttgccacagtttttctccccttttccttcttgcatatctggttctgattgagcctgaatttctatgagagcagatgagagaccactggatgtagactgggttagattgagtatcctgttgcatacaatcccacactgtaggatctgccttggcaatacctctgtcactcttttcctgcttctccccagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagctctctgccantcactcaggtcctgggcattgttcaagctgagtggagcgntcttgnncacctgtgacgaaggttggtcctgtccaccgtgccggcatcttacggccctccatccatgg

SEQ ID NO: 722666 - DNA, 158 bp, Homo sapiens
tggttggtggcacacggaatgaagacatacaacggcaatgaaatttatcttcattcagattcagaaacctcattcgttgtaatcttctttcattgaatgcatgcattatgacgtaaccgcgtcaaggaaatacgttaccacttcaggaagatcggtat

SEQ ID NO: 722667 - DNA, 122 bp, Homo sapiens
gtctctgaaatctgcaggtacctcacacagccctgagctctgggccatcatgcggctggcagcctctatgctgggcatgctgggtactgcagccctagatgttctccagcagacacagaggg

SEQ ID NO: 722668 - DNA, 1149 bp, Homo sapiens
  misc_feature (135)..(135): n is a, c, g, or t
  misc_feature (652)..(652): n is a, c, g, or t
  misc_feature (1041)..(1041): n is a, c, g, or t
  misc_feature (1081)..(1081): n is a, c, g, or t
  misc_feature (1087)..(1088): n is a, c, g, or t
aatcgctacctgctctgtgccaggctggtctcaaactcctgatctcaaatgatccacctgcctcggcctcccaaaatgtcgggattacaggcatgagccactgcaccggcctacacctctttattttgtcatctntcaataattttctctttgatgtctctttctttgcctggagactaagatgtttttcaagacggataccagttcttatacatcttggtcactcccctcagcacagtgcctagcatagaaagagaaaacctttggatgattgaataacttgcccagagtcaggttctcagtcatccaggcaggctttgctgctggagtatctttggttgttttctggggattacgttcgcttgccacagtttttctccccttttccttcttgcatatctggttctgattgagcctgaatttctatgagagcagatgagagaccactggatgtagactgggttagattgagtatcctgttgcatacaatcccacactgtaggatctgccttggcaatacctctgtcactcttttcctgcttctccccagtgtctcgactgcattgtgagagtgaatctttcaagatggatctaatcttagatgtaaacattcaaatttaccctgtagacttgggtaagtattgaatacagncaataataagagactttttgctgcttctgctattctttactctctgatattgctgttattttcaggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagctctctgccantcactcaggtcctgggcattgttcaagctgagtggagcgntcttgnncacctgtgacgaaggttggtcctgtccaccgtgccggcatcttacggccctccatccatgg

SEQ ID NO: 722669 - DNA, 261 bp, Homo sapiens
cggatgacgccggtgcagcgggggggcccggaggcctggtggccctgggatggggaaccgcggtggttccgcggaggtttcggcagtggcttcggggccgggtcgcggcgtggacggggccgggcgaggccgtggactcgcggggggaggccgaggataggagtgatgcccgtcaaccacagttgggccgcttgtcaggacatgaaggatcatgtcccgtggaggagatctatctcttctcccctgcccattaaggaatca

SEQ ID NO: 722670 - DNA, 954 bp, Homo sapiens
  misc_feature (135)..(135): n is a, c, g, or t
aatcgctacctgctctgtgccaggctggtctcaaactcctgatctcaaatgatccacctgcctcggcctcccaaaatgtcgggattacaggcatgagccactgcaccggcctacacctctttattttgtcatctntcaataattttctctttgatgtctctttctttgcctggagactaagatgtttttcaagacggataccagttcttatacatcttggtcactcccctcagcacagtgcctagcatagaaagagaaaacctttggatgattgaataacttgcccagagtcaggttctcagtcatccaggcaggctttgctgctggagtatctttggttgttttctggggattacgttcgcttgccacagtttttctccccttttccttcttgcatatctggttctgattgagcctgaatttctatgagagcagatgagagaccactggatgtagactgggttagattgagtatcctgttgcatacaatcccacactgtaggatctgccttggcaatacctctgtcactcttttcctgcttctccccagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgagcctccagcaggacacagataacatgcaggcaatggagatggactcgataccgtgcgtcttgaaactgcagatgcgctctcacaccttttcgctgatctcgcggccc

SEQ ID NO: 722671 - DNA, 459 bp, Homo sapiens
  misc_feature (46)..(46): n is a, c, g, or t
tcccggaaaaactgtaaacccttgggtgtaaatggttaaccgggtnctttggtggacattaaagaactgggcctatgggagcccttggctgtgaagctgccgacttattaaccaacagtggagacggccgttttgcttctgcgaatttatgacctcgtttccggcccccaaaaaaaaggggatggccaaagccggccaggcgggggtccttattctggcccggagtgagtgctaggccagggttcttcaatgcccagaacccgcagagtttccccctttcctgagccagagggcccggaaccctgtgggcgtttttgttcaaaaggggtccgggtggggggcagccccccgtccccttttgtcccaggtccgttttcccaaagaccctgacatggaatttttttttattggaagggttccctttagtttgcttcccatgatttaattttagtcctttta

SEQ ID NO: 722672 - DNA, 407 bp, Homo sapiens
cgaatcgaggctgaaaccacgaaaatcggtcacacagtaagagctaccactatgcacattggagttgtctccaacatactcggatgcataccctagcatcacacacgcgcagcgaagtcccgcgatctaggcctacttacgagccaaaacctgcccctactcctcctagacctaacctgactagaacagctatgagctaaaacaagtccacagcaccgaatctccacctccatcatcagctcaacccaaaaaggcataattgaactttacttcctctctttcttcttcccaattctaattctactgactatcctagtaaatcgctgtcgcctttatccaagcctacgttttcacactgtcgtagtaagcctctacctgcgcgacaacacataatgaccgaatatctg

SEQ ID NO: 722673 - DNA, 223 bp, Homo sapiens
  misc_feature (2)..(2): n is a, c, g, or t
  misc_feature (61)..(61): n is a, c, g, or t
gnaggacccccctgcgacagagttaggcaatggttgagctaaaactttcaagtttgtgtantgtggagctgaaagctgactttgtagatgaggactaccattttggagagaggctggactcccatgtggcttcagaagacaaaaagaggatcagtggatcaaagttacaaaaagaggacttgactatacaacttcctaatgatggagtgggctgctgtgacta

SEQ ID NO: 722674 - DNA, 868 bp, Homo sapiens
  misc_feature (139)..(139): n is a, c, g, or t
  misc_feature (592)..(592): n is a, c, g, or t
  misc_feature (868)..(868): n is a, c, g, or t
gaattgaaaagttttagcagtggatttacagcctgcttaatacttctatttcttacaaaacaaccgtataggggttaaagtatcagtgcaaagtcccgttcaaatatgactcagtaatgagctctacaagccagccttngtggcatgttaaattcaaaacaaagcttagcattttttttttttttttttggggataagaaacgggggggggggtgggggaaaagaaagagggacttggggaagaagaagggaggggaacttaaacctggttcctggctactggtttttctcaagaaaaccaaatatgggtatcttccatggaggagctggttttctggaccaggggaatttatgtggaatcttccgggaggttctcacccatctccagggacacaccagtgcagtgcaggaactcagggacaaaaagctgccaggcataacaggaagataccagaatggcggttaccaaataaaatacggggcagatgtgtgggtcacgcgggtaatcatagcacttcgggaggctgaggcaggaggataactggagccataggagtggagacaggctgggacattagaagaaccatctctnaaagaaaggtggaaaatgaccggccaggggggtggcattgtcatcccaagactggaagggcacaacatagcccgagaaacacgacgttcggaaataggcgaacatggtccacgcggtgacacatggaacccgtccacacggaaaaataacctgtctcattgcagagaaagaacaaaaactttgcggctggcgaagatcacaccgtggcggccgaaaaaggactcgccaaaagcgtacggcgccacaacaggcagtggacacgaggcggacaagccn

SEQ ID NO: 722675 - DNA, 200 bp, Homo sapiens
aaccgatacacggtggcacggggggttaacttgagattcaacttcacaagatggtcccgtgcagcaaatgatatcatatggggtactggagcaagtcagtttacttggtttaatttgcgctagctggtaggtctgtgcaagtcattgatgagcgcacttacagcagtatatgtgagagtatttcagcgatcatgctgaac

SEQ ID NO: 722676 - DNA, 123 bp, Homo sapiens
tgtgtgatctgctacatgagcagtggagctggaggcacgtggatgcctgaatgatgagatcaacttctcagagacctcaatgagacggagttgacagagctgcagtcccagatctccgacaca

SEQ ID NO: 722677 - DNA, 2153 bp, Homo sapiens
cacgcgtacgagcagctggatggtgcctgagtgggtttgggacacggaggggcctgctggggggcactggagccctttggggagggaggaaagcctgtcttaccatggtgtggcgcttgccctgcaggtgggaggacagcttggggttgtggtgcatgcactcgtgggtggcatcggccaagtacaccttggagaaggccccagaactgatcttcttggaggagagcaggtagccattgtccttgcactcacgcacctgctccgtgaaggttctctgatccagcttctgcctgctgctgcccttcatggagggcagtgcatggaagggggtgtggtggtccagtttcaccagtcttggggggcacagctgagacctgacttgtgtcagagggcaggggccaggtggtagggggtgctgggtgggaactgcgtccctcttgaggcagcagccacacttctgaagacttgctgggactgcggcagaggcagggagtgatggggctgcaagctcagggcgggggctggcacagctctggactgggcagggggagggccagctctgggagacgaggtgcaggttctagagtggagaattgagctgtacctgcattgtgccctcaaagggtgcgtcttcttgtttgaggacctgcccactctgaggacatcttgtgggaccagtcctgcccacatggggcccactctctgtgaggtgaaaacccatttcaagggctgcagccaggtgaggcctctgtggacccctatggacgtggctggccacagaaagctgttaaagaaatgagggtggggatttctggggcataaggacaggaaaagggacacatacgtgtcaaccaccatttcaactgcaccccctccttcgagaggatgccatggccacactcagctgggccctaaggtgggctgagccagaggaaggcaggcaggagctctgtctcccggccttctccactggagcctgaagcacctcctgcccaggccagcaaggtgcaggaagcgtcccacctagagacctctgcagacttgaccacacaccccagggcaagcaagggccccactcctgagcctacctctgatcctacagttccaagagacagaagccaaccttgcccctcccttctggaccccagagtgccctgtgggcactaattactgctaacgtttgagtgccagctctgtgccgggtgccattctgggcagtcgcaccagctaccactaccacctgtagcagtcctgcccccgttcacagaagacattcaggagcccagcctgtgggggcagttcacatctgggatctcaagtcctaacacaaccaagcaatcctcgctttacagatgatgaaattgagccgccatggtggggaagcccaacccaaatgtgtcatctctgctgtgagctagacagcacagtggctgtgggcctggagggcagggctgcctgatgggcagccatcctgggaatgtctgcaagggtctggtgcttggtacagaccagtgagtctggggaattggggtctccaccaagatctgtgggtgcacttggcatgtttgctgcagaaaaggccccagaatgggctggcttgaactggaaaaacacactttctcatcccttttggaccacgagcttcttgagagcaaagcatgtgtttgatattcctttgctcaccctcaggccttgtttggcaaattgcctgggatacagaaaataaggacaaggtctgggtgtagtggcttatgcctgtaatcccagcactttgggtgaccaaggcaggaggatctcttgaggccaggagttgcagaccagcctgggtaacatagtgagaccttgtctctgcaacaaaatttaaaaattagccagacttggtggttcccacttgtaatcccagctatttgggaggctgaggcgagaggatcacttgagcgcaggaatttaaggctgctgtgagctatgattgtgccactgcactccagcctgggtaacagtgagaggcctcatttcaacaataaaacccagcttgggccgggcgcggtggctcatgcctttaatcccagcactttgggaggccaagacgggcagatcacgaggtcaggagatagagaccatcctggttaacacggtgaaaccctgtctctaca

SEQ ID NO: 722678 - DNA, 503 bp, Homo sapiens
  misc_feature (390)..(390): n is a, c, g, or t
  misc_feature (394)..(394): n is a, c, g, or t
  misc_feature (397)..(399): n is a, c, g, or t
  misc_feature (403)..(403): n is a, c, g, or t
  misc_feature (405)..(405): n is a, c, g, or t
gagcgttaggtaagagcggtctgggggaaagccctgggtaactctgggcaccggggaggggcagtgcgcggaatcgaggcacagccccaacttcagtgaaggcggttcaaaaacatggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722679 - DNA, 331 bp, Homo sapiens
attcctaccccagcaggaaccactaccctgacttttattttattttattttattttgagacagtctctctgtcacccaggcaggagtgcaatggcacagtctcaactcactgcaacctccacctcctgggttcaagttattctcctgcctcagcctcccaagtagctgggattacaagcatgtgctaccatacctggctaatttttatattttgagtagtgacagggttttaccctcaaattcctgacttcaagtgatccgcttgcctcagccaggaccagagagcgggggaaaacacccaataactagacatcttcatgtaactatcagt

SEQ ID NO: 722680 - DNA, 557 bp, Homo sapiens
tgatggcaggtaagcacatgaagggatgctcaacattattagttcatggggcaactggaaatgaaaaccacaatgagatactaataaaatctactagaaaggctaaaattaaaaagactggccatattgtgattggtaagaaagtggagctactgagctcgtccacactggtggcaggaatgtaaaaggtccacacttatttaaaaaccacgttgaacggccaggcgcagatggctcactgcctgtaactcccagacactttgggacggccacagtcgaggcagactcacgagactcaacgagactggagacccactcctgtgccaaccactggtgaacaccccggtctctacctacaacacactacaaaaacattacgctacggttgtggtctgcacactcgcctgatcactcgcaggctacctcacggaacgctgacggcaggacgacactcggttgacagccgggacggtggagggtatgcacgtgacgcatgacgactcagcacccacgtgtcactcatagccgtggcgaaccagacgcgagaactccatctc

SEQ ID NO: 722681 - DNA, 460 bp, Homo sapiens
  misc_feature (347)..(347): n is a, c, g, or t
  misc_feature (351)..(351): n is a, c, g, or t
  misc_feature (354)..(356): n is a, c, g, or t
  misc_feature (360)..(360): n is a, c, g, or t
  misc_feature (362)..(362): n is a, c, g, or t
agattaagaagatttatctgagattttactgaggttaagaagatcttcaggaagtgtcaagaatccatcctgaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722682 - DNA, 266 bp, Homo sapiens
  misc_feature (202)..(202): n is a, c, g, or t
  misc_feature (228)..(228): n is a, c, g, or t
  misc_feature (243)..(243): n is a, c, g, or t
aacccgcttcggcttcacgcgtgcgccggtaaggccaagctgttggtacaccgttgacctgccgtcagttgtgaattattggtacgcagttcgcgatcggtcaggccacggcagaaacttgccgccgtagaacaaacggttgttggcgttaccggttggttgagttgaagcaaacggccaattgccgcacatagcagccctnaagaaaaaatgctgcctttatgcgtntttacgcccgcagtngcgcggaacatatcaccttcgca

SEQ ID NO: 722683 - DNA, 453 bp, Homo sapiens
  misc_feature (340)..(340): n is a, c, g, or t
  misc_feature (344)..(344): n is a, c, g, or t
  misc_feature (347)..(349): n is a, c, g, or t
  misc_feature (353)..(353): n is a, c, g, or t
  misc_feature (355)..(355): n is a, c, g, or t
caaagcagagtgttcctctgatagcagttgaattagtcattagaattttaaaatgttctgatttggggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722684 - DNA, 522 bp, Homo sapiens
  misc_feature (82)..(82): n is a, c, g, or t
  misc_feature (91)..(91): n is a, c, g, or t
  misc_feature (147)..(147): n is a, c, g, or t
ccagcccgatgctgggggcagaacagtgagaaaagagtgagatggaaagggcgtaggactggcctggggaagctggacaggntggaggctngaggtcagtggtaggtaatggggattggggggtactgggtgtttagaggctgaaanagcacgtgggtaaatgaagattctttttttcttttctttttttttttttttttttgaaaaaaagtctctctctgttgcccaggctaaatgtgcaatggtgtgatctcggttcactgcaatctctgcctcccgagtttcaagcgattctcctgcctcagcctcccaagtcgctagaattacaaggacccgccaccacactctggctaattatggtatttaagtaggagataggtttccaccatgttggccaggatggtctcaatctcttgaccttgtgatctgcccgctttggcctcccaggttgctgggtatacaggcgtgagccaccgcgcctggttgtggctcctttatcctagaagtttcttggcctctcgt

SEQ ID NO: 722685 - DNA, 233 bp, Homo sapiens
gcaggttcaaggcaattctgtctcatcctcccgagtagctggacttacagccgcgcaaccaccatgcccagctaaattttggaattttccatagagacggggtttcaccaatgttggccaacttggtttccaattcctgaccttaggagatccccaacttcagctttccaaggtcttgggatccagggcatgaccattccacttggcgtttaaattttttagaggcaaagttt

SEQ ID NO: 722686 - DNA, 452 bp, Homo sapiens
  misc_feature (339)..(339): n is a, c, g, or t
  misc_feature (343)..(343): n is a, c, g, or t
  misc_feature (346)..(348): n is a, c, g, or t
  misc_feature (352)..(352): n is a, c, g, or t
  misc_feature (354)..(354): n is a, c, g, or t
attagatcacacagggcataggacattgctagtactgatcaatattcattaattaggagttcccgggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722687 - DNA, 278 bp, Homo sapiens
gcccttcaaaaacttttgcttgggggaaagtaaacaaaaaggatgggggtttggggcgaatgtccttaggcaaaaatggtttttattgggggggggggggggtgggggatttataataaagcaagcaaacccccccttgggtttcaattgaagataaaagaatggtttgggcaagcaaagccaatgggggggttttcccaaaaaaactttggaaatgagaggccaggaggggtcaaagggggatttttaaaagaaaaaaattcctttttataccccca

SEQ ID NO: 722688 - DNA, 441 bp, Homo sapiens
  misc_feature (328)..(328): n is a, c, g, or t
  misc_feature (332)..(332): n is a, c, g, or t
  misc_feature (335)..(337): n is a, c, g, or t
  misc_feature (341)..(341): n is a, c, g, or t
  misc_feature (343)..(343): n is a, c, g, or t
gtgtatctagaggacccggaacacagaagcggtaaatcacttaaaaggggaatgggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722689 - DNA, 501 bp, Homo sapiens
  misc_feature (387)..(387): n is a, c, g, or t
  misc_feature (389)..(389): n is a, c, g, or t
tcggacccggtatagcggtctaggactatctaaaactggtgataaagcaagtccacagaattagaaaattgactgtgactccatgcagattatattaaaaattttcttcttccgggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaananataaataaatttgtcacttagcttgtcatcagagagttctgcaagtttaatcttttgttaaaaacacagcttatcattaatacttcctgtgaaacggagcgtccacttaggc

SEQ ID NO: 722690 - DNA, 247 bp, Homo sapiens
ccttgcttggtgattccccggtattttctgttgtcattgttcgactccatgatactaaaacataatgaagaaacaaactccagtatggagaagagaaagccttaattatttggttccatctagaaaagcaacaccttaaaggagtccttcactaggattgtctcatcacctctattagataaatcatgaagtgtccctgtgaaattgaagtgacctatctctgtaggactcaagagactagctaagc

SEQ ID NO: 722691 - DNA, 518 bp, Homo sapiens
tcggacccggtatagcggtctaggactatctaaaactggtgataaagcaagtccacagaattagaaaattgactgtgactccatgcagattatattaaaaattttcttcttccgggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaattgagaacttgctgtgtcccacgtactggtatagggtgagtgcccctcatggctcaggagacactgaggccaacgtgtaggctccggctcttgcctctgtgcagatacttagcccgcttttgtatccgggtac

SEQ ID NO: 722692 - DNA, 547 bp, Homo sapiens
  misc_feature (433)..(433): n is a, c, g, or t
  misc_feature (435)..(435): n is a, c, g, or t
agccaatcaaatctatgtagtaccttctgatatattattagagaattttaaaatatcaatgtaataataggaagcacatataatttcatagctgaaattatataggtgcaatttttagctgtcaaagtggtaataatcaacatcaataaaactacaaggaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaananataaataaatttgtcacttagcttgtcatcagagagttctgcaagtttaatcttttgttaaaaacacagcttatcattaatacttcctgtgaaacggagcgtccacttaggc

SEQ ID NO: 722693 - DNA, 488 bp, Homo sapiens
  misc_feature (374)..(374): n is a, c, g, or t
  misc_feature (376)..(376): n is a, c, g, or t
cgggtaccccaccaaaagcggcaggttatgaaacaaactagcacccatgaggatgcaggttagatccctagcctcgctcagtgggttaagaatccagtgttggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaananataaataaatttgtcacttagcttgtcatcagagagttctgcaagtttaatcttttgttaaaaacacagcttatcattaatacttcctgtgaaacggagcgtccacttaggc

SEQ ID NO: 722694 - DNA, 795 bp, Homo sapiens
  misc_feature (637)..(637): n is a, c, g, or t
agccaatcaaatctatgtagtaccttctgatatattattagagaattttaaaatatcaatgtaataataggaagcacatataatttcatagctgaaattatataggtgcaatttttagctgtcaaagtggtaataatcaacatcaataaaactacaaggaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722695 - DNA, 234 bp, Homo sapiens
agagttttttaaacatttattttttaaatttttatttattttttatttacacattattattgtacatatttatagagtacagtttggtgttttgatacatatctctgctgtataatgatccagtcagggtagtgtattcatcacgtgatacatttatcatttctttgtgataataaccttgaaaagcctctcttctagctattttgtgatatacagtgttttactgttaactag

SEQ ID NO: 722696 - DNA, 659 bp, Homo sapiens
ggaccggactgcggttggggcgggaagagcctggggcctgtggctgacatggagcagccctgcatgctgatgtgcctgcgccctccccgccctgatggtggtgtgtgcccaccagtgatgatgcaatgctgcccagtggatgctgacccgagacttgtgatgcgcagcctgcctgcctgtggcctccctgggctcctcactgtcccacagccatgatgcctctcctcgcgcctccttcctgccgcctgagaatgcgaagggccatctctgatgtccgcctgcgccttctgtctcttctgtcaccttcgacctgctcttcatctccctgctctgtgatcatcgaactgaataccaacacatggcatcctgtaagaacttgtgagcagtgagatcatccagtacaactttaaaacttccttcttcgacatctttgtcctggccttcttcctgcttctctgtgacttgctcctagggctatgcctgtgcttgcatgctcctgtgcactggtgggtgatttgctgtgtcactgactgctggtgtccagtgcattcctcatatgtcaatggtcatcctctctgagctgctcagcaaatggggcatttggctacctgctccccatcgtctctttttgtcctcgcctggttggcgacctggttcct

SEQ ID NO: 722697 - DNA, 184 bp, Homo sapiens
cctcacgctcggcacctatgtgaatgtgtgtgagtgtgtatgtgtaatacacactcacacactattcacatacatacaagactcacaaacatacacaaaaatacatgtataatttgtataataagctggggtcagaatgaccatataattatatagggtttgctttgttatttgcctaaataaa

SEQ ID NO: 722698 - DNA, 104 bp, Homo sapiens
tccacactggaaaacaatcttttggccccattaaacttaaaagcacatgccgtctgacccagaagttctcagaagtactcattcactacccagtgtggagagag

SEQ ID NO: 722699 - DNA, 220 bp, Homo sapiens
tcgtacagttgcgatgcatgtgatttatgctgcagatggatcgggacatactgacggacgctcaagtgggcgaagatcgagccgcattgtttaggcaagcggactgaccctggcgaagcggcgagacaatcggttatttgtggaggcggtgttgtggatcgcgcgcacgggcagcccgtggggtgatctgccggagcggttccgcaactggtacggcggg

SEQ ID NO: 722700 - DNA, 605 bp, Homo sapiens
  misc_feature (332)..(332): n is a, c, g, or t
gtgccctcgctttctctatccagccgcctgctaagcagacccctcggagagctttctgactctcttcgccatcaggatgctggcttgctgggaacctattaatctgccttactcccgcgtttagacacctgcggcatcgtctcatggcttgtgatataccgtcttaagtactcaccattgcatcctcgctttaaatacacactgacgtgcattgtcaacttggcttgtgattaccatatcgtgcttgtaacagcaggttcgattaaccagttggtaacacgtcagagtagtatttaaatgccagtacaggtgtgggctgtgccgtgcactcncagatgtggaggattaatcttgaagggatgtgccccaaggggacccagatctgggggctggcctgatgctactgccctgtgtcctacgcataggcacctggcacctagagcactgcatccctaggacctctcgggtcctcaggatgcgtcaggcatgtagttccatctaccagggatactgtcacactgtcccatccaggcaaagactccattacgcactttgctctcactgagagataaacacttgctcctgaatccctccgtccgcgaaaa

SEQ ID NO: 722701 - DNA, 487 bp, Homo sapiens
ggatctccgatctggaaaacatcctgctggctggttactactgatacttcagatgaaagctctagtgctcattaactagttgattatcaagatacttagctaatcattacacatatattcatctctatttggtccacacaagagtcccaaaaagatattcattcctagagaatttagataacttgcctatggtcaaatgctcagaactggagaccaaattcgaagtcggcttgtccaaatgcacatagttcacaggccagtgacaccgttaccatactgttcccatcctatgcaatgcacagaaacagaagagattttagtgtcaggatataaaggatagataatcagatgactagcaaggaaagccccaagagaggaggttaaaagtccaatacaaaggcaaaatgcaaagaaccaaggtagcttcatagtcctcttggctgccagaaagaatacttacaatgagctgggcatggtggtatacacc

SEQ ID NO: 722702 - DNA, 887 bp, Homo sapiens
gggtgcacgctggatagcgtgctggccgtctgctagaggtatcccctcacaggagaagagacgagatggtgttaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgcctttaagtttaatgcataatttaaagctaaattgatcctgtagctgtccctgggcagaagctagagcctgattgtgggctactactcatccaattaaccttctaccaggggacgactacttctgggactggagtataacacaagaattcaaggggttcttggattttgagctctgcactaaacgggaaaggaacatgcttcatagcagctgccacattcttgaatgtgtgaggccttacccttttatcacctacaaggagtccgttacttggcagaagatacccagagatcaagggctccttcgtggcaaaacactccaaagccaacgaaaaaaaaaacttttggggcgcccaagattcaaaattaggggggcccataacatttatccacaaactctccaggtgcc

SEQ ID NO: 722703 - DNA, 276 bp, Homo sapiens
ccccctccccgggtacgtgcacggacactcttggggtgtcctgcgttggctatctgaaaggaagttcttgtcgggtgattccttttggcagagcaggctttcagttgtttatggcacagtgaaatatattcttcaatgctatgtaattttgaactaaaaagtctgtttaaggcacatgtctcagggtgattattaaaaacacacacacacacacacacacagcgtttagtccaagaccaatgtccttcacatttagtttctgtcttcaagtactga

SEQ ID NO: 722704 - DNA, 586 bp, Homo sapiens
agcggcgtttttccgccgcgtcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaatggcaataaatgcatatttatcaataattaccttcaatgtcaatggactgaatgttccaatcaaaagacactggatgaaaaaacaagagcctgcatatgctgtttaaaagaactcacggctctttcaat

SEQ ID NO: 722705 - DNA, 157 bp, Homo sapiens
gtggttctgtgctggtacatgtcaggtgcccagcctctgggccagtaactcagctactctttgtggctttcttcagggctttttttggtgggctgccacgcccatctttatcaccagaaagagtccacccagcacaagaacaccagcacaagaacca

SEQ ID NO: 722706 - DNA, 1525 bp, Homo sapiens
gagcccgagcagcgtgaagaacgaggcgagaacgacccccggaccgaccaaagcccgcgcgccgctgcactcccgcgtccagcacctacgctcccgcctgccgctcgccgccgcccaccactgcccaagcagaaacggctgcaacggggcactgctaacgggcagactaaacgcaaaggctgaaggacgaaccacagcagaacgactccgcgaggcttgtctgctaacacctgctcctccaacagccacgagcccaacgcctaacacaaggcccctgcaaagaagggcagcagaaggtacccaacagggcacacaacaggcgaaccagcctgactgctggccaggcaggggcaactaacccccttgccagcacaacatggcacgcactgtccaacacacccagacccagccccaccagcaaacgcctgcaacggctgcctgcgacgactgcccaacagctgcaacgctgctgctgccactttcttctgcactaaccctgctgctaacctctcctgggcctggacctggctaccacgctctctgacacacctaccctactttctctcaactccaaacgctctctctcctacacaccaaccttgccacgaaactcttccggctctcttagcgtttttcttctccctctctctctctttaacacaccgccctaactcgtctgtgctataacgccaccccacccacagacacccaccccttccactcggcgtcgcgcactcctcggggggcgcgcatacgcgcgggcccattaagtggctccaaccctacacctacccacccgtgtctccctccaaacaacgaccgtgcgcacctcgcacctctgctgccgcacgcacacaccaacaaccgttttctcccgcatttcaataaggcctctccgcgcaaccacgcaacctcccccctccctcggggcccttcccccgccgggacagcggaaccggccgaaacttcccccgctgggaacccttgtctggatcccccaccaacgtggcgccccacccccctttgggtcccccaaacacaacgcctccttggtcgggcgctaccccgacacacacacccgcacacaacttctgccctcaccaacacacccaccccactactaccaccgcctcacccaccccctcctcacgcccacctacgcactccaacacccccccctataaagcacccagcaaaaccacttctcgcttgcagaaccctggcaccccactcataccatctggcacacctcacggcggtctttcgcgccaccactgcgccactcccccaagcgactcccacgatgaatagtggcacctgtccacacagacgacagccgggctcccaagcttaacacaagggcgcgctctgccacaacactacggcacgagcccccaacaactaaccaccgtccgaaagacagagcccggcgccctcacgcaaacaaccggtctcaccacggccacctcgcacagccgacccccgcccacacaacagccactgcctcctactacacatcacctct

SEQ ID NO: 722707 - DNA, 564 bp, Homo sapiens
agcggcgtttttccgccgcgtcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcttcccctccacctccaggcacaacccgtccgcgatctcccggatcttgtagatgtcggagaacatctcatcgtggctgatgaggtcccggtagataatcatgatggcgactgaagggagacgacgacggcgctagcttagcacgagcctgaaactcggagcgagcgcggtgcaccggagcggcgctcggggggagggggagcgggcggaaaagc

SEQ ID NO: 722708 - DNA, 251 bp, Homo sapiens
taagctgagcctgactcacacttcctaaactcctcggttcttcacacgggcaagcagaagctctttccctacacgggccggtaaccgtgcccaggacacagggctcttggccttggcttcttggtatcctatggctgtgacgggggtctgatcattaaattacatgacttttaaggccagggagctgggcacgggggctcacaccggtaattccagcacttggggaggctgaggcgggcggatcactggag

SEQ ID NO: 722709 - DNA, 576 bp, Homo sapiens
gctttttcgcaagcgtggtttgccgccagtaacacaggtgtcgtgaaaactacccctaaaagccaacatgggaaaggaagaagactcatatcaacattgtcgtcattggacacgtagaattgcgggccaagttccaccacatactggtccactcgtgagtctaatcaaatgcggtggcagtcgaacaaagagaaaaaaacaaaagaaaataaaaaaaaaaaaagatgtggttggaggcggccctgcggccccccggagaagaaacatttttgaagacccccttgtgcggtttggggccggcggggcccaaggagggttaaaggagacaaccgagtgcaaatgaggcgtgttccctaaggagaagactcggggcaagggcacttacgggggctgggggttcctccccaaatataataaacagccccgggcgggaaacaccggagagctggctctgaacacaactccaaaagaggggagaggtcacggaggcaccaaacaggggagccttatacacaccagggagttccacagaggcgagcaccagaataataaaatttaacgcgccgcggcgtgggg

SEQ ID NO: 722710 - DNA, 341 bp, Homo sapiens
tcttgtggagacgggctcatgcacttatctacacttggaggcacgcgggtgatacctgaggacaggagttgaaagcagccggcaacatgctgaaaccccatctgtacaaaaaatacaaaaactcagccaggtgtggtggtgggcgcctgcaatccaagccatccgggaggccgaggcaggtggaccatctgaggtcaagagttcaagaccagccaggccaacatggtgaaaccgtgtctctgctagaaatacaaaaaattagccgggcgtgctggcgggtgcctgtagtcccagctactcgggagggaggctgaggcaggagaatgacatgaacccaggag

SEQ ID NO: 722711 - DNA, 180 bp, Homo sapiens
tcccgtcgttactcaaccgaacatctaccgctcaccgaaaacatatcacacagtactcctagacttgacttctgtggtcaccaccactgagaccaggtcacacagtcctcccagcttcacttcttcgatcaccaccacagagatcacctcacacagtactcctgttcggttgagcggaga

SEQ ID NO: 722712 - DNA, 310 bp, Homo sapiens
  misc_feature (66)..(66): n is a, c, g, or t
cctagaggatcccccaacgctgctcacaacgcaaatgcttctaggcggactatgacttagctgcgnacaccctttctgacaaaacctaactgcgcagaaaacaagatgagatggcatggctttatttgttttttttgtttcgtttgggtttttttttttttctgggctggactcaggatttaaaaacgggaagggtgaaggtgacagcagtcggtgggagcgagcatcccccaaagttcacaagggggccgaggacttggatggcacatggtggttttttaaatagtcattccaaaggtgagcaggtggg

SEQ ID NO: 722713 - DNA, 106 bp, Homo sapiens
tatactcttcagccacagcatcaatcctacctccatcgctaacccactaaaacactcaccaagacctcaaggccctgagccccatgcctcaggacacgaatgttca

SEQ ID NO: 722714 - DNA, 726 bp, Homo sapiens
tacttctctattgtttagggcgtgctcggcctctgacagagatgtgggcagctggtcagtgatggccattcgggctcagcacagcaacgcagcccagactcagactgtgggaagcaaacaggggctgtgacagtgccaggagagcctgatcgagacagatgatcctgagatgtgggagtatgctgcagagggagaaggacaaggcagtgtcagtggcctggagctcattgcctcagagaacttctgcagcctgatgctgcagctggagtgccctggaggtcctgatctgaacaacaagtacatcggagggttatcctggacaagagatactatgggggagacagagtgtggtgtgatgaaataagagactgctagtgccagcagccgggaccttgagaagaccttagagcatggatacctgcacagataggggagtcaaatgtcacagcccctactaccgtggataccccagacaaacctgagagcgcactacaacagaccactacatgcaaacccatcaaaagaaccagagaaatcaatagagaagacatgagacactatgacaacagactggaagagtgcaccaatattcaacaccaacaggaataacaattgatcttagaacagtcaaagacggagattatcaagaccacagataacagtcatacatacggaagatctaaatgcgcctaataaagcgctcaaaccagaaaaatatggcctcat

SEQ ID NO: 722715 - DNA, 125 bp, Homo sapiens
gtatgacattaagcaaagtctctctcgtctgtacactaaatcaaaaagcagcagactgtagaagaatgcatggactaagagccccatggcacagatcgccagatacaacaagatgatagagggaa

SEQ ID NO: 722716 - DNA, 311 bp, Homo sapiens
tagagtcgcttgagcgggaacttgatcgtcactcaagaaatgtatctgacattttcaatcggattttcggtaatacggaggcaaggaatgcggaaaatccgacgataagcagtcaaaattcacctgatcctcagcacccgtacgtttttcagcaatcaggctcgaccgattacggtatcgaatcgttgcgagccatcagcccgcgtttggcagaggcggtttcgactcatcctgaactcggtaaaatcttatcagacctgccgctcaggcctcagaaacgtgattttcattctatcctttcggaagctgtc

SEQ ID NO: 722717 - DNA, 831 bp, Homo sapiens
  misc_feature (673)..(673): n is a, c, g, or t
ctcggtacccgcgaacatgcggcatgcggcaatgatataatacttttaactctcacggcaaattagtcacttgtcaagtccattgagagaccaatggagtcttgtttcatcattttatatcctgtataatttttttctaacttgagcgaagttttatactgtatttagttcaatattctacgttaaataaaaccagggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722718 - DNA, 110 bp, Homo sapiens
caggacaccctgtgctgcatacctgatgagggctcttatcccaggctcctgctgccggccgccccaaactgctccccataggacagactgggacttgggtactgaaggat

SEQ ID NO: 722719 - DNA, 603 bp, Homo sapiens
  misc_feature (489)..(489): n is a, c, g, or t
  misc_feature (491)..(491): n is a, c, g, or t
tacttggtaaatggaagacaccttatgaagtatttaacttaatgctaataataaccctaagaggtaggtgctactattatgcccagtttacccatgaagaaatcaagacaaaagaggtcaactagtgagtcaactaacaaagttagtgtttgaagggctggctcaagagctccatgtttggcatcctcctttgggaaataaagaaaattaaagtgtggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaananataaataaatttgtcacttagcttgtcatcagagagttctgcaagtttaatcttttgttaaaaacacagcttatcattaatacttcctgtgaaacggagcgtccacttaggc

SEQ ID NO: 722720 - DNA, 395 bp, Homo sapiens
ataacatcctttaaaatattcattaaagttttgctggaaaccagaaataccacttaacttctcagttgcataagctaataatataattctttatggctaatctgcctccggttgcattttctgctacttacaatgaagagaatactaaatataatgtcttttgaataagtctatattgtgatgtctttactgcatctataattgaatcctgccccattggaagcagttgtctgctatatgaatataaaatgccaagtctatggccttttgttttagatgtggcaagttatgtttagagatttcatataattgtgtctcaactgattttaaggtaaactaatttatgtgggagggggtgggtcacttgaggctaatttattttctagggaagtttt

SEQ ID NO: 722721 - DNA, 1686 bp, Homo sapiens
  misc_feature (207)..(207): n is a, c, g, or t
  misc_feature (362)..(362): n is a, c, g, or t
  misc_feature (928)..(928): n is a, c, g, or t
  misc_feature (1420)..(1420): n is a, c, g, or t
gcagaagggagcgcgcgttgtgtgccggctgccaggctaatacggaagactgctcactcgggacgagttggtagtgactagtgaggcttgtcgcgtggtccgactacgaacatatgtagtgcatagcgactgaggttatcctagtgacacacttcgtgatgccaatgaggagtagacgaggaggtcggtagaggctacggcgatagncgactccaactgctgtgctgcctaggttacagtagaagtctgacatcacattccacttcccctcgtattagaatattcactatttaatcattaaggtgctggtactcgctgtgcacgagtggcaggagtccatgttggacacctacaactttacncttcagaagatgtgcgtgcgttaagtatgggaccatgtggcaagcatatgaacgaccaaaatagggtgcccttgagcttgttgcatatattgtaggaggcgtaaagaatggagacaattgtatatgactttttatgaggaaaggatggccttgcgttatagggtgatagtccaaagaagggccagatattcgcataggggggatacgagcgaatgggcaatttcgctagtcaaagaacgaggacgtaagaagggtaaggatattaggggagggttggtgggggcataggcttatttagttggcaaagtaatgaccaaagatataccatccaaggagaaccttccagattccagtggggatacgcctttttcggaagagaaggctttcggcatattgttccgcctaaagttcaacgagcaaccgttgttgcaggcgctaaagcaaagctatatgacgcttatattacccaaacaccatggagcgcatagatttgggcggatgtgtgcgccatacctgtggcgctaattggtgtgggggcgcggtggccatttgccttgttcaaccgntaaaaatagggcggtgggatatatgtagacacgggatccaagggggaggggataacacaaaggtctatggccaatatgggctacatttttgcgagtgtcccactgggaatgggcccaatatttcccggttcctaccgaattaattgcccgttaccacccataccggagagggacaaattccccggcaacaattgctttggtggatttccgaccaaagacccaagtttccccccccggccggacaatagcggtgctcggcaagaaatggccagttggaatcttcgccatggatttactaaacttacgggcctttgggggtggacaagtgtgaaatctgcttcccctaacggggtgcagggaactattgtgccttgtggtccctaatgacatctgggccctcgggtagtgactgaccaccgttcgcctgtcagaaatttaccttttctgggggattatacccatcagggacacggtgaccaaccgtgggtgggnttaatctaaaagcgctcgggtggtatttggcccaggaagcaagccatttatgtgtgtagaggggcactaacaagttgtgtcggttcagggaaaataccccgcgagtgtttccacagcaccgattctgcgatggaacccagtttgtctgttttttgtgacagcactgatcggggaaactccgcgcgtgcgcgtactacctatgcaaagcgtgcaccgcacacaaaaatttataacacgagcgcgggcggggttacaccaatggtggg

SEQ ID NO: 722722 - DNA, 454 bp, Homo sapiens
  misc_feature (33)..(33): n is a, c, g, or t
  misc_feature (45)..(45): n is a, c, g, or t
  misc_feature (340)..(340): n is a, c, g, or t
  misc_feature (342)..(342): n is a, c, g, or t
accgcgaatatcggataacagatttgaagtgtnaaccaacatganaggagtatttaaaaggattgtgggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaananataaataaatttgtcacttagcttgtcatcagagagttctgcaagtttaatcttttgttaaaaacacagcttatcattaatacttcctgtgaaacggagcgtccacttaggc

SEQ ID NO: 722723 - DNA, 580 bp, Homo sapiens
  misc_feature (422)..(422): n is a, c, g, or t
cagccaatatgtgccaggttgtaaaggggaatacatctgagacggtgagagggagaaaccattaagatgctgatcaggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722724 - DNA, 458 bp, Homo sapiens
actgttaattataatagctccattatgtgtatggctaccttggtagaacaatgccttctcccaccataactaaagtaaaaatgcttatggagcatgcacggtatgccaatgggtataccaggggaacaagcagctaaggtccctgccctcaaatggcaatgaggatatacactactaaacatataaaaacttgaggtggcaataagtgctatggaggaaaataaaataggaggggaggagagagacgatggctaaaggtcttgggtggtgccataaagcaacccacccatcaccctctacaaaatcccgcattgcaatcacaggaccacggggtggcacacagtgactctaagggggggcaacatagagtgattttgtcttcccttaatggacagatgcaaaacttttcaacaagctaaacacaggaaaaaaaaatcactctagggggtaccgagctc

SEQ ID NO: 722725 - DNA, 443 bp, Homo sapiens
  misc_feature (329)..(329): n is a, c, g, or t
  misc_feature (331)..(331): n is a, c, g, or t
taggtcggaccaggtggtgctcatcttagtgattctaatacaaaataaaataaaaaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaananataaataaatttgtcacttagcttgtcatcagagagttctgcaagtttaatcttttgttaaaaacacagcttatcattaatacttcctgtgaaacggagcgtccacttaggc

SEQ ID NO: 722726 - DNA, 410 bp, Homo sapiens
taccgggggatcatgctgtttatccgagaatacttatgaactatcaccactcaattaaaaagacagtccattttaaaaagtgggcaaattatttgagtaggtatttctctaagatatacaagtggccaagaagcacatgaaaagatgttcaatatcattagtgattagggaaatgcaaatcaaaatcatgagacaccacttcacattcattaggatggctactacgaaaaacacaatcatggaaaagtgttgccaaggacttggagaaattggaaccctcaaatgttgctgagaacaaaaaaaggtgcaccttcacacaaaagcactttggaaaacagttgggcatttcctcaaaaagttaaatacagagttaccatataacccagcaattccactcctaatgataaacg

SEQ ID NO: 722727 - DNA, 656 bp, Homo sapiens
  misc_feature (498)..(498): n is a, c, g, or t
cgatgaagctgatggctatactagatgatctactgagctctgagtagaaaaatatatatctagatagagagatcgatagatattgtttttatagtgatatggtaatacagtagtactggtttagcaattgcatattaatttaatagtatgtgggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722728 - DNA, 91 bp, Homo sapiens
tggttgtcatgtgatgggtccctccaggttactaaagggtgcatgtccctgcttgaacactgaagggcaggtggtgggccatggcaatggt

SEQ ID NO: 722729 - DNA, 757 bp, Homo sapiens
  misc_feature (599)..(599): n is a, c, g, or t
cacaaaaacgggaagcacagattataattttcagatgagaaaactgaaacccaggaaaataagtcacttgtccaaggacacaaagtagtgtttaagcctagacttcaaagccattaagggtttgttacctctctgccctgaattgggatttcccagacccatacaatttcatttgaaaaataataataaaattatgaaccaatttaccaactctttatttcactgccaataactcaaatataaagtacatgctggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722730 - DNA, 565 bp, Homo sapiens
  misc_feature (407)..(407): n is a, c, g, or t
acaccatctagacttcaaagaggggttgagatctagaccaccattaagaaaagtaatgtagggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722731 - DNA, 630 bp, Homo sapiens
  misc_feature (472)..(472): n is a, c, g, or t
taattagtgagcactccagtatttcaagggagtttgaccataacctgatatatcatatccagtgattgctaagtaattaagcatttagaattctgctctctaattttgttacaaaaagagtgttttggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722732 - DNA, 328 bp, Homo sapiens
agtggtgagaccagccgaggcaacacagcaagagccatgtctttacaacaagaatacaaaaattagccaggtgaggtggtgcaagcctgtagttccagctactcgggaggctgatggtaggaggatcagtttaggcccgggagcttgaggctgcagtgagctgtgatcgtgtcactgggtgacagggcgaaatcctgtctcaaaaaaaaaaaaggcaaactggtattcctgggacaatttggatataaaaagtaaagcaggcatatgggttaagtaacttcattggctagaccttctctccggtttatgtttccactgggaggcccca

SEQ ID NO: 722733 - DNA, 323 bp, Homo sapiens
actctcgaggatccccatttcttattatcttgtatgatgcactgaccaatgaagcttgttttattttttctttaatctttgcttttcaatttgaattatttctgttgacgtatcttcaaatttgctaattttttttccgaattatttgataagctatgaatcttacaaaatggattttaaaattttggatactaaacttttcaattctagactctttttggttctgtttctagtttcaatttctctgctgagattttccatctatttactccttatgttcttttccattaaatgcatacaatatgtacaataattccgggtac

SEQ ID NO: 722734 - DNA, 742 bp, Homo sapiens
caccctagtaggctcccttcccctattcatcgcgctaatttacagtcacaacaccctaggctcagccaagacattctactactcactctcacgtgcccagggagagtatcaaattgcctgagccaacaaggttaatatgactagctggacacaatagcttttagtagtaaagatacctcgtttacggacgtccacttatgactccctaagagcccatgtcggaagcccccatcgctgggtcaatagtgacttgcccgcgagtactcttaggaactaggcggctatggtataagtacgcctacacagcgtcagttctgcaactcccctgaggaaaaacagcatagcctatccccttccttgtgctatccctatgaggcataattataacaagctccatctgcctgatccgacaaacagagcctaaaagtcgtctgcattgcgtactcttcaatcagccacatagccctcgtagtgaacagccattctcatccaataccccctgaagcttcaccggcgcagtcgattctcataatcgcccacggacttacgattcctcataacttattctgcctagcagaggtcgtaaactaggaacgcgtgcgcagtcgcatcataatccgctctcgaaggagctcaaaggctactcccactaatagctttcgatgactgccagcaagctcggaactcggctgaaccccaatatttactaatgggagaacgcctgggtgagaaccacggcctg

SEQ ID NO: 722735 - DNA, 575 bp, Homo sapiens
  misc_feature (417)..(417): n is a, c, g, or t
ctcctctatagtgggtggctgctgtacctctggatttcttttgggtcttgtacttgattagaacttaaagtggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722736 - DNA, 370 bp, Homo sapiens
atgaaaaattgttgagatacggttatcgggtgcccggctagctcagtcggtagagcatgagactcttaatctcagggtcgtgggttcgagccccacgttgggcggcaactggtcgttttagtcctaaatctacgactactagccatacctaaaaatataagtagaccagctcttaggaaaataatctgctctgaagtcttgcatttctgtgtgtgtaatactcttgcgggcgctccactgttcattatctacccattatcttgcgatacaattaggatttaaagctgtggtaaaatatgcccaacaaaatttaacactttttaactgtacagttctgtagcattaaatacatttaaatggttgtgcatca

SEQ ID NO: 722737 - DNA, 107 bp, Homo sapiens
tctcgagggtggctcgtcgcgcggctctttgggtggcgcatgtgggtgtgctcttggtggaggccatctatccttaatactacacaaacgcagccgagtgtaccaga

SEQ ID NO: 722738 - DNA, 267 bp, Homo sapiens
ccacgatattctggtcaccctgtgatgtctgtgaagagcctgctgaccagaactgtatatagtctccattgtcttgcttgggatttgagaatgaaaatcagagagggaagatctggtatttcgtggcctaaattccccttgtggcgtgacagtggagatgctgcagttccaaaagagaaggtttcttccagagtcatctacctgagtcctgaagctccctgtcctgaaagccacagacaatatggtcccaaatgagcgaatatcgtg

SEQ ID NO: 722739 - DNA, 502 bp, Homo sapiens
ctcatgtacgtcaatataatgctatcaaaaaccatctgcacttctaggaatactaatatgtcgctcacacctcatatcctccctatatgcctaaaaggcaataatactatcgctgttcattgatagctactctcataagcctcaacagccactccctcttagcgcaatattgtgcctattgccatagctagtctttgccgcctgggaaggcaggcggtgggcctagccgcgtactagtctcaatctccaagagatatggcctagactacgtacataagctaaacctagctccaagtgctaaaactaatcgtcccaacaattatattactaccactgacatgactttccaaaaaaacacataagttggaatcaacgaggaacacccacaggctaattattagcatcatccccctactattgtgggaaccaaatcaacaacaacctatagagctgttccccaagctttttcctccgaacccctaaaaggccccctcctagtata

SEQ ID NO: 722740 - DNA, 780 bp, Homo sapiens
tgtgactattctccaactacaggtctggagatggagtcctgacacgggaacctttttacccgctgggctgcaatgcaatggcaaggaaaaggccaacgccatcatggaggaggttatgagcctgctgcagcccctaagtatcactcaagacctgagccatggacaatggacagacatcaacttttgaatccaagctggagtgcctgtagccagtctacttgacgacttatacaagcatttcttcttccatcactcccactgagacaccatgactgtcatggatccatagcaaatgattggtgctgatgctgattgtgctgctgccactgatgatgatgcagacatggaaaaaatgctgtctatgtcctagaaacacgtggaaagaaacgtttccatgcttctggcatggaatgctgtgtctgcaactatggaaaacttctcttcacataacaattacatccaatacatcttaaaggcacaactctatttcatgcttgctgaagtaccaatattgatactttccaaactctctgattctatgaggaggaatcattgtcccctgcctactaacacatagaattaacatatgggaggtgatacagcgggggcatttctttatatcacctcttaaacacatttgccgcactttagaagtaaacactgaaaaaatcttgtgacgatcggccagcaaaggccagaacccgtaaaagggccggttgctggagttttccaaagctccgcccccataaaaacttattccctaggggctatttcttttag

SEQ ID NO: 722741 - DNA, 770 bp, Homo sapiens
aagcaggggtatcaactgcagagtgcccattacggccggggcagacactgagcttcagactgcctcggctccagcggcatggcgccctccaggaagttgcttcgttgggtggaataccggaagatgaacggtcgggaacgcatgagtctggcgggagctcattcgggtacgtctcgaaccggctgggcaagggtgccgcgtccgacaacgcgaggttggtatatgtcgcttcgcgcccctactgcctaattagtccgatcttccgtcccggggcaagaccgcctaagattcaccaggattgctgtgtggttgggcaggaactcgctcacaaaagctgacttaatgtgggctgttatacctgggggaagatcagccctggcgtagagtgcaaagacgggcggagccaggtgggtggtcctgggggtcaaatcgagagagaaaggcatgtcgtgtggtgtgagtcagatgatcgggattgggccataactggggcccattggcctctggaagagggactcggagtactcgcctgcattggggagaagctagcatgaaaagggaagctggcatcactgagaaggtggtgttccgagcagacaaaggtcatcgcagattacaccgggaaggactggagcaaggtcggtcctggctatgagcctgtggttgggccattgggttactggcacggagtggaacaccccaacagggccagggacgttaaacgagaaagccgaggatgggtgaagtccaccgtctctgatgccggggtc

SEQ ID NO: 722742 - DNA, 304 bp, Homo sapiens
cagggagcccgactgtccgttatgcaggagtcttgagccctttatctcctttaggcccggcatgtcagtcaggaatcggggaaccttctctccttttattcaggaggcctgacaacccggtggtgcctgtgctcaggggaccctagctcagggggctattctcgaactctgagacccacgagcctgcaatcagagtccgttcactctgatccctgagccagggtccgattgttcatgtttcaggacgctgtaccaatgtccctctcccggtgtgcagatgcgggagactggaacttgagtccgt

SEQ ID NO: 722743 - DNA, 763 bp, Homo sapiens
  misc_feature (54)..(54): n is a, c, g, or t
  misc_feature (65)..(65): n is a, c, g, or t
  misc_feature (108)..(108): n is a, c, g, or t
  misc_feature (117)..(117): n is a, c, g, or t
  misc_feature (141)..(141): n is a, c, g, or t
  misc_feature (151)..(151): n is a, c, g, or t
  misc_feature (162)..(163): n is a, c, g, or t
  misc_feature (221)..(221): n is a, c, g, or t
  misc_feature (228)..(228): n is a, c, g, or t
  misc_feature (255)..(255): n is a, c, g, or t
  misc_feature (297)..(297): n is a, c, g, or t
  misc_feature (304)..(304): n is a, c, g, or t
  misc_feature (314)..(314): n is a, c, g, or t
  misc_feature (338)..(338): n is a, c, g, or t
  misc_feature (495)..(495): n is a, c, g, or t
  misc_feature (500)..(500): n is a, c, g, or t
  misc_feature (508)..(508): n is a, c, g, or t
  misc_feature (528)..(528): n is a, c, g, or t
  misc_feature (605)..(605): n is a, c, g, or t
  misc_feature (671)..(671): n is a, c, g, or t
  misc_feature (683)..(684): n is a, c, g, or t
  misc_feature (707)..(707): n is a, c, g, or t
aattaatatttaaattttataatataaataacagtataaccttttactagtaanaatataaacgnttaaagaggctctttgtaattcatttatacaaattcacaaacngtccaattnattgataaaggtctctgggtttcnttaaccccanggtcttgcatnnggcagtggaagggtatactaaagaaataacaacaaaaatcacaacgaaaatgatacantcctacnccacgaagtgatctcactctctcaaanccacaagatacccaacccccaccaaacagaaagaaagtacancctaatnccccccattnaagcaaacggaattttttaaaacnaacaaactacccatttaagttaatagcaacagagataaagcatcatggggctctccatccacagccccaggtggccctggcaggccagaccctagcccctcgtttccccacaggaagccgcgctggtagtcgaccttttgggggggaaactgggaanagggncgagggtnagggcagcatttcgcaaaanaaaacaccatttccaagacacaacacggcttcaccaacacaaaacaacggtccaacccgcatggcccccacaaattngggcaaaaaatcacagattcagaaagaggaccgcaaaacccaaagaacaaggagaaaaaggaaatnagagccagatgnnggaatgggggcacacaggacggnaggaggcagggaagaagccaacacaaaaagacggacaaacccaagggcatctttcc

SEQ ID NO: 722744 - DNA, 568 bp, Homo sapiens
caacgatggtcctcatgcttttccggtccctggctttacaggtactagggtctctggattcagtctccagaattgctggtttcctggttgtctgctccaagcctaagtgtttcttttccccactctccactgtgccaggccgcacatctcttgtctctctgctttcttgcttccaaatggtttttttttttttttttttggaaaaagtttctctctggtcgcccaggcgggagtgtaggggcgcgatctcggctcacggcaacctccgccttacgggtggaagcgattctcctgcctcagcctcccgagtagcggggactacgggcgtgtgccatcacacccagttaattttttattttaagtagagatggagcttcaccatgtgggccaggcgggtctcaaactctggacctctagtgatccgccggtttgggcctcccaaggggtggaaattacgggcatgagccaccacgcccagcgcatttattcttacagaaaattgggggccatgcagaagatgggaaccagagggagcagagaaatctcagaccgggtgattccataggtt

SEQ ID NO: 722745 - DNA, 165 bp, Homo sapiens
tctacctgaagcaactctgctcttccgtcagctcaaagcacaaggaggtcagcccaggaggaggccagctgcaattgtggagacacggtccccccccccaaacccacctcatgcacaccgccaaccccttgccccaggagcgggctctaggcaggtcccctagga

SEQ ID NO: 722746 - DNA, 165 bp, Homo sapiens
attcccttatgcatttcttgcagggcaagtctaattgtaataaactccctcagcttttgttttatctgagaatgtcttgatttctcccctatttttgatggataatcttgccagatacatgaatttttgggaacagtatttttctttcagcacttaaatatgtca

SEQ ID NO: 722747 - DNA, 1091 bp, Homo sapiens
  misc_feature (259)..(259): n is a, c, g, or t
  misc_feature (1066)..(1066): n is a, c, g, or t
tcccgggacatgcagtgtaatatcgtgctacgtagtgtagtagtagtagtagtagtagtagtagtagtagtagtagtagtagtagtagtagtagtagtagtagtagtagtagtagtatgagtagtagtagtatgagtatgtagagtagagtactattagattaggttatcatatatttcttataccttagtcttttatcttgttcacggcttaattatgtgttaccatctcgctctttaatttacgttcctctttatcnttgtaatcacgtatattcatcatctgcaaattagttatcatatctttcacttctatgtttccatattatttcatttttttctactattatctgttttatctctgtggactcttttcttctcctcgattctttatctctcttattgtcatcgatctcgtttacatcattcaatatttctctccttgtttacttcttcttacatctttatctatatgtatcacattattcctacttatcatctcttagtaatactacctttttatgatcttctataatctcttgtaaatatcattcttcaattctaagacatttattctcacacttaactgatctaatagttaattgtatatattgtttataatttttttatacatcgctattaaagatatatactcttctttattcacctcaatttctattttatgatcctgtatacactatctttactatatcatttatatcactcatttgttgattaataactcaattcactcatgatattacttactcataatgtttgactattctacatacactttgtttattcaccttcatatcttattatctagatcctattgtctttactgtgtattcttaacatctaacttgttacttactctacatcactattttgtatactttatactcttaattacatcattacattattatattccttgctactacatctggtttctattctcctcctcttctctctctctatccccgtctctatactatattactcctactcatcactccttttatatatttagattactactactttaacttaattatgatacntatcatactcctgtctatgatctct

SEQ ID NO: 722748 - DNA, 363 bp, Homo sapiens
ctcccttgtgagacacatcaaagggaaaccttccttggctcttcctggcttctggtggttgttggcaatcctcggcgttcctgggctgcagctgcatccctccagtctccgcctctgtcatcacctgtcattctcactgtgtgtctgtgtctgcacatggctgtcttccctcttcttataaggacaccagatatattggactaaggacccaccctacttcaatgtgacctcatcttaaactaattacatctgcaacagccctacttccaaataaggtcaaattcagtgggtactggcaggggtcagggactttcagctttactttttgggggggttacaattccaaaccattcacagctacct

SEQ ID NO: 722749 - DNA, 109 bp, Homo sapiens
  misc_feature (96)..(96): n is a, c, g, or t
tatcgatgccacacacattatattatatatgtgtgtggtatccaaggaatcacttttatgagggctaaagataaagaagttggccagaaaatgcangccatccttgtgt

SEQ ID NO: 722750 - DNA, 1965 bp, Homo sapiens
  misc_feature (501)..(501): n is a, c, g, or t
  misc_feature (609)..(609): n is a, c, g, or t
  misc_feature (685)..(686): n is a, c, g, or t
ggctgctccgcgccgggattatgggatctcgcagctcgcatgcgccgtgtagccgtcgccaccgcgcagtccgtgcgccctcggtggcgtacccggccgcgctccatccccgccgcggcacgggcgcgctcgtgcgcccggacagtgtcccgctgcggtccgcggtgatggccaccaagatcgacaaagatggcttgccgggcgggtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccgggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtntgtgatcagtgatcggaaggagctggaggaagatttcatcaagagcgagctgaagaaggcggggggagccaattacgacgcccagacggagtaaccccagcccccgcncacaccaacccttgccaaagtcatctgcctgctccccgggggagaggaccgccggcctcagctactagcccaccanncccaccagggacgcaaacagcaagccactgacgcaggcagccgccccgcccaccctgctgctccaccacgccccacaccctatacccgactctccccttcagcaaccccctgcccccgcgctcccctcatctctccactgccaccgccctccacttcgcaacaacccatccctctcacccctctactgcaatccctcccacatcctactctcacacatacttgtccctacaccaccctcccatccatcatcctaacacacaccgctcctcccttcacaccacgccaccaaccacacgctcccactccccaccccggcattcggccccccccggcgccttcccccccttgcccccctatcgacccactacttccgcacgccccacttccccccgcccgcgcgccttggccccccttccccccttcgcccccccccccccgccacatccccccccttccttcccttccccccccttcgcggcccccccgaacttccatccccgcccctcaccctttcctctccccgccccacacccggccccccgcgcgcaaccccgtcgcacagggcgccgcactccccctttcgggcccccgccccctcacaacgcgctcctgcgcccacccggccgacactttccccctctggggccgcgcagtttccggccgccaacgccgccctgtttccgccgccacgcccgcggctttttcaccgggggcgcctcactccttgtacctagcgcccccctcctcacgcgtgcgtaaaacggcgcggccccacccccccacagcgcaggcggcgtccgcgcctccgcccgccgttgtgtcagcaccgtatctcgccgccacccagctccctcggcgcccccgctccaccgcaacatctactccccccgccatctcgcagcaagagcggcagccgttcagctcatcctacactcgctcactccccggcatcatatggtgcggccgggtccccgccccgccgcgatttcgcccccccgcgcattctgctctcaccacccagtcattcgggctctcctggcgcgactttcaccgaccccgccccgcgaagcgctcctcctgttgcgaccaacactcgcaccacggcagcgccatgtctcccccatacgccagggccgccccccacgcacctgcttgctgcgcgcgcggccgcgcgcacccgcgccccatcacacctgctgtccgtcgcgcgcaacaaagggctcgccccccctgcctatgccgaccctcctcgtgcgggccccctccgcctcccccagg

SEQ ID NO: 722751 - DNA, 2012 bp, Homo sapiens
  misc_feature (229)..(229): n is a, c, g, or t
  misc_feature (1309)..(1309): n is a, c, g, or t
  misc_feature (1701)..(1701): n is a, c, g, or t
gcagatgtgtgtgctggcaccgtggaggtgattgatcctcactcatcgattggactgactctggttgcgcttcggaaggtgggaggttgtgtgctgtcgctagattgccttcctggatctgactagtattggatgggctactccgttgtcgtgcctggtttgcttgtgggttgcctctccgctctccgtgctgtgatgcactgcatgagtgatggatgtcgcgcttgcnctgtgttatcttcgccctcgcttggatgtgttgtccgcgcgcttcgtgagtatgatggagttttgttctgctgttgggtcgagtggacttgttttgatgggctggtgagtgttctctccagctcagctttgtacagttatgtgttgctcttcgatgagcattggttttcgtgtggcgtgagaagatttgtgcttgtttggtggtggtatatcgctcacgatcctcgctgcttgtgttgtttgttccctgaccggtgtgttgatgtggtgtgtttgattgttttgtccctcgctccgtgtggttcgtagatttgggtgcgtccaacttgatgggagcggcgtcaatctacatttatgggaaggacgtcccaccgatgattttggttggggcgtgcgtggagaatatgtgtgtttgtgtgtggttgatgtggtctctgacccccctcgttttgtctctctcttgggtgataccgtcggtcgatcctactgaattagttggtgggtgtggttgttggcttcatattattgagccgctcccgctatctgcttcttgtgtgtactagctatggtttggtggacgacaccgactgagtttaggatccacccctgcttggttgtgactcatcgaggggggggtgccgactccacgtttggtttgtctgcgtccctccctcctcctggtgggttggtgacacccctctatcgtagtggtctttctcggcggagaagaggtttgtcttgtgctggggaatgatgatcctcccggcgtgtgctcgatgagtgtggcgggcattgtgtggtgtatcctgctcctgcatccgtccagcatgtggggggcccaccctctgtgctctgtcggatgcctgctctgcggtgtggtcgaacggcgccttctgcttgtgtaggtggttcgccttcgtccactccttcctctgtggggtgttgttcctttttgtcgtcgtccacctacaggggacctttttgcttctcctctgctgagggaaggagccctcaacggagaagttgttgtgtgaagacgccccacttgctgggagaggcgataccccacggtggggcgccncagctcgtcactcttgtgttctccccaccacagggaggctctcgggccccccacatagagtagagattgggacgagaccaacttgtgtctctctgaagactctctcgctcactcttgtgtgttgctgcgtccccgctctttgggggcgcacaccacccacgctctcgacacacacagtggcgcctcataagagatgtgtgtgtgcgcacacaaacactctcttattgaggtccacacgaggagtgtcttttgtactctctggaacagaggtgccacatctcgcacacaatgtggatacctggtgtttgtgcacacactttaaagacacacactccaaggtagaataagaggccgagggtctcaataatggaatagatattgttaattacacncagatgtctctgtgtgtggttgtgtacactctctctctgtaatacaccagaccctgccatatcccgtgggtaccaagagccaggggtgaacatctcatccataatttgggaggacatccatggcaccagaaacaccagaatattgaagattactatccccaacacccacccccttgtacactttgtgaccgacgcctaagagaataaatgtgttttaaacccccttccctttctgtggcttttaatttggagattttcccctgtgtaagacctttggactgagaaattggggaaacccaaattactccccc

SEQ ID NO: 722752 - DNA, 1861 bp, Homo sapiens
  misc_feature (501)..(501): n is a, c, g, or t
  misc_feature (609)..(609): n is a, c, g, or t
  misc_feature (685)..(686): n is a, c, g, or t
ggctgctccgcgccgggattatgggatctcgcagctcgcatgcgccgtgtagccgtcgccaccgcgcagtccgtgcgccctcggtggcgtacccggccgcgctccatccccgccgcggcacgggcgcgctcgtgcgcccggacagtgtcccgctgcggtccgcggtgatggccaccaagatcgacaaagatggcttgccgggcgggtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccgggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtntgtgatcagtgatcggaaggagctggaggaagatttcatcaagagcgagctgaagaaggcggggggagccaattacgacgcccagacggagtaaccccagcccccgcncacaccaacccttgccaaagtcatctgcctgctccccgggggagaggaccgccggcctcagctactagcccaccanncccaccagggagaagagaagccagtgagatggcagcgcccgacaaacatgtgtccacaagacccacaccattcccgcgttcccattagaacccatgccgtgtccatatctcatgacgctcatggaagcctcatttctttgaatcttcatttatactataactcacccctcatattcaaggttctaaagaagaagtcatttagatgcaaggtcctgccatgccatcagatccgaggtgcctccctgcaagtgacccctttaccctgcgcattactcattccacagcgacgaggtctgcctagtgagactcatggcaatgaaccatcacagttcgctcttccaagaaggccccggggcacattataatagggcaaatcctaagattaaaccatggagccacatgattatctggtgataccaaatggacgggggcacagccttgggaccagtgaagctggtgacaccgagtgacatgtcaagcacctacaagtagaggcagcacagcgtaccagttacccctaactaaagggcaccagaaacctccgtggaagtactgaccacagggggcatacccgtcattggcacacgcgtccagtaccgggaggtggacacaaagaatgccatggtacaggacaataaggcacgagcattgcacccggagtggggacaaaaagcggaaagagaacccgagggtaccaagcacaggaacgcacagacaggaagaacaacaagtacgggctacaaaaacataaacccaggagagaagcggaaacaggaaagaacggaggacaggaaaaccaagcatggtaccacagcaaactgaaccagaagatagcgtaggtagacacacaaaaagtggcacgggacattgagagcccagcagtggccggagagggagaactacacgaggggacaaccacggggccgccagaactcggccaagctactgtagggagtgaaagcacagcgaggagcgaaggaaaatacacgacacagcgagagagacccagtaggacacagcacacggtacaacacacaggacaggtgggcacgagatatggaagccgataagtagaagacagagaaaacacaaagacgcataccggacgcaccaccgcgtgtattagccaggcgaacgacatatctgcccgcagcgcccaaccgacttatggagca

SEQ ID NO: 722753 - DNA, 365 bp, Homo sapiens
tttttgggggggggcccccccccccccccccccccaaatttttttttgtggtttttttccccccccccccccccccttaaaaattttttttttttagggggggtaaaaacccccccccccccccccccggggggggaagggggggtttttttaccccccccccccccccttttttttttttttttttttcccccggggcccccccccccggttttttttttagggggggtttttaaccccccaaggggggggtcccgggggtttttttttttttgtttttttcccccgggtttttttttttggggggccccccccccaaaaaaaaaattccctttttttcttggtttttttttttttggggggga

SEQ ID NO: 722754 - DNA, 965 bp, Homo sapiens
gctccgtctgccgctgctcacagtggtactgcctgtgcgttgtcaccggtgactctcgcattgttgcggttagtgtgtgaccgcgacgggtgactgtcgggctagtgctcagccagttcttgtcgcgtgtctggccacttgcgggccgccctagtccccccgcgagccgggggtgcctcgcggtggttttccggtgactcctgtgctatggcgcgccggctttccctctgtttgggtgcccccgcgcgtgacccatgtgcagtactatcctgctgcggcgcttgcgaggtgtgtttgcgccctctgtttgtgaaacccgggtcgtggtgcccctcattcttcgtgcattttttggtaggcccccccctgcgtattaacgggtccgggacaaccaccccgatctggtagagggtcttgtcctcgagttgaccaaccactgtgggagaccactttccgcgtcgtcatatcggacagcaacctcgctctccggctggggattctccctaacccaggtggtcactcaaatgcctggtgctgaatgcatttgcacacacgtccacctcacgtatctgtccccgccgatcatgcttcacgagacgctgctttgagtggattattctaagtgcccattaccacgccccaccgccgctatgtgaccacgcgggggggcgaagaacgaacgggcctatacaaacgagggtgtgtctcaatcgccgctcctctacagcgtcaatatgatcagaagacgtgcgtatgtgattatccaggagctgaatgtctcaaccctctctaaagaagcaagagtgaacaagtatttgggggcacccgctgcggtttttttttgttccgtatggcgcactttattgatatgagttttttcaaaccccatttgtttggaggcctagtgtccccgacatttgtccccagatgtcgggacccctttcaaaaaatataatgggacaaaa

SEQ ID NO: 722755 - DNA, 392 bp, Homo sapiens
caggttatgactcggtccggaccggtcccctgctgcgtcgcccgggaatgctggccagccacatgagtgccctcagccagtcccagctcatctcgcacatgggcattcggagcaggatcgcccacagctccccatcaccggcggggagcaagtgagcgaccccctgtccctccagctccactcatgaagaggagttggaagtgcatttcaagatctcgggagaaagaagaccttaaaccgacccaggaaaaacggcccagaacccgaggacgagaacccagaaagaccccaatgagccgcacaagcctgtgtcggcctgcgcactcttgttcagagacactcaggccgacatcatgggtcagaaccccagggccactttcggtgacgtgttc

SEQ ID NO: 722756 - DNA, 584 bp, Homo sapiens
  misc_feature (426)..(426): n is a, c, g, or t
cctccaggctcccccagaccacctatttctgttattacttgaatggaattgttgggcccttgtttttaaaagcaggttcaggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722757 - DNA, 645 bp, Homo sapiens
  misc_feature (487)..(487): n is a, c, g, or t
gaaccattccaaggcaatacttaagaaaagagctaaaacaggtagctgattaaccatacagatatctgtcagaagaggaaatagcaagtgcaaaggtcctgaggcaggaatatatatggtaggatcaagaagtaccaaggaggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722758 - DNA, 644 bp, Homo sapiens
  misc_feature (486)..(486): n is a, c, g, or t
cgcggtacggcatcacacacacacacacacacacacacacacacagacacacaaaattgagtatattgttgctattattattttgaacacataccgtaatctcttagtatcaattaagagtaagaaagataaaagtttgtggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722759 - DNA, 1007 bp, Homo sapiens
ggcatgcttcggacactggacatcaaacacgaagacgaagtgaaatcgtagtctcgagtgatgatccatgttttcagcgacgggtaacaaactggggcaggatgtgactctcatttcttaggtgcctttgtggctcaacacttgaagaccataaaccaagaacgctgcatcgaaccattagcagaaagtatcacagacgttctcgtaacggacacaacgggcactggctagttaaaccaacagcaggctgggatgggtttgtggagttcttcccatgtcagaggcacctcagcacaggtggccatccaggaatgtgctgctggctttagcaggtgttgctgcagtaggagctggtttggcatatctcaataagcatagccttcctgtcagtgcaaatcagttgacttcaaccaacccaccacaacacaaaaccagtttcatgcagtatggaactccacaagctgtacaaccttcctagagtagcacccataggcaaccttagcagaaacagcaagtggccagaggcattatcggctaaccacggcacttacatacatgggaaagagtgctccccatttgattgcaagcagtcactgtctggaacagcataacaaaagttcaagtttcagcaacaaacaaacttagtctgcggaagcctatggaggcaggactaacagatataacagaacacaggacaccggggaacagacttcaataccctggtagagaacaggaccgaggcccgcaagcccggacaagactcgcaagtgaaccacggacgaacttaatacatacaccggacctgacaagcacagccaccaccaaggccacggaccgtggtacccgaccgaccacgcacacgacggcacaccaccgacggcacacaacacacgaccacaaaacatccaacccatccaaccaatcagaccaaccagcacaagacaacagacacaacaaacaaccacacagcaacacacacaaaaaaacaacacaacaagaaacaaaca

SEQ ID NO: 722760 - DNA, 563 bp, Homo sapiens
  misc_feature (405)..(405): n is a, c, g, or t
accggaacctagcgacgcaaaatctaactatactggcttagcaagtaagttgacttctcggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722761 - DNA, 668 bp, Homo sapiens
  misc_feature (1)..(1): n is a, c, g, or t
  misc_feature (85)..(85): n is a, c, g, or t
  misc_feature (137)..(138): n is a, c, g, or t
  misc_feature (143)..(143): n is a, c, g, or t
  misc_feature (154)..(155): n is a, c, g, or t
  misc_feature (224)..(224): n is a, c, g, or t
  misc_feature (400)..(400): n is a, c, g, or t
  misc_feature (664)..(664): n is a, c, g, or t
nccgcctgtgtgcgctgcccaaggctttgcgtgtggcccccaggggacgtttggccagcccccaaagtgccgcccaaggccccanggctgccgcccactgggcttgcgtccgcccatggggctcgtgcccacgaagnntctcnggtgcttttgnnggagggttgtttcaatcgttggagtcaagggcgtgtaaatgctcaagccactagaactttcttccactncgcttccgggtcgcttcaagagccgcctttaaaaaagaaacattccacgttgggcacttctagccagttagagctatagagttgaggcgccccggacctcgacggcgtccttagtaggcgctcctttccggtccttcgcgggaagcgctgccttctaaggtctcgcttctcgcgcngttctgagggagataggcctccagggagaggacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggncgca

SEQ ID NO: 722762 - DNA, 122 bp, Homo sapiens
tcgagctctgtaccctcgataagggcaacgctgctcagaatccgccaggaactgacctgctgactgctctctgccaggaatcccaatgctttcactcttatctaccctttggcctttatgag

SEQ ID NO: 722763 - DNA, 619 bp, Homo sapiens
  misc_feature (461)..(461): n is a, c, g, or t
aacacaaaagcgggaggaggtagagaacattgctgctgtccataatgaagtgagcacagttgagttgagaggggtggattccgaggaaaggggctgtggaaaagaaagggagagaggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722764 - DNA, 997 bp, Homo sapiens
cgctcgccctcgcccctgcccgtggacaccctgcccgcacctgcccgatccccgtcggctgctgccggtggccagtcagctgacaaggctgggcacaggggagcggctggatggggatggcggggctggcgcactctgtgggccagaggccgagctcgtggtcatgcggcggatgcacctgtccgagcgccgatgactctcttcaagaatgcatggagtgccgtgcaggaggttagcttcgatgatccgcaggaggaggccatatggggctgcgccacctctagttgcctatgatgatcgccggttgtgaggtgcgatggaagcctgtgccagttatctctcgggcccaccgtgaagagactgattccctcgtgccatggtctctccctggcatcaaagttagcgcgttttcttgtagcaactgttttattccgtaaagtcagtgcctggactggggacctgagccatccatgcgctgacgacccgagtaggccgagaatgccatctcggtccttgctggaacggtgtgcagacatcgcttgtgttctggtgtcaatcagggtggctggatggggcaagaatggcggacaagggtggcgtttggtaaatagcgaggcaaatcccatgcaaacttaatttattcagctttttccttatattattgcaattttgaaaacgagaagttttcaactcttgtttgcccgggggcatggcagttgcaggggcgggtgatcctcgaggtcaacgttggaacccgtccgggctcgccagagtccaagccgaattgatccgtgtgccctacagcgatcaccgcaaaacgtgtgggcgtgggagattttaccgggggtgcccagaagccacaatataatgcccccaggcatgaaatatgtaggggataataacatagcataacctgaacgcgggggggttaccacccaatgtgttgaggatcaagggggacagggttcatccgaaacctcgctgaagcccgagtgaa

SEQ ID NO: 722765 - DNA, 277 bp, Homo sapiens
  misc_feature (79)..(79): n is a, c, g, or t
gctgctctggtggggccttggagaacctggtggtcgaaactcctgatctaactaatctgatggggacgtggagaacctntgtatctagctcagggattgtaaacgcaccaatcaacgacctgtcaaaacaggccactcggctctaccaatcagcaggatgtgggtggggccagataagagaataaaagcaggctgcccgagccagcattggcaactcgctcgggtccccttccacgctgtgggagctttgttctttgcaataaatcttgctactgct

SEQ ID NO: 722766 - DNA, 663 bp, Homo sapiens
  misc_feature (505)..(505): n is a, c, g, or t
ggtatataaatatatattatatataagtatatataaagtatacgtttactttatatatatctatccttatttagattatccaggtacttactaaattctttgcacatcttgaattcttctctttctaggttcaattttcctctttctaaacatcatttaggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722767 - DNA, 583 bp, Homo sapiens
  misc_feature (469)..(469): n is a, c, g, or t
  misc_feature (471)..(471): n is a, c, g, or t
ctcggtacccgcgaacatgcggcatgcggcaatgatataatacttttaactctcacggcaaattagtcacttgtcaagtccattgagagaccaatggagtcttgtttcatcattttatatcctgtataatttttttctaacttgagcgaagttttatactgtatttagttcaatattctacgttaaataaaaccagggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaananataaataaatttgtcacttagcttgtcatcagagagttctgcaagtttaatcttttgttaaaaacacagcttatcattaatacttcctgtgaaacggagcgtccacttaggc

SEQ ID NO: 722768 - DNA, 677 bp, Homo sapiens
  misc_feature (519)..(519): n is a, c, g, or t
ggcgatctagaggatcccggaaaattagcgacgatgcctctactcctatgcacttccaccttgcccccaccaatgagagatcgcctgtgtgacaaccactgtgtgatgatggaaggtgaccataaaaatcagttttctgtgttagtttaaattattgtcaagagttgtcctttggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722769 - DNA, 569 bp, Homo sapiens
  misc_feature (411)..(411): n is a, c, g, or t
agaatcccgcgcgcagtatcggaatattcctaactgtactctttgacatcagaggtgcagaagtgggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722770 - DNA, 599 bp, Homo sapiens
  misc_feature (441)..(441): n is a, c, g, or t
cggtcatggggcataatgtttatatagatgcagtgtgtgcaaaacataatagtgacaaaagcaggaaggaggacgggaattaaaaaggagcagcaggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722771 - DNA, 249 bp, Homo sapiens
tagctccactggaacgacgccacagaatcgaacatcaccgagcggcacggcgcgcctggggcaggcgcgcggcattgcggaccacgcgactagacacagatcgacatgctccctggaagtacatgagcgagcataaagcctccggttctcaagcttatgttgttatgcgcgtcattaagcgcgcatgtgcgcccacggacatgggcaccctgaccaaagccatgcattgagacgcacgcggatgaactt

SEQ ID NO: 722772 - DNA, 177 bp, Homo sapiens
ccagcctgctgcttcctaactattgcctgggcagtgcccaccactgcacccctgatgttcgccgtctggcgagggttaacagtaaaatattgtatattattaaatagctagaagagaggcttttgaatattctcaccacaaagaaatgataaatgcatgaagtgatggatacactaa

SEQ ID NO: 722773 - DNA, 645 bp, Homo sapiens
gcggttttgttttttttgttttgggtgcccctcagattgggggggtagaaaggggaagagaaccccgggcccaacgggcccactaggggagacgcccacggaagacacggcaccggggacaaacaaaaaaacagcccgcaaagagcgcgcgtggacggacacccgggcaaccgggggcccgggcgaacatgcgggacgcatgcaaaccgcggagaactcgtaaaacacggcgccgtgctctacgccaacacaccgcgcgaagagcccgacgggcaacacgcgggaaccccgcgcagcggccaccggggacaaccacgcgaacgcgacttccgcgcccacccccgcgcctcggcgacggccacggagcgcgcgcgcgggagccgccaagggcccaccacaagggaccgggcgcaagcccgcggcgaacaccgggcacgcgcggaactatgggcggacgccgcccaaccgcgcccaccccacccagacgccagcccatacgggggcgcgccgcggggccccgcacgaggggcgcacaccccacaccacgcggggcacccatccccgcccggcaccccggcgcgcgcacccccgcgcgccgcggcccgtcgaacaaccccacgcgcgcggcagaggacggccgcgccg

SEQ ID NO: 722774 - DNA, 377 bp, Homo sapiens
cgtccagagtccgagtagcagcggggatacaggcatccacgcaccacacacggctaaatttcacgtactttcagcacagacggggttcaccatgtaggtcagggccggtctcgaactcctgtcctcacatgatccacctgccttggcctcccaaagtgctggaattataagcataagccaccgcgcccagtttcatcactatatcttttgggtaataatttccatcttcctaactcaaagatgaaatgcgtacagagctgtgtatttttatggtcccatttcatcttcatcaaagtcttctgaggaattccaagaggttctccattgataatgcacagcaaaatttcttagtgtccactttccttgtctttccctct

SEQ ID NO: 722775 - DNA, 285 bp, Homo sapiens
ttttttttaacaaaacccccaaaaaggggcttttttgggtggctagggggggccccttccccaattttgaaggttctggggttgaaagccccctttttttttgtttaccctttttgggttgggggggcccctttttgggccaaaaaatttgggattttttttcaaaaaaaggttttttttcccttgccaaaacccggctttgggttgggggtataggggggatttttttgtttgggatttttaaaatggccctttcctaaaaaggaataaattttttgattttga

SEQ ID NO: 722776 - DNA, 173 bp, Homo sapiens
tgaagggaaacaaaaaagtgtttgatggggccagagaggggctgctttccagaaagctaaaatttaatttcttttttcctttgggttttggacttcaaccagcctacaagggggcccttgctaacaaatcagaaatttgcccattaatgattaaaggctgtggttgcccccca

SEQ ID NO: 722777 - DNA, 412 bp, Homo sapiens
ctttgttgcgtcaacgaccctagccggagactcaagctgccccctgtgataagtgccttctcgtctttctggtgtgattcaggactttaggggtcagtaaagaccgaggagcctttattgtaataagaaacagacataatgccccttcttcacaagccctgtaacaacagctaattttttttttttgatctcccctttctcccttgaaattaatccagtctgggcaatagatgcagtctgaccctttggatgtaactaacaatttttttataattaattttttcttccattcacccaatttttcctggggggagcctttgatggccctgaatttttacaccgacccaagtttttcgggcccttggaacccaatgggggttccagaaaaccttttacgcctgttcacagaccg

SEQ ID NO: 722778 - DNA, 116 bp, Homo sapiens
gtgctgttctagaggatccagaagatcccaagaagaagaacctgatagtaagaaggtggaggaagacttaaaggcagacgaaccatcaagcgaggaaggtgatcttctgcacgata

SEQ ID NO: 722779 - DNA, 166 bp, Homo sapiens
aatagagacaggggtctcagtatgttgcccaggctggtcttgaactcctgggctcaagatatcgtccctgcttgttctcttcaagtgctgagattacaggcatgagctaccatgcctggctgaaaatttatgatgccagatcaaattgcccttctgtcgtcttctc

SEQ ID NO: 722780 - DNA, 383 bp, Homo sapiens
agtacgaatcgagctcggaccggatatcatagaaaccatattctcacttcaatctgtttgaaagagtaggtatcatgtaaattatatttttaaaaatgctgcggataaaccagggcgtatgtgcaggtgccgtcgcctcatctctcctcatttgtagtctgcacttgtggattcaatctgatggtatcaacagtgtcctcatctcccagttccattatccatgtcttctgattagccgatgacatgtagttgcttcggatttatttcccagtgctctctaatacctcattacactaaataagtgtcaccacattagcatgaaaatatagtcgtaattattaaagaggttccccgaaagtaccgatgtctataaccgtaagaga

SEQ ID NO: 722781 - DNA, 316 bp, Homo sapiens
atcatatatctgagctcctcccgcccaattggcccaatctatcaccctatagaagtgctaatgttagtatcagtagcatgaatacagtctcctccgcataagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagctcg

SEQ ID NO: 722782 - DNA, 135 bp, Homo sapiens
agaagatgatgaaaccgttaacagcatgtacgtccccgtacagagcagctaagaggaacctttaaatgagggaaatcaaaatcttctttcctgggggaagattcgatgtcacactgtgattaagtaacgcggggt

SEQ ID NO: 722783 - DNA, 397 bp, Homo sapiens
gtaaaatcaattttacaaaatttaagggttttttaactaaagggtcgcctttttaaggtattttgaatattagggtcatttggcacttttccgcaagtagggtacttttcatgttttggaaatatttggatttgggaaaaaatggctttaggcccgcgtctctgtttgaccttgtttgggtgaccctttggggtaactgttttcatttaccgaaatgcatttttgcttttaaaggggttttttaatgggacttgggatcccccttttggggggacctgcatatatacccgtccttatctgtttgggccctaaaccggtttaacctactttggttttttttagttaagccctaagttcaacgtgttaactttttttccttaaagaatttttttttcca

SEQ ID NO: 722784 - DNA, 505 bp, Homo sapiens
gaactgacgacgcggctgggacagaaccagaactacttgtagaaagagaatctagctccaaagtagggaaaggccaggaaagaagccagggggagcagagggagcagaaaggcggcgcagagactcgctttctctcaacgtgacgactggggagactaacacattctctccccaaaaaagtcaactataaaactggacaaaactgtcaaaagcaaccatttcagaacagtagaaactgaccaaactttgataagaacaagcagagcttggggatcatgcctgggctgtccccagcctcctcctagcaatgctgaccggtagttcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagctcg

SEQ ID NO: 722785 - DNA, 515 bp, Homo sapiens
ggccccccgggttttcccttttatgtttcgggttggaatgtggggggaaattgtaagggaaaaacattttcccccgggaaacagttatgcccatgtttcccccaagttggaaattacccctcataaaagggaaaaaaagtgggggttcccccgggggggggcccgtttaaaaaaaaggggttccccggggttgaagaaattgggcaaaaggaaaagttttaaacaatggggttttggtcacaggagtttttgaaaggttggaacagttaaggtaaaggcccccggtttgggctttttttttttttttatttaaaattaaaaggttggggaacccgggggggaatttttattttccggggacggttttggtttggttttttcccttttccccccccttggccccaattaaggtttttccccattaggcccaaattaaatttcccctacaaacccctaaaaatgttttgggaaaaaggtccccagtttaaccccaccaaaaaatcttttactttcca

SEQ ID NO: 722786 - DNA, 417 bp, Homo sapiens
ctggggccagatttgtcttttcttttcttttcttttcttttttgagatggagtctcttgctctgtcacccaggctggagtgcagtggcacgatcttggctcactacaacctccgcctcccaggttcaagccgttctcctgcctcagcctcccgagtagctgggactacaggcgcctgccaccacgcccagctaatttttttgtattttcagtagagacggggttttgccatgttggccaggctagtctcaaactcctgacctcaagtgatccagccgcctcggcctcccaaagtgctgggattacaggtgtcagccactgcttggggcctggcttttctgactcggcttaggaattcggcggatgtggctgggatgctcatggcctagaactcaccttgctccttgtagacctgaag

SEQ ID NO: 722787 - DNA, 414 bp, Homo sapiens
accttctcagtggggaacaagggcaacgcgtggagtcctgagaaacagatcattcaggacagtgtctagcgggtcaattctagggctgtgtgatgacatggactccctcattcctctcctattaaaaagagcagagtaggctgggtgtgatggctcatgcctgtaatcccaacactctgggaggccaaggtgggtggattacctgaggtcaggagttcaagaccagcctgaccaacatgaagaaacctcgtctctaccaaaaatacaaaattaccccaggtgtggtggcgcatgcctatcatcccagctactcgggaggctgaggcaggagaatcacatgaacccaggaggcagaggttgcagtgagctgagaacacgccattgcactccagccagggtgacagagtctgtctc

SEQ ID NO: 722788 - DNA, 326 bp, Homo sapiens
ctaccggatttgactacgcggctggaggagtcacccctgttgcactacctgatggagccgcaactctggccccggtccgaggggccgcacctgtctccccgggctgaggagcctgcgtagttagatctagccgcgttgtctgatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagctcg

SEQ ID NO: 722789 - DNA, 751 bp, Homo sapiens
gggtggtgggaaatcggctgtggtagagaggctatgcctacttgaggagcgcgaatccggcgggtatcagagccatcagaaccgctgccatgaccggtgtgcgcaaggcagcagcaagatgctgcgagcaatattgattacaggatgaggtgtcatcctgcaggcactggtgcggagtctttctagttgggctacctatcaaggctttatgaccaggcatcgcgaggatatttagtataccctactgttgaactagtggatgcaggttccgggcaccaggatccacagaccatacagaaaactgcgcgaacacaaagccacgaaaaagggacagagcaaagccgtagttctctccgcggtcttggtcgacttcgtcatgtcggcagcgcgagagtacagtcgtggtcttcaaagttgacaccgtatgagggtgacccgtcccttcccgaaacgaatatcgttgcggtacttgggtacacgaaggtatccgacgtgttgcattgtcgaagcgctcgtacgggagggcccccattgggaatcgtgcgcatagcgagactagcctttgggcacatgtattgagacaatcgccccatgcgtaggttagggtttccgctaatagcccgcacaagggggcttcccgttgcgagagaacgtatggcattcgtggcccaagtcacgaggtagggcggcgcttgggcaggaggcaaatccccgaagatcagggatgaaatgagcccccgatcaatggact

SEQ ID NO: 722790 - DNA, 451 bp, Homo sapiens
aaagcaggggctccggctcaggtgattatcctgaatcatccaggccaagataagcgccgtggtatgccccttggtgttggattgcctactacggctcacatttgcgtgcaagcttagcgtgaggctgaaggataagattgatcgccgttcatggtaaaaagctggatgatggccctacattcttgcaggtctggtgatgctgccatatggtgatatggttgcgggcaagcccatgtgtgttgagagcttctcagactatccaccgttgggtcgctttgctgttcgtgatatgagacagacagtggcggtgggtgtcatcaaagcagtggacaagaaggctgctggagctggcaaggtcaccaagtctgcccagaaagctcagaaggctaaatgaatattatccctaatacctgccaccccactcttaatcagtggtgggtcagaacataag

SEQ ID NO: 722791 - DNA, 140 bp, Homo sapiens
caggttccggtcgctcggcacaccattcagatgttggagaaatgtagtccatgtggctattctctatgcatgtcgctcctaggttcatagcgcagtgtggtctggcggagttctctacccgacctgccactcagcgcaat

SEQ ID NO: 722792 - DNA, 334 bp, Homo sapiens
ctacgcggctgggcgtggtggctcatgtcccagtgctttgggaggcgaaggcaggtggatcatctgagcccaggagtttgagaccagcctaggcaacgtggcaagagcctgtctctccaaaacctactaaatttagccaagcttggtggtgtcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagctcg

SEQ ID NO: 722793 - DNA, 540 bp, Homo sapiens
  misc_feature (30)..(30): n is a, c, g, or t
  misc_feature (342)..(342): n is a, c, g, or t
tgggttataagaaaaaaaaagttacaaggnttcttccgtttcatgtccctgcaaaagttagggcaaaaagtgttccaggcccaaccccaatttaaagggggggggcccccccccagtttgtcctttcccaaaggggaaagaatcccccaagggttggggaagggccttaaccaggaggccttttcccccaaaagggtttttttttttaaaaaaaaaaccccccagggggggcgggggcccaaaaaccccgggagcccgttttagaaggaagggcaaaagtagggtttttaacccaaacggggggggcccccggggcgaagggcgccctttttttttaacccntttaaggaaaagcaccaaaggaaaattgggttttccctttttaggggggggggcattccccaaaaagggttttggccctttcccccccgggcctgtaaaaaagttttttaaaaaggcgggggtttggaggccggggggagccccccccccttttaagggggggtccccccccccccaaaaaattttgtttggggggga

SEQ ID NO: 722794 - DNA, 306 bp, Homo sapiens
ccctctgtctacgcggctacacaaagactgctgaaaggaacacacatactgttttctacagcagctacaccattttacattcccctcagcaatgcacaaggtttccaatttttccatatccactcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagctcg

SEQ ID NO: 722795 - DNA, 622 bp, Homo sapiens
tgaagctgcgaagcgcttttggagcctgtgaatgaaccttcctcctttccctcctccttcttctggttgagtctcctcctgggttttgacggtccagggatataaggatgatgggggtaacaacccgaattggaacttgcaggcaagctgccccgagcctttctggggaagaactccaggcgtgcggacgcaacagccgagaccattaggtgttggggccagaagctggaaccaagatcttgggccagccccgaatcctcccgaattttccagaaccgtccggaaccttccgaatccttccccgggccaccacgcttcctatgggacccgcctgggcaacgccgaacccagtcgcgcagggttgaagtgaattttccccccaaactgcaataagccgccttccaaggccaagatgttcataaatataaggggcatctaatggaggggttcaaccttaatagtaacccatgcgctacataagggtgagtgtgctaacaaattcttggtggttaattgaaataaaaaggaaagtgctgaaggatgaaatggcaatgtggaatcactggaataaaggatggatttttaaaacctattatgctgactatcagtttattttgggccc

SEQ ID NO: 722796 - DNA, 256 bp, Homo sapiens
agagcatcctattctagagtcatatcaacaatagggtttaggagctcgatgtggggtcaggacatcccgatggtcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagctcg

SEQ ID NO: 722797 - DNA, 152 bp, Homo sapiens
ccagaggatcctgaagcatcctaacagaagtactggtcttgaactccagaccttattgatctgccccgccttggcctcccaaagtactgggattacaggcatgagccactgtgcccggcctatttctttttttttaagacacagtcttgctc

SEQ ID NO: 722798 - DNA, 264 bp, Homo sapiens
ttaactacgcggctgggcgtggccgctcacgctatatcccagcacttttgggaggccgaggcaggcggatcaagaagtcaatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagatcgagccgcgtagtcagctcg

SEQ ID NO: 722799 - DNA, 291 bp, Homo sapiens
gtgataagcagtatagatcaccaagcacgatgtaacaggcccagccctagatgcgggggacacagatggtgaatgagaggtgggcccctgcctgcaatgtagggaacagagcagcaaacaggattccacatctggtggaaggacccaggaaggctcctctggtccagccgcgtagtcagatcgagccgcgtagtcagatcgagccgcgtagtcagatcgagccgcgtagtcagatcgagccgcgtagtcagatcgagccgcgtagtcagatcgagccgcgtagtcagctcg

SEQ ID NO: 722800 - DNA, 273 bp, Homo sapiens
gcgaactacccgcgatcggctgacgttttcatcgatgccactgccggaatcgcgctgcaaagtctcaattaatctgaattcaatatcaccgaatgcagatgtaaatatcattgaacgtcgcgcatttgcatcgaatttacggttgttaatcttcgagctggtcctttcgattatcatccgcgcaaacagcaaaaggcactccctccgtcagtcgagtgaggccgtcggggttgttccatttcagacggggcagggagtgctttcgcatgagac

SEQ ID NO: 722801 - DNA, 275 bp, Homo sapiens
cagttattacggcctgactgccggtcagcctagatttggaaccagccatacccatactagcgggggctatgacagtcttctgttggtcagtcacgactctagctatctccttcttatagacggtccgcacggtcatgaccggtccggccagccgcgtagtcagatcgagccgcgtagtcagatcgagccgcgtagtcagatcgagccgcgtagtcagatcgagccgcgtagtcagatcgagccgcgtagtcagatcgagccgcgtagtcagctcg

SEQ ID NO: 722802 - DNA, 209 bp, Homo sapiens
cgatctgactacgcggctggctcgcccgctcacggggtgctcacagcggcgtgctccagctgcactgaagctggcaatgaggaagccgcgtagtcagatcgagccgcgtagtcagatcgagccgcgtagtcagatcgagccgcgtagtcagatcgagccgcgtagtcagatcgagccgcgtagtcagatcgagccgcgtagtcagctcg

SEQ ID NO: 722803 - DNA, 588 bp, Homo sapiens
  misc_feature (430)..(430): n is a, c, g, or t
cgtccgtcgaccgctcagggaactatatcaaatctcttggtatagaccatgatcgaagataatataagaaaggggcacactaatggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722804 - DNA, 662 bp, Homo sapiens
ctgagcatctgggtgtaccgttagcacggagattgcgccggctgtacgttcagctcgaggcctggagaccagtaccttggctcgcctaagcgaggtacgccaatgaatagacgtgtcacgcgctgaaggctgaagatccagtgcagggcagaatcaagtctgaggagaaggaaagacatggcaccagtgaaggcttgatctcgcattaaaggactgactgaagggctgcaagcactccatgttcatgagtttgcggataacacaggcgcctgaaccactgcacgcccttactttagacctctatctagcacggtgggccaacgcatgaagagaggcatgctgcagactcgcgcaacgcgactcggtcgaccaagatggcgcgcccgctcgccctatcgcagattctccgatcccactttcaggcgaccatcgcatcatcggccgtacactgctgcgccatcgacaacgagatgcctcgctcccctctctccctgcccatgccaccagcccgctatccgctgaagctcctcggcctcggcccgctccgtcatcgccctatctcctcctctccaacgcgcccgacatcccctcacccaccccgtacaccctagtcagctcccgtccccctaccatcatccccctctccattcgcggctcgccct

SEQ ID NO: 722805 - DNA, 646 bp, Homo sapiens
  misc_feature (488)..(488): n is a, c, g, or t
cgttgcatatcactttgtctctcactgacattccttctacacgaaggcatgacctggacctcaatctgagagccccaagaaatgaaaggtgttaatgaagtactcttcattccaaaagaaggatcatcaaaatcaatcctggggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722806 - DNA, 595 bp, Homo sapiens
  misc_feature (437)..(437): n is a, c, g, or t
gttattttgtgggctttaacatcatgctccttcctcccgactccccgccccaaatcacaaaatacagaaaagctctaagaaaacaaaaatcggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722807 - DNA, 657 bp, Homo sapiens
  misc_feature (657)..(657): n is a, c, g, or t
cataacgagtcaacgctgtggaggcaggatgtagccagtgccggcgacatgaccggcttgagccagggagtgctcgaccggcagaagaatctgggcagagagatttgcataaggtacagcgcctggatgacgacatttctgctgacgtgcgaacgcagaggtactcgaggataatgcagcagatgaagtaagaggaggacgagaagaccaggctgcccaagatgctatgagcttttgtgtactaccctttcgcccttcagctgtgcgcctggagccaggcctatcatgctagctactcatgatgctgagctcacaggaatctagtagcagatggcatgtcactgtgtcgtgatgagtgtaacatcttgcctgttggactctagttctgctcgacaagccgagtattctgcttgaccacctcacgagggtcgaggagattatcctgatcgcgagggtcgtgcaacctgtgtctcagctaactcgggctgagacagaagattcgattgaaccaagagatggaggttgcagttagccgagattgtaccaccgcactgcagatttagcctgagagtcacagcgagtattctgatgcaagacaacatagagctcacttggccttcgccctatcatggggggcattatagtccagtggctctn

SEQ ID NO: 722808 - DNA, 603 bp, Homo sapiens
  misc_feature (445)..(445): n is a, c, g, or t
gatctggtattgccgtgtctgtggcataggctggcagctgcagctccaatttaacccctagcccctgtgaacttccatatgccttaaaaaaaagagagaggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722809 - DNA, 589 bp, Homo sapiens
  misc_feature (431)..(431): n is a, c, g, or t
acatctcatttctgatttgtcagttacttattatgagccaggcactgtttgagaaactggggatgcaataaggaataggacatgaggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722810 - DNA, 360 bp, Homo sapiens
tggttagaaatagatgaatttttatttttaaaaaatgccaataagggcgggacgaggtggctcatgcctgtaatcccaggactttgggaggccgaggcgggtggatcacttaaggccaggagttcgagcccggcctggccggcatggcgagaatttgtttgtgcaaaaaaaataaaaatcggccaggggtggttgtgcgcccctgtgatcccagttactcaggaggttgagggggggaattgcttgagcccggtaggtgggggttgcattgagccaagttcatgcccctgccctccagcctgggtgacagagccagaatttgtttcaaattcccctagtaagccaactagaatatgccca

SEQ ID NO: 722811 - DNA, 729 bp, Homo sapiens
cagtcccatgctttgtgtcctttatccatgctgttactgtctcccgttatccttccaacatattgtcacaggggtattcgtcagtgttcacgacgctctttgcaaggactgtggccatctcgctacgaggtggcgactggcaagtttgagcttgatccgtctgtccttcccagagggcgagcctgccgcatagggaatgcctagcactgtaggactctccagtctgccaagggtgtaccatgccggacctgccgcaagcaggttggtgcacagcggtgttgcatactcagccctgcatgccaagctggtatgcgcaaccgagattaagctgaagggtggatcgggcacatgactggcctccatatagtgtctgcatcggctggatgacacaacagcctgcctgtggtacagcaccacaagcttatcatgcctggtcaagaagcaggccttgggcaggttccagctgatcgttggcatctttgcctggtagttcgatgggactgctggtcccttgcatctcctgatatataggcgcagacatctatgaagcaagacttctctcgtaccccagttgccacatagcagcagtcactggcagcgtctaccccgcatcttctgctcttgtccaattggtgagaataaggccccgtcatcagtgggcagcaggtctgagtactctcatatgatgctgcgattttcctggagctgactacacaccggtatatccct

SEQ ID NO: 722812 - DNA, 630 bp, Homo sapiens
  misc_feature (472)..(472): n is a, c, g, or t
ccacagaacacaaaacaaaatgtactctggcagatggctgagacgcctagaaaaagagcagtatgaacatcctccctgtgccttcctggagtatcctcccttgtgtccttaaaaacatcacgttcaggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722813 - DNA, 638 bp, Homo sapiens
  misc_feature (480)..(480): n is a, c, g, or t
ccctaattgtgccaacggtcacgtcacgctccatattttcccttatttcaccatcttcatggcacttgcctgaaattcattatttaatatttttactttctggctctgctcacggcatgggaagttcctgagcctgagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722814 - DNA, 165 bp, Homo sapiens
gctatcgtgcggtgcttttcttcttcgaagtgcccgctcagcaagcagctggcttcctgctggctcgctcagtctccagcatctctaccctggctggagctgtgtgttgttgcagcaagagtggctgcctcttgcttcaaggtttccagctgcaagacatcaccc

SEQ ID NO: 722815 - DNA, 563 bp, Homo sapiens
  misc_feature (405)..(405): n is a, c, g, or t
aatgcggctgactgacttaccttagatgggatgaatgctgtctttaaaaaaggccctgtggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722816 - DNA, 158 bp, Homo sapiens
  misc_feature (137)..(137): n is a, c, g, or t
agacgagggagaagggatgaaagggcgacgctcatctaagtggagttcagaagcgagcaaagtgatacggacccacagacaaaggaaacacaagcgggtacccaagcgggtcggatacaacagcagcccatggttgntccggtctgccggatacttac

SEQ ID NO: 722817 - DNA, 583 bp, Homo sapiens
  misc_feature (425)..(425): n is a, c, g, or t
caggaactttgctccctgatgtaccctcagaacctagacttgaacctggcatggatctagaattcaataaacatttgtgggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722818 - DNA, 433 bp, Homo sapiens
atggactagtatgtgtagatatagaagagaatctgacagccaggtatatggagtcatagctgaatgggcatttggggacacaagagcagagcacaagtcctctgacagcacattcttggtactcatgtcccatggcatcctggagagagaatctgcggaactgtgcatgatgagaagaaaccagatgtgctgctttatgacaccatcttccagatattcaacaaccgcgactgcctcagtctgaaggacaaacccaaggtcatcattgtccaggcctgcccgaggtggacacaaccccgtggggaactgtgggtcagagactctccagcatcccttggaagtggcctcttcacagtcatctgagaacctggaggaagatgctgtttacaagacccacgtggagaagggattcattgctttctgctcttcaacg

SEQ ID NO: 722819 - DNA, 120 bp, Homo sapiens
  misc_feature (81)..(82): n is a, c, g, or t
gaagccgggaggacttgggtgcgcctgcagggtatcggaaggccggtttggggtgttcaaaagttttctcgctctaggggnnattcttcaaggcaatcactatgtcaaccagacacaagg

SEQ ID NO: 722820 - DNA, 133 bp, Homo sapiens
ttgggaactgagagcactagcctgctgagagttcaggaggggcagattggcacagagggggaagaggaagcagagagacagagtgggcagggaagggtcagtgcccagggtggggccagcatgtggcccaggg

SEQ ID NO: 722821 - DNA, 238 bp, Homo sapiens
cggggaacagccctgggcctgtccaaagtaggaaggacagcatcattaacccctgggtactctcaaaaaagtggttcttgagtaaagacttgagagaggtgcagagtgagccctgcaggtgctgtgagacagttgcccaggattctgctaagagccatggcaggagcttgcctgaaacattggaggaccagaaaggagccatttgggaaagactagagatgacagaagtggtaacaga

SEQ ID NO: 722822 - DNA, 584 bp, Homo sapiens
  misc_feature (426)..(426): n is a, c, g, or t
accgcatactcggggttaggtgaaaactttactttagttattgcctatacttttttctaatgcttaattatatgtatttgggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722823 - DNA, 349 bp, Homo sapiens
caaagcaaaaaattgaaatataccatcagactcattacaaattcaaattaaaaagtgggtgactagggggcgcagtggctcacgcctgtaatcctagcactttgtaaggccaaggcagttggataacctgaggtcagaagttcgagaccagcctgaccaacatggtgaaaccccatctctactaaaaaaaaatgcaaaagttagccgggcatggtggcgggcgcctgtaatcccagctactcggggcgctgaggcaagagaaccgcttgaacctgggaggcggaggttgcagtgagccgagatcgtgccaccgcactctagcctgagtgacagagcaagactctgcctc

SEQ ID NO: 722824 - DNA, 802 bp, Homo sapiens
gatacagctagggccagtccgcatctgactgcgagttaccagttgtgtcagggagaaagatgagcatttcatactctggtcatgtgagagaggcctatggcatctgaatatagttgacgtgtaacagctagtagctactacgcagtgtccagcatacaggatatggcaaagttcaggaagacgtggtcccaactaactactcaggtgtctgctatacagtgtcgggacaaaccaggtggtacgagagccccttggatactgcttagcacagtcgccaagattaagaaacaagggcattcattctgagggagacagggataacatcctgactgagtagctaatagtgcgtagggaaactccccaaagggccaggttacgatatccccgtgaggaaagcaaaccagatggcatcttttggtcgggcgcttcaacggagaggaaaggcacaactaacaagggtgtgagactattagattaagcccttaattctttcataataacaggttacctaaccatggagtcaagttaaattggcccagttgacgctataaattggatttccaccaaaaagcagacacacatggtccgtcaagtgcacttttaatagaaagaggtagtaacgcaagtcctcttttagttaggattcgttcgagtaccaacccaagaagatttcacgattccactggagagttgaccttggaactaggaacataatttgggactggggcaggtcccttgaattttacaaaacctacagacttggctttgggggtgaaaccttgcaatagtgtccaggttacag

SEQ ID NO: 722825 - DNA, 906 bp, Homo sapiens
gcgtgtgccacttctttgtcggggcgcccctatgtgtgtaggcatgctttagtgttgtccgtgcccgttccgcaaatatgtctcgggttgtccactaaccccggggtgttgttgacacggggcctacttttaaaggagcccccctgaagcttttcgcggccccctctttagggggggatctgcccctgcaccacgagtcttcccctcctagctggtgggaccggttacaatggcgaccccgacggttctccacgcgcattcccctccgggggttttattactcgtgttcccccgctgcgagtatcagaaccgctccggggttgtttgctaccacgaggtcagcctcacaaaatgtttactataacatcgcacctttgggtgaaccaacaacctctccctggactcgataataaatgcttcatccacgcccactgtcccacaatgaagacctatccatggccaacacaattatttttcccgcaaccaaaaacatctggcgtcatcgaatttgttcaactatcgacttgatccgcctctcctctggagcctatttacaatacatacccactcagaaccgtctttttaaacaagtgggcgccccagatttgtatctctttcaccccctgacgtgctggggcacccctcgtccgaccagttctttagtgttgtcgcgggtgcagtccagtgtattataagctcctggggcggcgccctcttctgtcctccctgtgatgcggccgctctgcccccctctgttttaggcctcctcgcgtctgccccgtgatgtgtttcttctgcggggaatggggagtcaacccccatactcacagggccgttgcccctgtggtggagcctgctttttcaagcccccgggtattccttatttgtgtattacttcctcttaca

SEQ ID NO: 722826 - DNA, 227 bp, Homo sapiens
  misc_feature (105)..(105): n is a, c, g, or t
  misc_feature (116)..(117): n is a, c, g, or t
  misc_feature (139)..(139): n is a, c, g, or t
cccaggagttggaaagtgcccctgggcaacacagtgagaaaccccattctcctccaaaaaatgaaagtaattaatcctgagccatggtggtacacccctgtggtncccagctactnnggaggtctgaggtgggaggatncacttgagccccaggagatcggaggctgcagtgagccgagatcgcgccactgcagtccagcccagggtgacagaacgagactccatct

SEQ ID NO: 722827 - DNA, 866 bp, Homo sapiens
caggttatcttgtagaatagcaactatcggatttcactcgtacccggagagttttccgcttggttgaacacattggcctcagtgaagagacgctcttctggctcttccgtgacgcattacaacagccatccaggccggtgcagttacgctgcattccttacctccttcccatgtcgggggacctgcatccagcttgcagactagcagagttgaatcgatattcacttaagttaggaatggattggtgtgtcctaacatgagcctcagtcacaccgagagggagtcttgttgtcttaaaaagagcgaacgatactgggcgtggtcgtgggcctgtaggtcccagctgcgtcaaggctagtggatctcttgagtccaaggccaagtgtgagcaacatagcaagagcccagtctcagagacaacatagagggtaccatagagtaactaagtaaaagagaccctcggttcaccttagacagatctatgatttatagaatgtaaagcacgcaaatattcaggccatacttaaggacagatttttgggcaagactggggcagtccgaggtgcccttgatgggcaagggccaggagtgttaacacagtcctggctgagtaagtttctttcccttctttccaaggtcttgtcggagtaatctaacaggtcccgggttttgtcgcgagaaatgtcccttgcattctgcagctggcacgggtggtgacatctcctgttgccttttttaccattcgccggtttgtgcattgggcgaaccgcgtagactttgggaatttcccggggtgccgactaacctggcgtgggtaatggcccgcacatttgttggccccggcttgttggggctccgtcttccgg

SEQ ID NO: 722828 - DNA, 149 bp, Homo sapiens
cgtcatcgcccacgacattcatcttatcacgaagggattcatcatagaggatcaacatgcccgcatgtattccttggacatgtctgccatcatacaatttcaatgataacttcttgtccataaattttttcaactcgagagggtgagct

SEQ ID NO: 722829 - DNA, 132 bp, Homo sapiens
gctgattacaggatcttaaagacagacactcgggggggaggggcggattgctgcaccacccagccttctcttaattttcagtgcttttggtttgggcctccctgcccccatgttttctgggctgggagctcc

SEQ ID NO: 722830 - DNA, 231 bp, Homo sapiens
gaactcttctttgctgcattcctttttcttcacttacaagaaaggcctgaattgaggacttttctgtaaccaggaacattttttaggggtcaaagtgcttataatttactcaaccagggctactttttaattgctttcataacaacttactcattaggtttcccatcaattcaattcattccgatattgaccttgggctctggagggtgggggattgttaaaacacatgca

SEQ ID NO: 722831 - DNA, 226 bp, Homo sapiens
atcagtgggaaggggtgggggagggggcccccagctgcctttcctccctcacaggagccccccccagccccctttcaggagaagccaaaggccctggccaaaaataggaggaaaaaaaagaactctccatagaatgtaatttataaatggggggatatgtatataaatctttttatatgtaaataggcatatatgaagatatatatatatatagtttcctttttta

SEQ ID NO: 722832 - DNA, 690 bp, Homo sapiens
  misc_feature (358)..(358): n is a, c, g, or t
  misc_feature (440)..(440): n is a, c, g, or t
tgcaattggaaagcaggtacggtttataaaccaaccagcttaaaaaaataatctgggtaaacaccttagttacattcttctaataagccggtggatcgggtcctcccggtggccagatctccaccttctacaaaagggggggtctttttcttcatgccacctcgggggaaaagacaattggaggggccacgaggaagtaattggcctcttgtgaagcgtttctccaccagtatagactctcagtgaatcaaatcctccagtgcagatgatgccgtatttaccaagagatcgagcaatacaaaggcggtaactctggtgcaaagcaatcccggttctatatgggatttgtggcgcatanacacacgctggtaagattgagtcacattatacgtggagcttcagattgggggtacccccatggcaatatatgggtctacaantccgtcagagtggttaatcagaaagcctggttggacgcttccacaagggtcccatggaacgatcggccgacgggcgaagaagctggaaacaccttgcgacagccttatatactactgtagggacccctctgtggcccaggattatctaaaagccaagtcttacattagccacgatgtggttacccaagggaacccacctcggctgaaccgtctgatcccaggagcctggttgttgtcgtccccagtagga

SEQ ID NO: 722833 - DNA, 856 bp, Homo sapiens
gagggtctcttcatctgggaaagacatccagggagagagcaatggagaagagtgccacattaatgtcttgatatcggatatgtacgtggtcaaagaaggtttgcgctttttctagctatctgagaatctgtatctgtagtgagatagcatttgtgacacctgacaggcagcctggacatagagagggagaagaagtcagagaggtgtgacaagatagagagctatttaacggctcggctggaaatgtctgggtctgacaggtgcagtctgtggtgctcagcccacttgtcccactatctagcggtgcatgatcctcgagcaagattccgtcatggtgtctgcatttctcacagttgtaaagccacaaggactgttgcactgggcataatgaacgatcatatacgtgaaaattatttgaagacacataaagcactatacagattcgaaactccacttgagtcattataccttgctatgaatgatggtgtctttggggactgagagggtgctatccatttctcatgttttccattgtttgaaacaaagaaggttaccaagaagcctttcatgtagcgttctgtaggaattcattctctggggaagtgaggaagccaggtccacggtactgttcttgaagcagtagcttaacacactccaagatatggacatcacgggagccgctggcagaagggactgtcacgaagtgtggcatggatgttattagccagttgttggctttccctgtatcaaagcttgggcccttcccttcattggtttccaaaggcattatatgagcttgagttatatgttcactgtccccctaatattagggataacaccggaggcaagtgattta

SEQ ID NO: 722834 - DNA, 104 bp, Homo sapiens
gatcaaggtgtcagcacaggtcactgtctggatgagggctctctcctgggttgcaaacagacaccttcttgcttgtgtgttcacatggccactcaactacgggt

SEQ ID NO: 722835 - DNA, 790 bp, Homo sapiens
agccctccccccccccccccccccccccccccccccgccccccccccccccccccccgcccccccctcttaacttcggcaggtcgaggcctgggttttgcgcgcccagtctgggaagtgccctttctctcttagtgtgtgacaaggcaagcgtccggcattgcggagagaactgtggcctgctgtgcttgagtgtgcccatgtgtgtgctggttcatcttcactgctggtctggtgtggcacatttccccgctgctggtgtgcctgtgagaaacttgggcatcctgtgtgtgttggacacactgccatgagtgtcactggcctgtctttgcttgcttgattgctatgtgccctgcctgtcctgtggactggtgtggctgtggctgtgcagtgacagcatgtgccctggcctcaccaacacggtgactgcggtgaagaattgctcagattggctcagtccccaatccttgcttcttgggttgggtgcttgccaagcactcttgcttgcatgaacctggggtgctgctccagtgctgttgatcagctgtcccttttcctggccactctgtaaagttattgtagttgtcttgtgctggagtggtgctgggacattgtgcccaccctgaggtgccgcgatggcttgccgcccagtcgggcaccccaggtccggtgtttgtggagcttgcccgttgacgtgctgtacccctacttcatggtccagaaggagatggtgccagccaagccacccaagggcctcgtgggccgagtggtctcctggtatttagagaatt

SEQ ID NO: 722836 - DNA, 221 bp, Homo sapiens
agtcgagcgccacggtatcaccacgattgttcctcttgaggtggccttctgacacagacttggtgtgcaggctggtttcgcgagccggcggcgttccatttactactctggtgagcctgtattggtataactcgtattgtaaggcttttgagatatcttgtgaccttctgattttccccgtctttggtgcttttgccccctcgaatctgcaggttggagaa

SEQ ID NO: 722837 - DNA, 195 bp, Homo sapiens
tgtgctgggtgactctgaggatccctcagacagcggaccccctgctgggctgtcgtgagggaggagggcgcttcgtcggctgctcgtaccgcgacggtccaaagaagtgttgcgcagccgtgttgtttacctgagggtgtcctggcgacgcccagcccttggcgccttggtgcccgggcgggcccggctgtctga

SEQ ID NO: 722838 - DNA, 504 bp, Homo sapiens
ggggtcctcttgttccctgctggcctgccccttgggaacaagaggacccctctttctcccatgctgcacttactccttttgctagtaaaaggggttcgtagatgtcaaaaaaaaataaaaaaaaaaaaaaaaaaaaatgtgttgtgtgggcgccgcccggggcgccccgtggaaaacgctttttaagacaccatcgcgcgtgggggcgcgcggggccccagaggggtaaggtggaaaccgtgtggcacccaagagcgggtctaccaccaaagagagagagaacgcgggggaccagacgaactagagggccggggattactctgcaccacaaataaagaaaaacgccccccggggggggaacacaggcgacggtcttgcgagaaacaaaattcgcccaggaggaggcgttcgcggagcgacgcacacaacaggggatctatcaaacaaacggaggagtcccacgaggaggactcgcaattaccattgaacgccccgacagagaga

SEQ ID NO: 722839 - DNA, 1467 bp, Homo sapiens
  misc_feature (964)..(964): n is a, c, g, or t
  misc_feature (1030)..(1030): n is a, c, g, or t
ggtgattctgagtacacactgcacggtgtggtgcacccacataatacacctcagctcgcgcactcgttgtgcacgatcgcaagtgagcgaccgtgtgtggagcaaccaaaccacctttgtgtcccgcccagatgattaaagatatacggctcgtatatatgtataattggttgaacaccccgggggcgcccacaaatagagaaagtaatttggtcttcccccccaactaggggggaaaaagaagtgagaaacaatattttaattctccccccgcggcccgatataatattatttccctacaaggggggttttattacccgcccccctgatataacgcgttgtgcgagcgaaaaaaatgggaaagtgtacagtcttaagaaaaaaatcagagcctttggcgcaaaaggggagagagccccccaaaagcctcttaaaagaacccccctccccgggtagaaccctcagatagccggagcgcctatcctccttatatgagaacccaaggcttaaaaaaaggaaggctaaccacacccccgctgcttctaaagatggtgagggcacagaaaaaatatggtggggggagaacaaactttatataataaaggttataagagggcccgaaacaacaaaaacgccttatccccggaaagcccctttgggtagaaatataggcttgggttgtggtccccacaaggagtataggaaatatccctttaaggtgtcacaacaggtgtgtgaaagaaatgttgtggcccccaccccacgggaaagcccccgttctgtagagattgccccccctgtggtgaaaaagattttatacactcgctatatagtcccgcacacaaagagaggagacacacagtcttgtcttctgtggggacacaacacatagagggagaaaaacaacccctctgttatagagagagagagatgtatatataaaaaatgtttaagaacacacccnactaaagtaagcgtcctataaaaagacacgctcacccactatttaaagagagaggcgttttcaaangtgttcacaacaacaccccaccttacactcttataagaatttcccacaaacatatataatctggaaactctcctctcacacacacccacattgtggagccacaatctattcacccctatatatgagagaaactaaatggttatgataataaagtaaacactgagaaacactttctcctccgcaatataagctctgggtacaagagattaaaacacacctgagacactgaacacattaacagcccaataattctacacatcaaccacacaagtcattattaccctcacctgtcaaacccaaacacacacggcaagctacataaggaaaggttaaaaaaagtaaaaggaaactcggcaaattcttaccccgcctgtttacccaaaacatcacctttagcatcaccagtattagaggcaccgcctgcccagtgacacata

SEQ ID NO: 722840 - DNA, 1382 bp, Homo sapiens
ggtccagatcggcggtcccgcgggtctgatctcgtagccttcaaccacgctcgtaatgagtacggagagaacaagatactcggggtacttcatcgtatccaacgcctctcgaatacgtccacttccgcatttactctcgtctcgcctaagctaactcgtcctgggcgactcatccttcatacgagtccatcatccatgacttcatggtgaactcatgcacagatactcgagatgcgtcgggtaagactatcgactatcctggtcctgaaccatatcattgacgccgtcccatgcattcgtatgcatgcaatctaattggcgcacctcgaacgttgggcatgaggcacgctcgctttaaacaggtacactgggtatcaaagtgttgctaacccatgtcacggtccctttctatacaattcttaaccttcatctgcgtggcagcccttacttgagtttatccggaacaccgtcggactggaagttgatggcccatgcatggtgaacaggggcggttggaatgaccctacttttcatttcactccgcctgaaccattagggtctccgcacgcgcaaagtaaaggtctgcccgtaaggggagaccttcaacgggacggcagtcctttgcgcgtaggaaacgccatgttgcaacgggatacgcgccacggacagttcgggacaggtgacgctgaacgtacctccctggcgatgtttccgcaaagggaaccaactccaatatggcagaacggcctcccagagtccaaggtaacacgcaattgcaaaggctaaggcggggaaggcttgataataaccgcgcctacagatggcaaatctggccacgacgtgggagataaagcgccgctaagggcccgctatatgaggggcaccctttgggggcaaaggaacacaaaaaaatgggctaggagatatacccacagggggcaccgtttgcttgaggagacgtccatattacagctttaggctatctttgggaggcgtatttccgttaaggcaccccgggacctgcccgggggagagacgatcactataacgttcaatccggtggggttcgaaaagtttgttccctccttggggacagggaaatcctgttcgggagtgtttgttacgccctacaggaaacttctgaacggagggaactatcgtttgatgaggccccactatatatccaggaaggccataaggaaacatagggtgtgaatatggatatcccacacctcccttttgtgaagcacaacagatcctacttttagcgcaaagacaagagtatgcgtgttggtgcagtccttgtggtagcgctctatggggcacgacggtatcatttggaggagccattggcccgccgcgggtacggttattactttcat

SEQ ID NO: 722841 - DNA, 513 bp, Homo sapiens
cgtgcgggaaaggtgttaaaaaaaagggtttttttttaaaaaaaaataaaaaccgtttcggaaaaagtgaatatgggaaaaggaaagccgaattcccctcttcgcccaatgcgccaccatgtttacaataccctgtcccggtttaaaaatagggaaaatgcaaaaaagactgtgcccccgccaaagaagggtacataatccacttgaggttatatttaaaaagagaatgcccgcccacggtttaaagattgttctgggcaaccaggtgccacatttgtcttcaaatggcaaaggtaggcagtaggagatctttagggcccaaaaactcaaagcagtgttccaacgaaagatttgtgaaattattcatctgtactttttgaattgtatgtagccttggcaaaattgcctaagacaatgagttagactccatcttgcaaagagtcacgtgcagctaagccaagggtgtggccatgtacatcatgctgtgaaaaaattaaaggcagcaataaacag

SEQ ID NO: 722842 - DNA, 336 bp, Homo sapiens
  misc_feature (150)..(150): n is a, c, g, or t
agtcctctcactccccattcccctttctgtgtaaaactggttggaagaaatgatctgacctaccgtgtttgactgtcgtagatacccattcagagagggtcccacccggcccaaaggaggactgccaaagccacacatcacaagccttgntgggtttcccctctcagtctattactattagatcatacccttcttgtccaatcatatttctacacagtccatagtctgttgaacctaaacataaaaatggacaattcccctgtatcttggggtcttcattctgagggctcacatacaattatgatcaaataaatttgtttgctttttctcctgtta

SEQ ID NO: 722843 - DNA, 247 bp, Homo sapiens
gcgtcgacgtagttatgagggagaacagagatagagacatctgggaggatccagagtgaatgtgaccagcagtctgagccaggccgggtgaggagaggggagaggaggggggaagggagaggagagggtagaggggggcgatgggagaggggagagagggaaggagagggatgagaaggagagaagaaagagaggtaagtccttaaggtctcaaacctacacaaaggtcgacgcggccgcgaattta

SEQ ID NO: 722844 - DNA, 192 bp, Homo sapiens
atttatatggtttttagggaaaaaaaatgctataaactgcaaatttgaaattcaaatgggttgttcccctgagaccaaaaaaaaaaaaggagttttaaaagggataatttgttggagccaataaagctttttgttgatgaacaaaaaccaatactgctgggccctgagaataaaaactcatgcccccttgta

SEQ ID NO: 722845 - DNA, 285 bp, Homo sapiens
atcaagaacgcttgcaacggtcagtgcctaccgtacagtgggagaaccgcttcgtgtctgtgtacagtaaggacaaccccaacctgctgtatcaacagtgtgtggcttcgcagtgccgcatcctgcctcaagtgccgcaccagctcatgaggcgttcacccacaaggcacggggtatggaacctgccgacatgaggttactaaggagcgcacagatcagtgtttcctgcgtgtggacgatgagtcaatgcagcgcttccacaaccgcgctgcgtcagattctcat

SEQ ID NO: 722846 - DNA, 202 bp, Homo sapiens
gtgttcgcctactgtaggatcctcgtgctgtaggggtgtgtggtccgtttaccccactatgtgaagatgtcagaccaggctagctggctcagcctcatcaagtacgtcctctatcgtgttacaatcctcttcttcttcgtcgctcggcagccggatcttctgcttcggcatctggatcctccttgccaagaccagcctcgtg

SEQ ID NO: 722847 - DNA, 579 bp, Homo sapiens
  misc_feature (421)..(421): n is a, c, g, or t
acgtcatgatgagctaatctgacaatttttttttttctcacagtttggtaaatgtcaataatttaaaaagacatgggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722848 - DNA, 575 bp, Homo sapiens
  misc_feature (417)..(417): n is a, c, g, or t
aacaaaaactacttgaactgattaataaattcagcaaagtagcaggatacaagattaaccttcagaaatcaggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722849 - DNA, 568 bp, Homo sapiens
  misc_feature (410)..(410): n is a, c, g, or t
ctcaatgcagtggtaaggatcaggcattgccatgagctgtgctataggtcaaagatgcaactggggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaacaacaacctaaaaaaaaattttaaagtcaagagacaaattagccggttgctcttagatttagaaaagtctctggagtntccatgttgtggcgcagtggttaacgaatccgactagaaaccatgaggtttcggattccatcctggccttgctcagtgggttaaagatccggcattgccgtgagctgtggtgtaggttgcaacacggctcggatccataataaatttagggtgaaggg

SEQ ID NO: 722850 - DNA, 178 bp, Homo sapiens
ggtaccctttcacgcatcaataaggtctgcgcactgtagctataggcagcgtcaagtgaggcgctttccgtcgcatagttgacggtgcattccacgcccgcaagtttattgagagtgcgtggacgtggttggcacagttagcgcaggagagccccaggagggcaagttctacatgcct

SEQ ID NO: 722851 - DNA, 903 bp, Homo sapiens
  misc_feature (355)..(355): n is a, c, g, or t
ggaccagagaagctgaggagcatggaccagacccgcagtgctggcaccatgacgctcggccgcttcgtgctagccctgatgttgaggggcgctccccggaagatggtcggctttgattctgtcctcaatgattccgctccacggccacatgcaccgggcattctgacccctgtcgtgcggtccgcactacccctattaccttgcgccacactcagcatgctggtctcccgacgacgcggtcctgctgtcgtctctccacgtgcttgcccgtgctcgccctcgcagggcgctcccttgaccctcgaggttgcacactgcactgccactccaaggcctggtgagacacgcgtcgggnccggtctccctgagggcttggcccggcgcgctgatggcatgggtcagggtgacggacttcgtgccgccccgtgtctgccgtggagccggaggtgcacaccccttcctgtgatagcggtcgcccacatgagatcctggggcatctaggctgatgatagacggggccacaaagtgtaagtctggagacgcccgacagggcgcgggcacgaccccgtgggtgtatctagcggagacgccccgtgagaaaggttggactggggctactgcgactgcggaccacgggatcaggtaccgacttcgttggagggcaaaaacatgagtttgagaggcacacgcggaagtatatgcaaagctggagttggggcaacagactgctagcagccactgggatgaatcctgatgaagtcaacccattgaacagcaagttgcacgcatgcagagtgaagggaagaggcaaaacaaacccggggcgggacatgggccctatcccattaagtggagcatgcccgttgccgagaatgaagaaataagatcgtggtgacaagacac

SEQ ID NO: 722852 - DNA, 500 bp, Homo sapiens
  misc_feature (386)..(386): n is a, c, g, or t
  misc_feature (388)..(388): n is a, c, g, or t
gagataccgtcaactggccagaaccaggaaatattttaagaaaatgtagaaacagtcataataaataatttttaatattgataattagaggaagactctaaaatatgaggtgaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaananataaataaatttgtcacttagcttgtcatcagagagttctgcaagtttaatcttttgttaaaaacacagcttatcattaatacttcctgtgaaacggagcgtccacttaggc

SEQ ID NO: 722853 - DNA, 513 bp, Homo sapiens
  misc_feature (18)..(18): n is a, c, g, or t
  misc_feature (21)..(21): n is a, c, g, or t
  misc_feature (24)..(24): n is a, c, g, or t
  misc_feature (339)..(339): n is a, c, g, or t
  misc_feature (342)..(343): n is a, c, g, or t
  misc_feature (349)..(349): n is a, c, g, or t
  misc_feature (353)..(353): n is a, c, g, or t
  misc_feature (475)..(475): n is a, c, g, or t
  misc_feature (477)..(477): n is a, c, g, or t
  misc_feature (481)..(482): n is a, c, g, or t
  misc_feature (484)..(484): n is a, c, g, or t
aagcaggatcccccccgngangcntgagaacttcttataaaggcaaattctcagcgcttgtaccagacctactgaatctaaaactctggccatggggcccaggaatctattttaaaaagctctccagggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgcgttgctgtggctctggcgtaggccgtggcagatacagcttcgattcgacccctagcctgggaacctncanntgccangggnacatgatgtaaaagacatctatataaagtactaattatagaactgtgtggggagttcccatcgtggcgcagtggttaacgaatccgactaggaaccatgaggttgcgggttcgtcccccgcntnatcnntnggataaggatctggcattgttatgagctg

SEQ ID NO: 722854 - DNA, 319 bp, Homo sapiens
agttggttagagcgcacctttgataagggtgaggtcggcagttcgaatctgccgagacccaccaatcttgtgcgggaaaagcctgtagaaatacggggccatagctcagctgggagagcgcctgccttgcacgcaggaggtcaacggttcgatcccgtttggctccaccatttacgttgtgatggttgttggctgtagttgcttctgcgttagagtttagaaatgagcattccatcatgcgatggtgaatgttgatttctagtctttgattagatcgttctttacaaatttgggtatgtgatagaaagatagactgacc

SEQ ID NO: 722855 - DNA, 414 bp, Homo sapiens
cattctcttgcttgcatccttgctgttatagggcatctcctccggctcctgctcttgggttgcatggtgccacatctgtgcagtaggtttaggagaagctgtgatgccttctgactgcagcagtcctgacaaagcactttgtgaacccctccgggacataagggcatcaaactaggaacaaaaacacagtcttgactgtgatttggtgattttaccacatacaaggcccgaaagccaattgaagacgagaaaagaagacaaatctcttgccagcaggagtaagattgtacaggagtctgagtatacatcagggcaagccaagagacagggacaaacagagagaaaaggttcatgcaattatgaatataacctggagggggctttggaattagattacaacagtaacagagagtt

SEQ ID NO: 722856 - DNA, 335 bp, Homo sapiens
tgctacctcagggacaaagtggtcgtggggactctgttatggaacatctataaccgaataccaattgcaaggaagatcattatggacggtgagcagcatgaagatatcaatgatgtagccaagcttgtcaacactcatgaagaatgaagccccactgtggaattggcaaacgcagtacgtctcctgagaggaggttgaatggataaaggagcatcttctttttcagcagactgtctctgtgtatgagtgtgaataatcaagtcctttgtgaatattcacaaatgtgtaggtaaattgttaatgttgacattgtgaaataaattatgcttgttcta

SEQ ID NO: 722857 - DNA, 674 bp, Homo sapiens
  misc_feature (500)..(500): n is a, c, g, or t
  misc_feature (503)..(504): n is a, c, g, or t
  misc_feature (510)..(510): n is a, c, g, or t
  misc_feature (514)..(514): n is a, c, g, or t
  misc_feature (636)..(636): n is a, c, g, or t
  misc_feature (638)..(638): n is a, c, g, or t
  misc_feature (642)..(643): n is a, c, g, or t
  misc_feature (645)..(645): n is a, c, g, or t
agccaatcaaatctatgtagtaccttctgatatattattagagaattttaaaatatcaatgtaataataggaagcacatataatttcatagctgaaattatataggtgcaatttttagctgtcaaagtggtaataatcaacatcaataaaactacaaggaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggagttcccgtcgtggcgcagtggttaacgaatccgactaggaaccatgaggttgcgggttcggtccctgcccttgctcagtgggttaacgatccggcgttgccgtgagctgtggtgtaggttgcagacgctcggatcccgcgttgctgtggctctggcgtaggccgtggcagatacagcttcgattcgacccctagcctgggaacctncanntgccangggnacatgatgtaaaagacatctatataaagtactaattatagaactgtgtggggagttcccatcgtggcgcagtggttaacgaatccgactaggaaccatgaggttgcgggttcgtcccccgcntnatcnntnggataaggatctggcattgttatgagctg

SEQ ID NO: 722858 - DNA, 917 bp, Homo sapiens
agccaatcaaatctatgtagtaccttctgatatattattagagaattttaaaatatcaatgtaataataggaagcacatataatttcatagctgaaattatataggtgcaatttttagctgtcaaagtggtaataatcaacatcaataaaactacaaggaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggagttcccgtcgtggcgcagtggttaacgaatccgactaggaaccatgaggttgcgggttcggtccctgcccttgctcagtgggttaacgatccggcgttgccgtgagctgtggtgtaggttgcagacgtccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722859 - DNA, 312 bp, Homo sapiens
gtggaaccgtaatcacaggtcgtcgtaggtactcatataacgtggaacatatgaggtcggtcctttggggtctggctcaccaacttagcaggttttcaaggttggttcatgtcgtagccggtttcagaatctcattccttacttttttgtttgggagacggggtctggctcggccacccaggcgggaggaggtgcaagggtgtgatcagggctcacggcagtctcaaactccggggctctagtgatatttcttcctcagcctccgtgagttagctgggactacagtggtgtgccacgacatgtgggtgataa

SEQ ID NO: 722860 - DNA, 227 bp, Homo sapiens
cggacagagtcatgtgatactttttgattataaccagtgtagcagggtgaagtggttatctcatcatggctttgattttcatctccctgatggctaatgatgtttaacatcttttcatgtgcctcttggcaattttatgctgtctctggagcaatgtctgttcagatcctttgcccatttttaaataggattatttgtccttttattgtattgtgagagttctgtgt

SEQ ID NO: 722861 - DNA, 147 bp, Homo sapiens
  misc_feature (78)..(78): n is a, c, g, or t
gaaatcctgcgaagaaaaaaacttctgatgtaataaatatgattatctcttatcgaatgcctttttggacatgaagtntgtggtggccttggtatgtactttctcgttttacatcactccatcattggtatatggttagtgtgtagg

SEQ ID NO: 722862 - DNA, 652 bp, Homo sapiens
gcttgatccagagtctgtctgaattaaatccctgcccctcacctcatttcatggtttgttattcctccgtgccattaagaaacaccctccaggagttcctgtcgtggcgcagtggttaacgaatccaactaggaaccatgagcgttgtgggtttggtccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722863 - DNA, 1058 bp, Homo sapiens
  misc_feature (224)..(224): n is a, c, g, or t
  misc_feature (243)..(244): n is a, c, g, or t
  misc_feature (248)..(248): n is a, c, g, or t
  misc_feature (468)..(468): n is a, c, g, or t
  misc_feature (480)..(481): n is a, c, g, or t
  misc_feature (492)..(492): n is a, c, g, or t
  misc_feature (502)..(502): n is a, c, g, or t
  misc_feature (507)..(507): n is a, c, g, or t
  misc_feature (515)..(515): n is a, c, g, or t
  misc_feature (518)..(519): n is a, c, g, or t
  misc_feature (541)..(541): n is a, c, g, or t
  misc_feature (555)..(556): n is a, c, g, or t
  misc_feature (559)..(560): n is a, c, g, or t
  misc_feature (577)..(577): n is a, c, g, or t
  misc_feature (588)..(589): n is a, c, g, or t
  misc_feature (594)..(594): n is a, c, g, or t
  misc_feature (601)..(601): n is a, c, g, or t
  misc_feature (617)..(617): n is a, c, g, or t
  misc_feature (634)..(634): n is a, c, g, or t
  misc_feature (641)..(641): n is a, c, g, or t
  misc_feature (653)..(653): n is a, c, g, or t
  misc_feature (656)..(657): n is a, c, g, or t
  misc_feature (673)..(673): n is a, c, g, or t
  misc_feature (676)..(676): n is a, c, g, or t
  misc_feature (678)..(679): n is a, c, g, or t
  misc_feature (684)..(684): n is a, c, g, or t
  misc_feature (688)..(688): n is a, c, g, or t
  misc_feature (691)..(691): n is a, c, g, or t
  misc_feature (721)..(721): n is a, c, g, or t
  misc_feature (726)..(727): n is a, c, g, or t
  misc_feature (730)..(730): n is a, c, g, or t
  misc_feature (732)..(732): n is a, c, g, or t
  misc_feature (744)..(744): n is a, c, g, or t
  misc_feature (753)..(753): n is a, c, g, or t
  misc_feature (760)..(760): n is a, c, g, or t
  misc_feature (780)..(780): n is a, c, g, or t
  misc_feature (790)..(790): n is a, c, g, or t
  misc_feature (795)..(795): n is a, c, g, or t
  misc_feature (797)..(797): n is a, c, g, or t
  misc_feature (800)..(800): n is a, c, g, or t
  misc_feature (829)..(829): n is a, c, g, or t
  misc_feature (854)..(854): n is a, c, g, or t
  misc_feature (1043)..(1043): n is a, c, g, or t
ggctcttttaaatgaccccaggcgtcgtgtattgaatcctagactcacgtccgtctcgccggcgcccgagccagtccgcgcgcaccgcgtctgcgtccccgaaagccccgcccgcaagggctgccctgcctacctggtctccgacgtgctcgtctggagggcggtgcgaggggccgagccgacgagatgttcttgctgcctcttccggctgcggggcgagtagncgtccgacgtctggccgtnnacgnttcgggatccggagtcttccacgcagacatgacgaagggccttgttttaggaatctattccaaagaaaaagaagatgatgtccacagtcacaagtgcaggagagaattttgataaattgttagctggaaagctgagagagactttgaacatatctggaccacctctgaaggcagggaagactcgaaccttttattgggcttgcatcaggaccttccccangccgtggtgccnngttggccctcnggcaaaacanggcangcctggantcnncgaacacggaaaacctggcctnatggcaaaaaaaanntcnnagctgctgttgccccgnggtgccggccnnttcanaacctgnggctctcgtctgtggnggtggatccctgtgggnacgctcnggctgctgcggnggnngcggtgcttggtctcnctnanncggtngccnaangcaaaaaaaaaaaatggctgtgtcggcaangctcnntgnangtggggatccgnaggcctggncaaaagnagtcctgtttgcttctgggncaaacttggnccgcnanttnatgaaaacgcacgcaaataaaataacgcnaacacaatttgccgaaataattganagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggantacctttgacagtgg

SEQ ID NO: 722864 - DNA, 329 bp, Homo sapiens
gatggatcttcatccgaagaggtgtggtccctcgcaaaggagtagatccggatgaatgagcgaagctctatctcacatatgagctaacacaacgctgaccctaactagagaggaggtggacgagtatatatagtctagggccacgaatgggtaagttggggatatcctctctgcgtcatcgaaaccctatacaagtagaccactacagccatttatttggggggccttcttatattgctttccgcagggttcaccgacggaagcaatagggtttcgatgagggtttgatgacagggtttgatgaaaggtttgatgacagggtttgatga

SEQ ID NO: 722865 - DNA, 485 bp, Homo sapiens
agccaatcaaatctatgtagtaccttctgatatattattagagaattttaaaatatcaatgtaataataggaagcacatataatttcatagctgaaattatataggtgcaatttttagctgtcaaagtggtaataatcaacatcaataaaactacaaggaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggagttcccgtcgtggcgcagtggttaacgaatccgactaggaaccatgaggttgcgggttcggtccctgcccttgctcagtgggttaacgatccggcgttgccgtgagctgtggtgtaggttgcagacgacggctcggatcccgagttgctagctagctatggcgtatggccactggctacagctccgattca

SEQ ID NO: 722866 - DNA, 643 bp, Homo sapiens
  misc_feature (74)..(74): n is a, c, g, or t
  misc_feature (79)..(79): n is a, c, g, or t
atatgtgacacatgttccacataccacataccagcaaatggtttctttttctttccttttcttttttaaaaganttttnaggagttcccgtcgtggcgcagtggttaacgaatccgactaggaaccatgaggttgcgggttcggtcctccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722867 - DNA, 186 bp, Homo sapiens
cgaggatctcaagctccaacaagaaaatcgcagatgtatttaacgcatctgagaataaatacaaagattgtaaagcaattggcttgtctaagtaagtctaaatatctgctcaaggtattaaattgaattaggaattcaatcctcttatttaaagggatgtattgtggcttctttgcagcattcaca

SEQ ID NO: 722868 - DNA, 178 bp, Homo sapiens
tgtgatgtgactctgagctgtcgccatataagtggaatgactgagagtcgggtacaattgctcacgcttgtaattccagcactttgggaggccgaggcaggcggatcacctcagatcgggagttcaagaccagcctgaccaacatggagaaaccctgtctctcctaaaaatacaaaaa

SEQ ID NO: 722869 - DNA, 242 bp, Homo sapiens
tggtctctacatggtatcatcctccaaaagggaacgcggtttcatttggaacagaatggtctatgccacaggttacacacatttcttgaattaaccacatcctttcttccatttcatgacgctctttataaatggactcggccaggtggctggattacaaagataagaaataaaggggccaggcgtagtgggctaacaccggtaatcccagcactggggctcgtgcgggggtaccgagctcg

SEQ ID NO: 722870 - DNA, 709 bp, Homo sapiens
tttttttataattattttattttttttgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctctagtatttgcttgtcatcttggtgcaaccagaaatccacatgtggaaatggtgtccaggagtacggtcctatacgaagttgttctgtctctgcatcataaatgctaatcattggtcctcctgctaaagttcgcgcagcacgaagctgctcctccggaccccgatcttgaaaggatgctctgtaaatctctgcagtcttaatgttgacagcaatgccatatattaccggaaagtgggttttcgttttcttcccggtcatttaattctgtcacacataatgtcactaagtgaatgtcatcttcttgcctgtcaaattccctaag

SEQ ID NO: 722871 - DNA, 192 bp, Homo sapiens
ttaaaaacactagtcaggagcacgtggtacatgtctgtagtcctagctactcgggagagctgacgtgggaggatcacttgagccccagaagttgaagctacagtgaactatgatcacaccctgtactcccagcctaaagtgacagagtgaaacccctgtctctaaacagaaagttggttgggcgtacgggga

SEQ ID NO: 722872 - DNA, 148 bp, Homo sapiens
actatgaacctgctgacaggagagacatgaagcggatccagacatgatcacgagtggctgaggaatatggtgcctgtggaggtgatctcccattgtcaccccaacatcaccatcaacatcgtggacgaccacacgctgtgtataacgg

SEQ ID NO: 722873 - DNA, 801 bp, Homo sapiens
tttttttataattattttattttttttgcctttgccaaaataaggttttattttgaaagtcatttgaaaaacactgaggaaggaaggagaagacctaagacccaatggatgtaggttccaaatttggattcttgctggccccaccaatggtctctgtcaggccaagaaggttctgctttctttggtaattcctatttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctctagtatttgcttgtcatcttggtgcaaccagaaatccacatgtggaaatggtgtccaggagtacggtcctatacgaagttgttctgtctctgcatcataaatgctaatcattggtcctcctgctaaagctcacgcggcacgcagctgctcctctggacctcgatcttgaaaggaggctctgtaggccaggcacggtggcttatgcctgtaatctcagcattttgggaggctgaggtgggcagatcacttgaggtcaggagtttgagaccagcctggccaacatggtgaaacgctgtctctactaaaaatataaaaattagccaggtgtggcagtgggcgcctgtaatcccagctacttgggaggctgaggcaggagaatggcgtgaacccagggggcagagcttgcagcaagccgagat

SEQ ID NO: 722874 - DNA, 331 bp, Homo sapiens
ggattcattgctatggctgaaggcagcgagagtggagagacctagtagatggctgtgggtccactgagagcatccactagtaaaagccaatacaagctcgcacctacccctcaggatgggctccaaaaccttctagcatgtctattgctaatgataacccctagcagagaataattggttagaattagggggtaagggaacaagccagaatatggttatcagtacaagctaatgacacatggcacgcactgaatcatgcacctaggagagtgactgctggagagctggaacccagttgcaccaagaatgagagttgggatctccaagaaag

SEQ ID NO: 722875 - DNA, 178 bp, Homo sapiens
atctgatctgatgtactagtagcgacccgcagcagttatcggaaggaatgatagaggttgggcgaaagatctaactatctcaactttaatggtaagagccggtcgtgcgtgagcgggcgtgatgagtgctagtgggcattttggtagcgcaactgtacgggggggtacgagctgaatc

SEQ ID NO: 722876 - DNA, 397 bp, Homo sapiens
catattgcctaagagggagtggttgttgagggttatgagagtattggtccgaccggaccaagtggaaagattctctagtatttgcttgtcatcttggtgcaaccagaaatccacatgtggaaatggtgtccaggagtacggtcctatacgaagttgttctgtctctgcatcataaatgctaatcattggtcctcctgctaaagttcgcgcagcacgaagctgctcctccggaccccgatcttgaaaggatgctctgtaaatctctgcagtcttaatgttgacagcaatgccatatattaccggaaagtgggttttcgttttcttcccggtcatttaattctgtcacacataatgtcactaagtgaatgtcatcttcttgcctgtcaaattccctaag

SEQ ID NO: 722877 - DNA, 2430 bp, Homo sapiens
  misc_feature (39)..(39): n is a, c, g, or t
aagctgagggcacgtgtttgcggttcagccctttgatgnccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgtta

SEQ ID NO: 722878 - DNA, 190 bp, Homo sapiens
acgccagaggatcacttctgagtactgtggactacaggcgcacgcacatgcccagctaatttttgtattttcagtagagatggggtttcaccagtgttgaccatggatggtctcctacctccttgacctcgatgatcctgcctgcctctggcctcccgaaagtgctgcgggggtacctgagctctgaatt

SEQ ID NO: 722879 - DNA, 452 bp, Homo sapiens
gaagtaagataaaactaccatatgaaccagcaatctcactactgagtattcttccataaggaaaggaaatcagtgggatcctgcaaccccatgttgactgcagcactattcacaatagcaaagatatggaaccaacctaagtgtctcccaacagatgaatgaataaagaaaacgtggtatatatgcacaatgaaatattattcagccataaaaaaagcaatgaaatcttgcatccgcaacaacatgaatggaattggaggtcattttgtcaagtgaaatcagccaggcacagaaagtcaaataccctatgttctcatatacgtgagacgttgatgtcaaggaggtaccagagttcgaatgatgattaccagagctgagaagggtcacggtatgatagggaaataacgggagagggtcagttaacggctacaaacaacaagtcagatagaatg

SEQ ID NO: 722880 - DNA, 2288 bp, Homo sapiens
  misc_feature (39)..(39): n is a, c, g, or t
aagctgagggcacgtgtttgcggttcagccctttgatgnccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgtta

SEQ ID NO: 722881 - DNA, 142 bp, Homo sapiens
agtgtaaactaccggtaaaagtcaaaataggaatggcaaagactcatatcaacattgtcgtcattcgacacgtagaatcgggcaagtccaccactactggccatctgagctataaatacggtggcatcgacatagtatcaat

SEQ ID NO: 722882 - DNA, 2488 bp, Homo sapiens
  misc_feature (39)..(39): n is a, c, g, or t
aagctgagggcacgtgtttgcggttcagccctttgatgnccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaaaaaaaaaaagaccactcccaacaactctactacaagaccaaccacacgacaggcgg

SEQ ID NO: 722883 - DNA, 464 bp, Homo sapiens
tacaagctttgtgtcatcaagcattaagctaagtagattacaacgcaacacactgggaaaattctacgtggcagctcaaagttcggcccaatcttgcactaattcatattcaacatctgctaactgcaaataatattatctaatcgatctttatatggattagtcgagcgtggtgaaggcagatagttcagaattaactctggcacatatataaatctctccagaggtataaggcagctactgggtttataaaataaaactgggaaagccttatttttgtggataaacggttaatccttgacacaagtgataacttgcaacaatcctgctccctgccctcaggttatgaaactgtccatctgggcacaaatcaggtaaacaggcttaggtctcacttaaaataagtaacacaagtgtcaaaagtgtattctgtataccactcaaagcagctctgtcttttccag

SEQ ID NO: 722884 - DNA, 124 bp, Homo sapiens
agaagctgagttcatgagggttgctccagttctgatccgagagatcaccaggctgggttcaccatggagggcgatcttcctaagcagtttacacttgccggggtggtacatacaagagcccgtt

SEQ ID NO: 722885 - DNA, 312 bp, Homo sapiens
ctccagcccttgtttttgccagggtaaacacctctgtttgccccactgtcctggggtcgcttttgggaggcacaggcatgggtgtgtttggcctcattttgtatcagtccagtgtgttcctgtcatagtttgtgtctcccagggaggcccatggtaggggcctcccaggggccattggggagcacagggccaggctggggtgaggaaagctcccctgttttttgtttaattgatgagcctgggaaaggagtgtgttttgcctgcccgttacagtggagggttccgtgtccataaaacgttttttaactggga

SEQ ID NO: 722886 - DNA, 2376 bp, Homo sapiens
  misc_feature (39)..(39): n is a, c, g, or t
aagctgagggcacgtgtttgcggttcagccctttgatgnccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgcccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgtta

SEQ ID NO: 722887 - DNA, 104 bp, Homo sapiens
ctttcttcctgggcccccctccgggtttttgggggggtttttttttttgtgcgttcccctggggttggggggccctgcgcgccatgtggaaaatagggaataca

SEQ ID NO: 722888 - DNA, 220 bp, Homo sapiens
tataggcgctaggtgccgcagatcgctccagtgccttatgggcgacggcctcttgaaggcagcgaccattctgatcacagacagcgggcggcgcttgcaaattggcggtgaagttagccgatgcggcgttgagtgctacctcgacaacccaatagggaacagagacgaagcgtgcaatctcgcgatcgcgatcaatgaccagtttcaacgttgggcgtct

SEQ ID NO: 722889 - DNA, 910 bp, Homo sapiens
  misc_feature (908)..(908): n is a, c, g, or t
ggccatggtctgacattcttgtaaatcttaatgtctagcttatagaagccagctagattcttatatctgctttacgtcagtctgtgtgacatgtgttggttgaagtgtatgaaaacaatttgcctcacacaggtagctggaaaagggaggagtattttaatagtatttaaaaataatgtgatattctcatttgatactatgccaaaatttgacaaatgatactgtttcttaaagataatatggaaatcaaaacatataaatgaacttttagtacttgcattacaaccatttgttctgtcgtgcaatttaaatagataatttccccatgcatgattttgtgataacacatgcattcagtcattgtggaaacatacctggttcactggatggctacagatcctccaaaatattgacatatctcatcatatatatattttccattatattcatgaatatcaccaccaatcccatgagaaatatttctcaggtatgagaagccggccaggttcaagaatagcaacattacaagttttcacaaattctatttctgttaaaaccttgattgtctccttggggacaaacgacgaatggtccttttggacgtgacaggctaaacttggtcttaggagaacagtctgacgattccaaggtcggaatacagaggtggaatccttcctttcaataaaatggtttcatgaaaaatgagttacccccgacacacagttgcaaggtgtttccctacaacaccatggcttgtgcgcgatgaagggctatgcactccatctcttggcacagtgggccataccataaacgaagaggtcagaacataggaaggtacggagaggagagaagtgggaaaggacacttttgatccacatcttaaacctcggtgtcttctgtctcttggngt

SEQ ID NO: 722890 - DNA, 2232 bp, Homo sapiens
  misc_feature (39)..(39): n is a, c, g, or t
aagctgagggcacgtgtttgcggttcagccctttgatgnccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgtta

SEQ ID NO: 722891 - DNA, 2314 bp, Homo sapiens
  misc_feature (39)..(39): n is a, c, g, or t
aagctgagggcacgtgtttgcggttcagccctttgatgnccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaaaaaaaaaaagaccactcccaacaactctactacaagaccaaccacacgacaggcgg

SEQ ID NO: 722892 - DNA, 1886 bp, Homo sapiens
  misc_feature (39)..(39): n is a, c, g, or t
aagctgagggcacgtgtttgcggttcagccctttgatgnccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaaccaggatagaaaaagctccatgagcagagcagcccatgtaacctttattatggctcaggccttgcaagaagggctatagagtgtggagtgacaaagccaggatttaggt

SEQ ID NO: 722893 - DNA, 311 bp, Homo sapiens
gacaacctagggtcagttttgcagcgtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 722894 - DNA, 446 bp, Homo sapiens
ggatccaacaaagaggtgacttgcctaagttctaggcttctgcagtaaatttttttttattttttaatttctaatttttgtgggtacatagtaggtgtacatatttatggggtgtatgagatgttttgatacaggcatgcaatgtaaaataataaacttatggaaaatggagtaaccatcccctcaagcacatatcctttgtgtaacaaacaatccaattatactctgttattttaaaatgtacaattacgttttattgattatagtcaccttgttgtgctatcagacactaggccttattcattcattctaactattttttgtacccattatccctccccaactccccttcactacctttcccagtcattggtaaccatctttctactccctatctccataggttcaattgttttgatttttagatcccccaaataaatgaaacc

SEQ ID NO: 722895 - DNA, 498 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 722896 - DNA, 323 bp, Homo sapiens
tacaagcacaagatacgagaccctggtgcttcagggcagacaagccccagcggcgagcatgtcaggagaggcccgaggacctaaacctgcccaatgccgatgatcaccaggatcatcaaggaggcgctacccgtgacaggtgtcaacatctccaagtgaggccctggagctgccatctccctgctgccgccagctgtcttcgtgctgtacgccacatccatgtgactaacaaccttttgcacatgaaatggaaatgcggaagacgctgaatgccatgtgatgtgctctcatgccatgtgaagagatggagttccagcggttcg

SEQ ID NO: 722897 - DNA, 391 bp, Homo sapiens
  misc_feature (232)..(232): n is a, c, g, or t
aagatgctaacgcatcggtatgtgaagacgggtggggagcatccggcagcgagggtagtgcccaaagccacagtgcacgcttcctgaagcagagtgcagttgggggctgagtcccgaagtttgtccttggttccagactgggcagcactactcgtgtcagtggtgagacgactacgaccagtacgcgctgtgtacagccaggcagcaaggccctggggaggattccgcatgncaccctctacagtcgaacccagacccccaggtctgagtaaaaggagaaattcaccgccttctgcaaggccagggcttcacagaggataccattgtcttcctgccccaaaccgataagtgcatgagggaacaataggactccccagggctgaagctggga

SEQ ID NO: 722898 - DNA, 464 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 722899 - DNA, 531 bp, Homo sapiens
tcctgtggaggtgagtgaagggtctgctgctgaaatttgggggcaaataaccggagtaggtttgttcctgtgccttggcgagtcgccggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 722900 - DNA, 646 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaacaaataactggccggcggttacaacgtcgggactggaaaaaccctggcgttaccacaattaaaggccttgcagaaaagtccccttgcgaaagcggtggaaaagggaggcccggacggacggcctttcccgtgggcgaccgg

SEQ ID NO: 722901 - DNA, 441 bp, Homo sapiens
tcgtgccgaattcggcacgagctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 722902 - DNA, 638 bp, Homo sapiens
  misc_feature (72)..(72): n is a, c, g, or t
ctggaccgacatcataccacgacacactttgagaacaggtacagcagatgtacaaatgactaaagatctggncttggagttcccgtcgtggcgcagtggttaacgaatccgactaggaaccatgaggttgcgggttcggtcctccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722903 - DNA, 841 bp, Homo sapiens
  misc_feature (269)..(269): n is a, c, g, or t
ggggtgggcgctcgggaattcgcccattatggccgggctgccaagtcagttggataggtgcggccccatggtgggcgggcgaggactgggagcgctgaaaccgcggaagggggtgaacactatgccccactcatcatctcaatcgcaactatacttatgtcgtcgtgttgctgtgatgcgtttggcagacgctctctacaggggatcaagagaagggggagtggtcgacgcaggggagcagttatgttattaaataacaaataaactanagccgccacacaacccctaaaacccaacaacacgagacgatcgtggtgttgttctgtggggcggctcttctagagcgctcaacggatcagcagatgcagctgcgatttcaccaatttaaatgggaatagtgttctaactcagacgaagggcgacaaggacgatgactagctcagaattttatataatgtgtgcgatggggtggcgggacgccgtcgtctccgaccaagcgcggacgagcgcttccgtgctgtcctcgctgctgcgcgccacgcctcctgtagcggcgtgatgtaagccggccgacgcacccagccacccccgagtgccgcgtgccgacgagttgtatgtcggtacgggacaccgctcacacgccctatgtccgctttatcaatacacacctcacgacgtatgtaaccatatacataaacagaacacgctgagcccctgctcagtgcgcggccaggacggcatattcctgatacccacactgattcatcatataaacggccacccctttaatattcactgagagtgggtttgagggggcgcgaacggcgagcggtggagagag

SEQ ID NO: 722904 - DNA, 610 bp, Homo sapiens
  misc_feature (23)..(24): n is a, c, g, or t
  misc_feature (31)..(31): n is a, c, g, or t
gctattgaatgtggcttatatcnngtgcgancgagtttccgaggattgtttttctggcgtttggagaagatgcctaaattgagggcggagtcgaaagatgtttaatcccacaaggccacgcggcggggcctcgtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 722905 - DNA, 697 bp, Homo sapiens
tgttagaggatcccggaacacaaaagcggctgagtttacatgttagaggctatcattaagaacacagtcctggagttcccgtcgtggcgcagtggttaacgaatccgactaggaaccatgaggttgcgggttcggtccctgcccttgctcagtgggttaacgatccggcgttgccgtgagctgtggtgtaggttgcagacgtccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722906 - DNA, 329 bp, Homo sapiens
gaggtacttttccttttaattgtgggggatattccagatgttctttttctcttctcttctcttctcttgtcgtttctttgttgagacaggggggtgttctgtcacccaggctggagagcagaggcacgatcatggctcactgcagcctcaactttccaggctgaagtgatcctcttgtttcagcttcctgaatagctgggactacaagcatgagttcctacacccggctaatttttgtatttttagtagagacagggtttcaccatgttggccagactgggctcaaactcctggcctcaagtgatctgcccactttggtgctgggatta

SEQ ID NO: 722907 - DNA, 500 bp, Homo sapiens
  misc_feature (25)..(25): n is a, c, g, or t
ggaccacttaggctagtacgagctnggtgtaatcggtcgaccttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 722908 - DNA, 814 bp, Homo sapiens
acgaaccgaggcgttacccggtaagagcggctgtgtgtttatacacatatcatacacacacacacacacatacacacacacacacacatctcctgaaccagaagaatatttatctggggaaacaacattctttctagaggtctgtgagtttcctttatcactcaagatttcaaaccttggagttatcctagaatttgccctttctctggcaaggtcctgttgattcactcttcatagtttttattggagggcttcgggagttcctgttgtggcatagctgaaatgaatccgaccaggaaccatgaggttgcaggtttgtccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722909 - DNA, 489 bp, Homo sapiens
ctataatgaacagcgatagtattattccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 722910 - DNA, 609 bp, Homo sapiens
cccggttgaattagattctctcgaggaacattaagataagaacaagtcaggagtctcgtcgtggcgcagtggttaacgaatccaactaggaaccatgagcgttgtgggtttggtccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722911 - DNA, 633 bp, Homo sapiens
ggttcttacagtagtcggcgtagggccttagattatttactgtactcctgtaagaatttagcagcaaatcatgtggatatcagaccaaatcatacaatttatatcaacaatatgaatgacaaaattaaacaagtgaagaatttgaagagatccctcatatgcccatgttttcgtcagtttggtcatgtggtggcacatttgtggctttaaagaccatgaagatgagggtggcaggcctttgtcatatttcaatggacacttgggctcatccacaaatgcctatgcagacatgctacaaggattatccattttatggtaaaccaaatgcgaatacagtatgcaaaatacagattcggatataatatcaaaaatgcgtggaactttatgctgacaaagaacaagaattaaaaaaaaaaaaaaatacggagagcacaatcacacgccggggggcgcgacacaaaacaacaaggacccatataaacggcgcaaatgatgacaaatagaagaaccaacgagaaccacacaaacatataaccaacgtggcacaaagacgcggacaccccaaataagacagccaaaaaaaaaaacaatacgcccaggtaccatggcataatgaaaacgaacacaaacaaa

SEQ ID NO: 722912 - DNA, 475 bp, Homo sapiens
tcgtgccgaattcggcacgagctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 722913 - DNA, 669 bp, Homo sapiens
gagataccgtcactcagtggtccgcagagtgtcctggcggtccctacccttcaccactccactgctctctcacttgacagtctcctaaacacaaatttctcttcttggagttcccgtcgtggcgcagtggttaacgaatccgactaggaaccatgaggttgcgggttcggtcctccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722914 - DNA, 188 bp, Homo sapiens
  misc_feature (137)..(138): n is a, c, g, or t
aaaggggggggggggaaaaaaaatcccccccccgggggggggggggggggaggaatttccccccccccccccccccccccccgggtttttttggggggggggtttttccccctttttttttggttttcccccacaannggggggggggggcccccccacctgtttttttttttttttttttggggggg

SEQ ID NO: 722915 - DNA, 497 bp, Homo sapiens
tcctgtggaggtgagtgaagggtctgctgctgaaatttgggggcaaataaccggagtaggtttgttcctgtgccttggcgagtcgccggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 722916 - DNA, 666 bp, Homo sapiens
acacggaacacttcatggcctctttcaaattcatcttgcatgtacatcgtttcttccctttagtctaagagtgggatctattctcttaagaaatcagcaccatggagttcccgtcgtggcgcagtggttaacgaatccgactaggaaccatgaggttgcgggttcggtcctccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722917 - DNA, 117 bp, Homo sapiens
cgatcgtacaactaacggtcatgacagcctcaactccattcattctccacagcgcctcttcatgacgcactgcatgctcaatcctctgtgctgggaaggtgcatgataggagggggg

SEQ ID NO: 722918 - DNA, 679 bp, Homo sapiens
atcaaagtatgtttattgaaacgataagttcagtgtgttggctctaatcactgttaaaacatttaatactatttggtaacattgaagatgttcaagtctcttcaagaagttaatcaggagttcccgtcgtggcgcagtggttaacgaatccgactaggaaccatgaggttgcgggttcggtcctccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722919 - DNA, 443 bp, Homo sapiens
actaggctgcggaagacgggtggatcccctgagggcaggagttcgagaccagcctgaccaacatggagaaatccggtctccactaaaaatacaaaattagccaggggtggtggcacatgcctgaaatcccggctactcgggaggctgaggcaggagaattgcttgaacctgggaggtggaggttgcggtgaggcaggatcacgccactgcactctagcctgggcaataagagtgaaactctgtctcaaaaaaaaaaaaaaggaaaggaaaaattttttggggggtttcattaaaggccggttggctgttggggggttttttcctcggtttggaaatatgggggagccattttatggaccttggaatagctaagcgcttggttgtcggggcctccttaacaattcccccgtttttcaaaagcttagggacccggcctagaatcc

SEQ ID NO: 722920 - DNA, 314 bp, Homo sapiens
ggcccgagaggggcctgtaggacggtgggatccgtagtagctagcagacgcactctcaggtgcttatgctcttcctgctggatgaggaggtggtggtgttcttaatggtggaactgccgcctccaacagagctgaggccaccccccatgggctcctgccactgctggaactgaagccacctccgacgcccagaccactgccataggagtagctgcttcctccaccctggcctgagtcagtgacgacaccactggcaccgccatagcccctggagacggtggacagcaccatagagatgttgcctttcggagaag

SEQ ID NO: 722921 - DNA, 1042 bp, Homo sapiens
tggcaggtaaccggaaccttaaatttatattatgtggaatgcttaatgcacagttaataggggctaaaggtggctagaaaaggggactactgaaataaataacggggaagacagtaatggagtcacatgtggattagggggggctgcaaaacagggaaaataggggcagatatagctacatacttatattcaaataccactgggaggcaagggtgtacgaggcaatggcgcagaattgtacagggtcaggattctagtggtctaacagccgtgccgacagcaaccggggtgctgggcccgtgtgtcaccgtggagccaagggtaagggcctgagcagcttgtcactctcgggaaagcccagggagtggggctgactgaccaggggccaataaagccctagataagggacaagggagctggacaaggtagcccagggaagcggaggccctaggagaatggcacatcgggatcccttaccgaggagacccctgccctcgaaaacacaccgtgggaaagacgctcatcacaaggctcaatacggagagtagaagggcgacggaggaacttgagggagccagaacacacctccacgaaccaaacgacacgggagggtaaatggggccagcaagaaactcgggagcatacaagggggcgcactctggtcgccaaaacaacccatcagcctggccctaatcacaaacaagcgcgcaagggggcacaatatacaaagggaatagaagaacctccgacgataacagtccccaacgaaaaccacccccacaaaagcacccccaaagatagaagggaccccccccacaagaggatgaccctcctccagcaaggcacacgccagaatgatgggcgaacaacacaacgcgaccaccgctcccaggagcaaacaccggccatacaggggagtgacggccatacagcccctaacagggcacatggtggaaaaatagaggagagcaaatgggagactggcacagcaccctgacactaccaagtaggaaaacagagacaacagggaagcactaggaag

SEQ ID NO: 722922 - DNA, 1381 bp, Homo sapiens
  misc_feature (288)..(288): n is a, c, g, or t
tatctggctgggctgggaaaggagactaaagtatctagttttaagtattaaaactacttttaattgatttatattggatactctctggataaatggcgggtgagttaaagaatagattggtgactcagttcctttatggaggttgggtggacctcaaaccatggtgttttatttcttaacccggactaacaggtaacttccaatatgggccactataaagataagggcgagggatatattcacataagggtgaacgcaggagaattttatcactatgggggtcaccangacgctaaaatctgggaaacacccactattgtggggatatggcaggctctcccacacacttcagagtcttaaaatatactcacacccgaacacttatatgggcgtaactatatatctttcctacaagttctccccccccctaagttctccactttgcgtgggcaaagtgagaaaccgagtgtttcttacaaatatcctctaaagatggtgttatcacatatccccttagagcggagaaaatattattccccctcacaaaacactcagagatgcacagaacagagtggccccaatattgcccacactctatctctaaaccgagggggtaacattacatcagcgcgggtcgtaaacatagcgccttaaaagggcccaggtgggcacaacacaccgtctcgaggctctaaacgggggacccgaggcccacaaggacagacaaatgcgtccgtacaagaggaaaaacaattccccccgagggacacaaggggcgtcccccccctccttagtatccacctccccctttgggtcgtttacccccacttcatctccaactttaaaccacaaccagtggggggccttaagaacataccacccactccttaaaaacagactccttcaacactcacaggggggagacgggggccaacacaatggtgggttgcgccccaatatacaccaacagggacacccacaacagcgcgctctttcgagacgtattaggggccccctcgaaacattgctagaaacttattccaaggcgtcacaaacccaccacgacgcggggacatacaaacaggggaggcaggagggcggccccccattccacgagcccccccacaatcgtcccccaccacattatacggacaaccagcggcgggaaaacaacgaacatcaacacaccacataccactacaagagagtacaacaaggggggggaagcaacaaaggccacgatacaacacaacagaccataagtaacccacaaccgcaggaccagagggacgtaacacaagaagaccccacacacaacaatactgaggcagagcaacacacacactcgcacgagcagcactaggcataacacaaccacaca

SEQ ID NO: 722923 - DNA, 263 bp, Homo sapiens
agatagctagtactcagtgctgtaggagaatacaaagaaattatctctctcctaccctggtggtggcacatcagacagatacccagagttgtctagcaaaggtaaaggtgttgataggcagctcccataatgaggtgttaaaagactataggaggaggagccagaagatgtgtgtttagggtcccagctccatcaggctttggctatgtgatacttggcaactcctgatcctgagttttctcaagtacagagtgaagctagaa

SEQ ID NO: 722924 - DNA, 588 bp, Homo sapiens
  misc_feature (59)..(59): n is a, c, g, or t
cacgccgatgggtagcataactaaactatatccaaatccctatttttattgctgatatntgttttacttaaaaatattacacctggtggcattccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722925 - DNA, 812 bp, Homo sapiens
gtatgagtttcctatcgctgtgtgaaaaattatgccaagttgaggagtgtaaatgacaatacccatagcagttgtgtagctcatgagtctggcacagtgtggctggattctctgctcagggtcttaaaggtctagacaaccataacgggtggtcaggacaacattccttcatggaggctctggggaagaatctgcttcctaagttcgttcaggtcgttggcggaattaccagttctgttgtgctaggctctcagacttgggaggtccctctctcacctcaagggttgacttgcatcattctgatggggccccctgccagcttcaaaccaggcctgcctgctcttgtctcatgcttcatatctctctcccgtgctcctgtagtaggggcatatgattagctcaagcccacggatctcttttcaggttcgatggtgcgatagaacataattgcgaggagtactgttgctcgatctcatcatatgcacgggtcctggagattagctcattgaaagtgggaggggcatttgtcaaattctgcctagccacgaggcaataacgtgactcagtctggcagtgtaggtggaattttcacgccagaaaggatgggcctagaaggcgtcatttcttttctccatggtgaaaggatggccctcgtgcttgaggttcaacttgtgtgtttacttgcgatgagtgaactacagaaataggtgtgacttccgtaaaggggtttgtctacattgtgaagttgtggttaatgaaagattgaattatgttgtgtatgggccttaataggaaatgcattatttggactg

SEQ ID NO: 722926 - DNA, 641 bp, Homo sapiens
  misc_feature (3)..(3): n is a, c, g, or t
  misc_feature (68)..(68): n is a, c, g, or t
  misc_feature (88)..(88): n is a, c, g, or t
  misc_feature (119)..(119): n is a, c, g, or t
  misc_feature (125)..(125): n is a, c, g, or t
  misc_feature (137)..(137): n is a, c, g, or t
  misc_feature (139)..(139): n is a, c, g, or t
  misc_feature (158)..(158): n is a, c, g, or t
  misc_feature (170)..(170): n is a, c, g, or t
  misc_feature (187)..(187): n is a, c, g, or t
  misc_feature (192)..(192): n is a, c, g, or t
  misc_feature (209)..(209): n is a, c, g, or t
  misc_feature (226)..(226): n is a, c, g, or t
  misc_feature (239)..(239): n is a, c, g, or t
  misc_feature (241)..(242): n is a, c, g, or t
  misc_feature (245)..(245): n is a, c, g, or t
  misc_feature (247)..(248): n is a, c, g, or t
  misc_feature (256)..(257): n is a, c, g, or t
  misc_feature (378)..(378): n is a, c, g, or t
ggnaccagttgtaggtggagggagtttagggctgaggctccgcgtggccctgtcgcttcgccttcatntgcaggtaccgccctttgcnttcctcaaagcgcttcttctcgtcctcggtntcgggnaccagctggggnanaggcagcgacctgccttcntggctcagcganacgtaggtgaagaaggnactgncggcccggtagcgcttntgagagctgtccacaanagggtcggggtcnannaananntcgatttnnatggacttattgttcgtgaaggtaatgcgtcccgagatggtgatgacgcagccttttttgattttgttatgaaaattaatggcgtccacggaagctgtgacgatgttggtcttgcagtggngtgaagaagatttaaggagacctcatccatgagcttcatggtcacacctccgtgcacaaagccgtgcagggtgcagtctgaaggccccaccaggtggatcaagctggactggctgtagctgacagtgttcggctctgggttgaggactggctggacgatgtccccgttcctccacttggtctccatgcgctccagcttctgggcttcataccgcttccggccctcctcctcctccccctgccgggaatacacaacaggaggca

SEQ ID NO: 722927 - DNA, 688 bp, Homo sapiens
  misc_feature (29)..(29): n is a, c, g, or t
taacagcggcgtagtacttctaaatattnggaattttaaaatttttcctttggaatacaaatgaatatatgcaaaattccttcatcttatgattcgaactattactaactcagtaaaactcttttccggagttcccgtcgtggcgcagtggttaacgaatccaactaggaaccatgagcgttgtgggtttggtccctgcccttgctcagtgggttaaggatccggcgttgccgtgagctgtggtgtaggttgcagacgcggctcggatcccgcgttgctgtggctctggcgtaggctggtggctacagctccgattcgacccctagcctgggaacctccatatgccgcgggagcggcccaagaaatagcaacaacaacaacaaaaaaacaaaaacaaaaagataaaaagtgcaaaaacaactttctagcatgtcacgctcagaccttcagcttcaacgttagatgagaggagtataagctttctgattagatggtctccactttcaaaggttaccatgtccttacttttccatgtgtacctgtaagatttttctgtcatctgtcaaaagtaaaggcaaaacagaaaaggaaaaaaagaattatccttcacttctcatcacagcagatccaagttaccaaggcttaccgaatctgctccatggcttccctcgtcagggtcctgggcggg

SEQ ID NO: 722928 - DNA, 160 bp, Homo sapiens
cgaggacagcgttctcactatgagtcatcagcgactaacgcttattttaattcaggcttaaaacacatcacaaacccaattacttgtatatgcagaacactgataacaaccctcacattaacatcagcacgcttgatatagaccaacttttcagggctca

SEQ ID NO: 722929 - DNA, 479 bp, Homo sapiens
  misc_feature (266)..(266): n is a, c, g, or t
ctgaaaggtaaatccttccgggggggatgctttcaccaaattaagacttttcctccttttagttcctggcgccagcccctaagtcaacttagcattttttgcatctcacttggcattagctaaaacctccattgtcagatttcaggtagtggccaaaaatgcaggtgcaaggaaccctttaacagttgcccagcatttcaggtcattttccctgccccctggatttgcaaacatttttcaagatcccatttgaattttttaggggntaaacccttgggccttttaaagggcaaaaatttatattttgcctgttaaaaaaaaaatgagcagggttagcttagttttttttttatgtagggtattaagattaactttgtccctgtttccctactcagcatgggaacaaaatgaaattccctttgtaggtagtgagaccaaatttatgatcccttaagttaacaataaaagtgtccctttta

SEQ ID NO: 722930 - DNA, 467 bp, Homo sapiens
  misc_feature (354)..(354): n is a, c, g, or t
  misc_feature (358)..(358): n is a, c, g, or t
  misc_feature (361)..(363): n is a, c, g, or t
  misc_feature (367)..(367): n is a, c, g, or t
  misc_feature (369)..(369): n is a, c, g, or t
ggatatttttcaataataaataccacagaactacatggttggtgattggttgaaccctcagatatggaggaaccggggatacaaagggccaactggggagttcccgtcgtggcgcagtggttaacgaatccgactaggaaccatgaggttgcgggttcggtccctgcccttgctcagtgggttaacgatccggcgttgccgtgagctgtggtgtaggttgcagacgttgctgtggctctggcgtaggctggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722931 - DNA, 1575 bp, Homo sapiens
gttatctgtaaaatcagacttaaaactacaaatatgtagacctgaaaggagcatagcaggcctatctagcttaagtctgattttacagataactatttgcattgagacaaagaaagataggcctgctatgctcctttcaggtctacatatttgtagttttaagtaggtttatgtataggctagaaatgattttcatagctgctacgtgtgtttcatatttacataatgcttgtaatttgaaaaatatataaacgcatgcatattactaattaattaatatggttacctagctcagaattcagcatttattcattcaacagtaatttcaagtgtccactctgtgtcagtacattaccatgtaatgctgaaagtgaaagaatttttaaacattactattcattcagtaaggcccccaagtgatggttttcaaattgtgcttccaagaatcctaagattttaggcatatttgaaatccttttgccacaaacttaacctatttaattgttttgattttttttttaagacgttgatgggagttgtgaggagtcttcctgtgttgcccaggccagcctcctgaactgaactcaaatgatccttccacctcagaatagctgggattataggtgtgcaccactgcacctggctagttgttttgattctaaatttagttttgttaaaatgaatcacatttgctttaaaaataatgatgttttcaaaatacagtgatataggccgggcacaatgactcatgcctgtaatcccagcgctttaggaagctgacgcaggaggatcacttcagcctaggagtttgagcctgggcaacaaagtgagaccctgcctatacaacagaattaaaaattagccaggcatggtggcatgtgcctgtggtcccagctacactggaggctgaggcaggaggatcccttgaacccaggaagttgaggctgcagtgagccgtgttcatgccactgcactgcagcctgggtgacagagcaagactctgtctcaaaaacagaacaaaaacaaaagcaaaatacaatgatacaggtaaaatatttcaaagccaactttagttactaagtgaaaaatgtgatgttaagcccagtacattaaagatgaaggaagatgttaatcaccaccaccacccctcctccccacataccttctctgaactggatcttttgaacgatatatatagggaactaaattagcaagaaaaaatgtaaagaaattaaagggtaatttgtgacttgacaagataaaagtagaaatgtttcagaaaaattttagggcatagggaatacagttgcattaaaattaccatttgaggtttcaaaattgttatttgcctaagctgtacatctgagctttctgattcagtgtgcgtggaaggggcccaggcatatatatttggacaaaactcacaggtatgtatacctctgaagaagaaccatggttgtacaatgaaatgtgttatcttgaggctattaagtttctttctcatcaatcatttgatctttgtgtctctgtaggtttttcaataaaatgggcttgacattaactctctgcctacat

SEQ ID NO: 722932 - DNA, 2031 bp, Homo sapiens
  misc_feature (2024)..(2024): n is a, c, g, or t
gttatctgtaaaatcagacttaaaactacaaatatgtagacctgaaaggagcatagcaggcctatctagcttaagtctgattttacagataactatttgcattgagacaaagaaagataggcctgctatgctcctttcaggtctacatatttgtagttttaagtaggtttatgtataggctagaaatgattttcatagctgctacgtgtgtttcatatttacataatgcttgtaatttgaaaaatatataaacgcatgcatattactaattaattaatatggttacctagctcagaattcagcatttattcattcaacagtaatttcaagtgtccactctgtgtcagtacattaccatgtaatgctgaaagtgaaagaatttttaaacattactattcattcagtaaggcccccaagtgatggttttcaaattgtgcttccaagaatcctaagattttaggcatatttgaaatccttttgccacaaacttaacctatttaattgttttgattttttttttaagacgttgatgggagttgtgaggagtcttcctgtgttgcccaggccagcctcctgaactgaactcaaatgatccttccacctcagaatagctgggattataggtgtgcaccactgcacctggctagttgttttgattctaaatttagttttgttaaaatgaatcacatttgctttaaaaataatgatgttttcaaaatacagtgatataggccgggcacaatgactcatgcctgtaatcccagcgctttaggaagctgacgcaggaggatcacttcagcctaggagtttgagcctgggcaacaaagtgagaccctgcctatacaacagaattaaaaattagccaggcatggtggcatgtgcctgtggtcccagctacactggaggctgaggcaggaggatcccttgaacccaggaagttgaggctgcagtgagccgtgttcatgccactgcactgcagcctgggtgacagagcaagactctgtctcaaaaacagaacaaaaacaaaagcaaaatacaatgatacaggtaaaatatttcaaagccaactttagttactaagtgaaaaatgtgatgttaagcccagtacattaaagatgaaggaagatgttaatcaccaccaccacccctcctccccacataccttctctgaactggatcttttgaacgatatatatagggaactaaattagcaagaaaaaatgtaaagaaattaaagggtaatttgtgacttgacaagataaaagtagaaatgtttcagaaaaattttagggcatagggaatacagttgcattaaaattaccatttgaggtttcaaaattgttatttgcctaagctgtacatctgagctttctgattcagtgtgcgtggaaggggcccaggcatatatatttggacaaaactcacaggtatgtatacctctgaagaagaaccatggttgtacaatgaaatgtgttatcttgaggctattaagtttctttctcatcaatcatttgatctttgtgtctctgtaggtttttcaataaaatgggcttgacattaactctctgcctacataagttggagttgtgggctctttcctccatctctcttcgtattacttatatactcctcttctgatttcaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgaaaaaaaaaaanctatata

SEQ ID NO: 722933 - DNA, 324 bp, Homo sapiens
accccgggcccctgcggggctgccacggtcagcacagaattcccaagaacaggcggctactcctgggggcagccaacattccagggagcctgtgtaacccgctccgtcctcagggcccagggaggctgtgggtgaggactgtgtgtgtgaggacaggagcggagacaggcctgcggccagcttccctatcccctccccagcgcccgggtacgagtctgtaaatcagcctgcgctgcatggcgtcttcacggggagaggcaggctcactcctcagctagttcattagctcacacgctggaaaaataaaaccaaacatcacacgtt

SEQ ID NO: 722934 - DNA, 596 bp, Homo sapiens
tgatccatccgcctcggcctcccaaagcatgggattacaggcgtgagccaccgcactgagccaaattctttaattctgatggaattacctgcagactaatgtaacacgcatgcttttctaggattgggaggggaattgttgttggtagatggcgtctagctatgttgcccaggccagccttgaattcctggcctcaagcaattcttacaccttagcttctcaaagtcctgggattacaggcatgagccaccatgcctggctgcaagttttaatttttgaaattgaggcatagcattatagggtcataacttaacttataaactggctttataaattagtacattttaaataggactaatgaagcctatattttcctccactagtatatttaaaggtataagacttgtgtatcccaaacactcagaatattaaataactaaagatcttattctaaaaggtgcattgagtgggtttttgaggcctaaaaattgtataccagtgctaattgggatataccaaactttttgtctcggagcaagcagttttggcgtgttcaggcgctctgcaaggatgcagggcagtgtctcatctatcaa

SEQ ID NO: 722935 - DNA, 560 bp, Homo sapiens
agcggaggcgctctggtgcttgccgaggacgcttccttcctcatatgcaccgatcttcccgatactgcctttggagcgcgctagattgctagccttggtgtgctccattggcctgcatagccccttacctgccgattgcatatagaactctcccttactgtctgtacatcgtcgtcgtcggagtcttcgcgatccgtccgtggcgctagtgtgatgcgccttcgtccgtctctaggagtacgttgtagttcagcttacggggccaagcgaatgaacgacaagaatcacgcgacttacgtagcagagtatgctaggaggtggtcaggttactagacgctagagtaagtatagcggagcgtaacaagatgccaacacctatcgcgccgatggctccctccattcctctccctccgccgaggcgcgaggttgcggcgcgcagcgtctgggcagtctcagcgtcagccgatctgccgcgggctcctgttgggcgattgcagccgagtccgttcctcgtctatgctgccgctcgctggtgaccgtctgcctggtcttcctcccgg

SEQ ID NO: 722936 - DNA, 1104 bp, Homo sapiens
ggactgtggagcgtagcatacgctgctctatgcgttagggcgggtctccagtagccttctctctcctgtgccaaatggcaactcttaaggaaaacactcattgcagccagttgcggaacgaagaggcaacagttccaaacaataagatcacgtgtagtgggtgtcaggacaacgtgtgggctatggcgtgtgctattcaggcacttctgggaaacgtctctggctgatgaactctgctcttgtggaatgtatcgggacagactacgcttaacaggacgaaatgatggatctgcagcactgggagactatattctcttcagacaccgtaaaacttgtgcgcaagagtcacgactcacttctgatgaccgccaacttctaagcatgtgtagctggctaacctgcatggcagatccctgttcaagccctaaagtaacgcgggccagcagcgtcagcgacctccaaacttcttaggttgctagcacagccaacactggtccaacatggtctcttctccaaaaaacttctccacttatcaatttccccttccacgcaaataccggatcaaaacgcttaacaaaaggcaagacgccctcgggaactcgcgacggatttcgaattacaccattaggcatggcggatacactcaccagaaactccccaatgcctggcatacccaaatttgaacatccgtaacccggcgataaactggcctttcaaaacccccatggtggacaaatagcacatttaacataggcttgtcgacaccttccaaccacctcatcacacataccaacacaccgggacccggattatgaaaccctcagagggacacaacagaagggcgggcaacttgccctaaaaaccatctctccaagggccacaaaatagatacccatctgcagccccctacacgcacacacctaaccaacaacgacaacccaacaccacacctaacaaactgggcgccccctcggcgaaccccaaaacacaacacacacgagcagcacacccacaacacctagacccaaaccacaaccacccaccccaaagcaaacaacccaaacaaaccacggagaccccacaaaacgccggcaaaccgcacca

SEQ ID NO: 722937 - DNA, 882 bp, Homo sapiens
  misc_feature (1)..(1): n is a, c, g, or t
  misc_feature (66)..(66): n is a, c, g, or t
  misc_feature (69)..(72): n is a, c, g, or t
  misc_feature (77)..(79): n is a, c, g, or t
  misc_feature (110)..(110): n is a, c, g, or t
  misc_feature (113)..(114): n is a, c, g, or t
  misc_feature (122)..(122): n is a, c, g, or t
  misc_feature (144)..(144): n is a, c, g, or t
  misc_feature (228)..(228): n is a, c, g, or t
  misc_feature (254)..(254): n is a, c, g, or t
  misc_feature (875)..(875): n is a, c, g, or t
ntccgaatgtcaccagtaaaacaattgaaccctataaatttaactgagcgtggctgtgtgaataanaannnnggaannnctttcgttgctggtgttttgcccttttaaantgnncaaaagtntagggcagcggcagcatttagnggcatcagaaaggagacccgggatttgtatgttaacatccagcctgttcaagaacctaaagaccaagcatttggcaatggaaanggaataataattattgctgacacccncactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgaaaaaaaaaaanctatata

SEQ ID NO: 722938 - DNA, 431 bp, Homo sapiens
ctgaaaaatactttaacttattctcaacaattttctgtttatagatgtcgagaaatttttaaggcataaaatctaactacaagtggattactaacattaattaataccctgatctgtggacagattgcctataataatgtatgtgactgcctggctaacctagtctgattaaaaattaacctaaattgacaacataaacttatgttagagagtgttggactttttttccctccaagtgaactttagccctggtgaaaggttccctgcagcagaaaattcattgagcatgtaaagcttgttggcattttttgtttattcccatggatttttggatttttttttttttttttttttttgaggagagtaaggttccagtattcgtatctgttctttaagcttcttgaatttgccataacgtgtttccaggactc

SEQ ID NO: 722939 - DNA, 1173 bp, Homo sapiens
  misc_feature (1166)..(1166): n is a, c, g, or t
tgatccatccgcctcggcctcccaaagcatgggattacaggcgtgagccaccgcactgagccaaattctttaattctgatggaattacctgcagactaatgtaacacgcatgcttttctaggattgggaggggaattgttgttggtagatggcgtctagctatgttgcccaggccagccttgaattcctggcctcaagcaattcttacaccttagcttctcaaagtcctgggattacaggcatgagccaccatgcctggctgcaagttttaatttttgaaattgaggcatagcattatagggtcataacttaacttataaactggctttataaattagtacattttaaataggactaatgaagcctatattttcctccactagtatatttaaaggtataagacttgtgtatcccaaacactcagaatattaaataactaaagatcttattctaaaaggtgcattgagtgggtttttgaggcctaaaaattgtataccagtgctaattgggatataccaaactttttgtctcttagtaattagttttgttttgttttgttttgttttaatgttgtgcttatcttaaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgaaaaaaaaaaanctatata

SEQ ID NO: 722940 - DNA, 421 bp, Homo sapiens
tcgaattcgaactaccagaccaaagctggatagctgagataatccttcatctctactgacaaaggaggaacttgagacaaacaatacgtatgtaggatggtgtgtctgcatttgtcacactggatactgccaataagaaagtgttcctgggtagagatacatatggagtcaaacctttgtgtaacgcaatgacaggagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttc

SEQ ID NO: 722941 - DNA, 264 bp, Homo sapiens
gacgctcaatggaatcccgaaattcccactggcttctatctacctgtgatgtgatttaatgctgaaatgacttggctatccaaagcttctagtctagaggtctgttggttgaaggcagacatcttcaagtttgttggaaataatacgaagctgactagcttacgtgaatgatgtcgtcctcatttgcttcgagcgaggactcattactgcagtatattgatctcttcatcaaacgttttccttttgggcgaatagatgctgtat

SEQ ID NO: 722942 - DNA, 335 bp, Homo sapiens
caaaacacaataacacatataataataaggaaaaagtccgaaatatctacaagaataaccaaaatgtgacacacaacatgaagtgaacacatgctgttggaaaaatggtgccgatagacttgtctgacacagggttgacacaaacctacaatttgtttaaaaaaaaaaaaaaaaaactcgagggggggacaggaacccaattctccctatagagaaccgtatcacacattattgtcccattcaatacaacagccggactgataaaaccctagcgaaacccaagcttatagaaatcgctcaaatgtctgctaccctaggtggcctaatagccaaaa

SEQ ID NO: 722943 - DNA, 272 bp, Homo sapiens
attgtcacctgtaatgatgttaaggtcttcaaccacctgatgcagtagtataaacataagggtgcatgaatttatttttactgggagggctctctagaggaggtgctctccattaatcgctcgtctcaaaccatttcgggcattcttaatagatagcaacttaatttttggctttgtttcatgcagtatcttctcctagcctcggcacatgccaaacaagtcgcatggtccttcgtgaatgtggttgcatgggatacccgcagctcgaactt

SEQ ID NO: 722944 - DNA, 715 bp, Homo sapiens
ccttctcattttatacaataaacattctccacctacaaaaaaaaaaaaaaaaaaaaaaaaaaaaaaaaaaaaaaaaaaaaaaaaaaaaaaaaaaaaaaaaaaaaacaaagacgaaaaagaacaaacaaacacaacaacaacaaaacaaaagaagggggggcgcgcgcgcaagtacaaaaacaaccgacagggggaggggcaagcacatctaccagccacacccagtagttagtaaggacaaagagagcgcccaacaacgaagcgggacacataagaaagcaacgagacgggccgcgcggtgataacataaacacagtggaaggagtagaacaacaggtacagagtagggagtatttttggagagggagaaacagaacaattaatcagggtgagggaggggaagaaaataaatgatagtgaggcaaagcactaactaagtaaggatagctatgtcatgcacgagtggggaggagtaacaaagtaatcatacgatataatgaaggttgcgtagtagatgtgtaggagtgatgaaaaaacagaatggatgaatctaatgatgtgcggtgagtgatgatgatagaaaaattaggttgtgacagataacagaagcgtgagtatttatgtgaatgtagagaaaggaatatattttatctaccgagagagcgcgggacgatatagtagaataatataatgtgtgtggttcggggtagagtgg

SEQ ID NO: 722945 - DNA, 331 bp, Homo sapiens
ctcccgtgttcacgccattctcctgcctcagcctccctagtagctaggaatacaggcgcgcaccaccacgcccggctaattttttgtatttttagtagagacagcgtttcaccgtgttagccaagatggtctcgatctcctataggcacgtgctactaacccctggctaatttttgtcttttaagtagagacggggtttggccatgttggccaggctggtctcaaactcctgacctcaagtgatcctcttgccttagcctcctgaagtgttgggattacaggtgtgagccaccacacctggcctattttgagttagatttttggttctgat

SEQ ID NO: 722946 - DNA, 572 bp, Homo sapiens
ggtacccactctgacgagtcaactcatctgcgtgaacggtcttaggcatgctgcaaggaggcatgaggactgcagacgtggccagagcaataaattgcaatgtccatactgtgagacgtctaagacagcgctacaggaagacacgatggacagctgatcatcctcgcagtggcagaccacgtgtaaccacacctgcacaggatccgaacatccgaacatcacacctgtgggacagatacaggatggcaacaacaactgcccgaattacaccaggaacgcacaaaccctccataactgctaagactgtctgcaataggctgagaggggctggactgagggcttgtaggcccgttgtaaggcaggtcctcaccagatatcaccggcaacaatgtcacctatgagcacaaactcaccatcgctgcaccagacagacctagcaaaaagtgctgttcactgactagtcgcggttttgtctcactaggggtgatggtcggattcgcgtttatcgtcgaaggaatgagtgttacaccaaggcctgtactccggagcgggattgatttggaggtggaggg

SEQ ID NO: 722947 - DNA, 401 bp, Homo sapiens
atcttccggcgtcgatcaagaggtcaaaagccgtctccattccattgagtatgatactcccaccacatacctgcctgtccgtgctatgtatggcctcagcggaaaagtatcgcttgtacgtcccgagtgtgtaatagacaatccacctagactggcaccgctaagtttcagcacgtgctctcactggtcagtgatgcataaaccctgctcagtcagttctcaacgggtcccattgcttcgcatgcattatgcatctccataccaaatcctgtattgctactgccagatgccacagagtcccttcctttatactgctttaactatctcatacggttgtgacgcaacgcaagctagacatcaattgtataatcgtgtagctcaccaatgttagaccatgtcac

SEQ ID NO: 722948 - DNA, 103 bp, Homo sapiens
gtttgtccagattcttccatttactgacaggcctctcccgttcgaggcctttacattctgtagtgggcctctcctggcagaacaattgcattggaccctgtcc

SEQ ID NO: 722949 - DNA, 1109 bp, Homo sapiens
gagtgacggtggcgtttccttgaggaagagtgagggttccaacttttctgcttatctgggaggtgtagggcgcggacagtcgacgactgtcacgacgaacacacagcagccggtacgaccttaggtctgttacgacggacagacgaccgagttggacagacgttccctgccgaagactgggctggcttacgatgacagatgacagactgcacatgatcggggacggactaatggggaatgattggaccaatgtagacggaatgacctatctctacatcacgttatcgacgcttgaacctaagacagaaaacaactgtgggtaataaggaatggaggagaacttaaataaacgatttccacgacgacgacacaacgtgtgcaggaagagtccccccacaacatccgtaggcacgctgggccacaacaaaaaacataacgtgagcggagaaggagtaacaccccagggcaggggggaccattaacacaacagacagcgggtaacgactgcccactcaagtccgggcttggggacgtcaacactgacgggggggtcaacggggtaacaccaacaacgaaacacaacgtaacacagggttcatagggcctacgttcaacacaacaatcgaccacgacaccgaccacctcaccccacaaacagcaccccacgaccaccgggtcgggccgcgccgcgcccccgggccaccgcccacacaacacggcccccacagcgaccacacaaacgcaagcggttatggtcagcagggtggcgccgccacagacacgacgctgacgatgcccaacttctgccacgatcaagacgaggatagaccaccgaaaaggagcaacccgcggggcgcacacgcgaaacaaagaggcggagaggggcaccacacaccaagaagataaagaaacaaccgccccggggggcgacgaaacccgggcgcacggggtcgatgacgaaccaacaagctgcacgcagaggtgcggacacgtcactacgggcgcgacaacacacgggcggagctagtcacacaacacagagcgtgctacatgacagatgacacgacgccgcaataataaattaccaccgacccacatccgcgagtggt

SEQ ID NO: 722950 - DNA, 866 bp, Homo sapiens
  misc_feature (63)..(63): n is a, c, g, or t
  misc_feature (65)..(65): n is a, c, g, or t
  misc_feature (340)..(340): n is a, c, g, or t
  misc_feature (358)..(358): n is a, c, g, or t
  misc_feature (866)..(866): n is a, c, g, or t
attgagaggttgttgctgaaatgctacagctgaggccacagagaagccatagcctactgtggntnggcctctttaggcaaaaggaaagtctgtgccactcctcaatggttaattttagtatcaaaattcttggaggttagaaaaaaaatcctacaatgtcagagctggcaagactattatttcagtcaccaaacttaacaggagaaacgagagccaaaaatattaggaaaaaggagttgagggcagagttactcaaccttggtactactgacattttcattcaaataattatttgttgtggtgtgtgtgggggtggggggttggttatcgtctgcattgnaggatatttaggagcatntctggccactatccaatagacatagtaacaaccccttgttgtgacaaccaggttgagaaccacagttttaaggaagctttctgctcattactgaagtcaggcaatgctgtcagcccacattttctgctggctgtggaaccacctggtgaatgctgcacagtgagagagggatgttattataaatcgaaaactcaaggcaccataccaataaacatgaataaaaactgtaggaagatgaatgtttggtgtggcaggcctcctgagaaaagtagctgatttttctgacatggattagatacttactcaaccgtcccagaaacatctgagtgtttatatatggatgaattccttgtggacagctggattggtcactttgcaaattatttttgcgacttccactacctcttgctcttaccccttccttttatcatctgattctgcactttctaaccaaaatgtggccccaagcctaataaaaatactatttctatattcaaaaaaaaaaaan

SEQ ID NO: 722951 - DNA, 465 bp, Homo sapiens
  misc_feature (31)..(31): n is a, c, g, or t
  misc_feature (58)..(58): n is a, c, g, or t
  misc_feature (217)..(217): n is a, c, g, or t
  misc_feature (306)..(306): n is a, c, g, or t
  misc_feature (353)..(353): n is a, c, g, or t
  misc_feature (366)..(366): n is a, c, g, or t
  misc_feature (387)..(387): n is a, c, g, or t
  misc_feature (418)..(418): n is a, c, g, or t
  misc_feature (433)..(433): n is a, c, g, or t
tgccagtcaaaagggtttcgtgaaggttgcntctgactgggacagttaggcctctttntaccactttaaaaggtgttgacttttctagtaaatatcctccatgtcaaagtctatctcaagatctgttccaggacaaccccgcctgcaacagggcccatttatgttccagccagcacggtgatcctgagtctgggaggatgcccacagactgcttttntgagcagcatgccttcagtggccagtccccaagcccctcaactccatgtggagcaaggaccaaccaccccatggagaagaggaacccgnctgcaagggaggcccaagaaggggacctttgggaaccagcccacaantgggacttttgtnagggggcttggatgggctggncccaaaagggttaggttccatgttcttaagnccccagaaacccgtnaaattattggcctttattttggaaaggaaatt

SEQ ID NO: 722952 - DNA, 338 bp, Homo sapiens
ggggcccccccaaaaggggggggcccccaaccccttttaaaaagggtttttcctgttcccccggttttttcccaaatttgggccggggggccccctaaagggggggggggaattttttgttaaaaattttccccggggccctttttggcccccccccaggggtttttttttttttttttttcacctttaaaaaagcttggggtttttttaaaaagcccccttggttttttttccccctgggtttttttttttttgaaacccttttttttggtttttttttttaaaaaattttaaaacccccccccctggggccgaaaaaaatttaattttttttttta

SEQ ID NO: 722953 - DNA, 884 bp, Homo sapiens
tgttcttccgccgctccgccgtcgcgtttctctgccggtcgccattggaagaagagatcgtcgcgctgggtcattgacaatggctccggcatgtgcagagctggttttgctgttgacgacgctccccgagccgtgtttccttccatcgtcgggcgcccctgacaccaggcgtcatggtgggcgtgggccagaagtgactcctacgctgggccgagcgcatggcccaggagcgagaagctgttggttcattcctttgacccttgtaacgtacccgcactatgaagcagtgggcatcgacatcgcaaagctgggacgaaatggggagaaggaatctggcgatgcgacatccttctatcaaacgaagctgtgtcgatggccctccggaaggagcacaccagtgctgctttgaccgaggactcgcctgtaaccccgagaggtcacctgtgacagtacaggatgttacgtcagatgtttggttggagtacgcttgaatcagcccccgtgctcgattgttaatgttgggtcactcccattgggccgtgccatgttcgtcttctactgcctcgtcttgagtgtcgccacccgactgggtcgcattgttcgattgggcatcgtcctgaagagaccgggggggtcgattccaatcatgtgggttgccccgaatcgtatcgcaggggttagtgccctatccctccgatgccgatctcgtgcgttatggacgcgtggtttggccggggactggtgacccgattgtaccctgagtgaaagatcccgtctagtgaaccgaaggctacaggctttcaacgaaccaagtgctgaagctgggaaaatacgtgcgcagagatcaagggatgaaccgttgtgcttacggacggccttgtaca

SEQ ID NO: 722954 - DNA, 220 bp, Homo sapiens
ctcctcagatgaaatacgcttctcgcatttcttcacggggcgcgccccatgcttcttagcgtcgcttgccaaactatgagctcatctattctcaatgaggctactctggcaatcccgttcatgtcattgtgtgataaatacccgatatatactgctttttcctcgctaccgtccactccatctacctggtcatagctgttttcctgaatatagatagagg

SEQ ID NO: 722955 - DNA, 851 bp, Homo sapiens
  misc_feature (283)..(283): n is a, c, g, or t
  misc_feature (572)..(572): n is a, c, g, or t
ggcacgaggattctgctggaggctgtgcatatctggaggtgaaggtaccacctcatggagaccccgcggctgcgccccgctgggagcttattcccctccttcctgctcctggctgcgggacgctggtggcctccttgcgtgggctgcctgctcacctgcctggggctcttctatcagcttgcttgcacaatggtggacaatggcaagctgtcctggcatggctggagatgaactgttggcctgcttgtgcttgatgtggcccatgtgtgtgctggttcatctntcactgcttgtgtctgtgtgtgtgcacattttccccctgctgcttggtgtgcccttgtgatgaacacttgtgtgcatcctgatgttgtgtgtgaacacacatagccatgactgtgtcactggcctgatcttttgcttgcgtgattgctcatgtggcccctgcctgtccctgtggactgtgtggtgctgttggctgtgcatgttgacatgcatgtgcccctgtgcccctcaccagacacctggttgaacttgctaggttgacagacacttgctcatgaatgtgctcatgnttccccaagtctcttgcttccttggtgttgtggtgctgccattgcactcttgctgcatgaacctggtggtgctgctccatgtgcttgttgatcagcttgtcccattttcctggccactcttgtaagttattgtgttgtcttgtgctgcgagggttgcgtggaccattgtgcccaccctgagtggccgcgatggcttgcctgccagtcgggcaccccagtgtccggtgtttgtggagctgcccctgttgacgtgctttacccctacttcatggtccagaa

SEQ ID NO: 722956 - DNA, 142 bp, Homo sapiens
ggttctttgagtcctttgcggatctgtccactcctgatgctgctatggacaaccctaaggggaaggctcatggcaagaaagtgctcggcgcctttagagagggcctggctcacctggacaacctcaagggcacctttggcgc

SEQ ID NO: 722957 - DNA, 80 bp, Homo sapiens
  misc_feature (36)..(36): n is a, c, g, or t
  misc_feature (53)..(53): n is a, c, g, or t
ccttggtctttgagaagatggtagcttctgcagttnggaggtgcagacacttnctctcctatgtagttctcagatgcgta

SEQ ID NO: 722958 - DNA, 121 bp, Homo sapiens
agaggatcccgaagtaccaatgaggaactaagttgcacagtttatagagccccagctttatgaaataaaacaatcaccaattccaaactgcatgaagagaaacgtcgaattcgaggggtac

SEQ ID NO: 722959 - DNA, 398 bp, Homo sapiens
  misc_feature (285)..(285): n is a, c, g, or t
  misc_feature (289)..(289): n is a, c, g, or t
  misc_feature (292)..(294): n is a, c, g, or t
  misc_feature (298)..(298): n is a, c, g, or t
  misc_feature (300)..(300): n is a, c, g, or t
gctgaggatcccccccgcgtatatcttagtgaagaaatcggatgctcatcttctgttctacatccctgcccttgctcagtgggttaaggatccggcgttgccgtgagctgtggtgtaggttgcagacgcggctcggatcccgcgctcggatcccgcgttgctgtggctctggcgtaggccggtggctacagctccgattcgacccctagcctgggaacctccatatgccgcgggagcggcccaagaaatagcaacaacaacaacaaaaaaacaaaaacaaaaaanaaanggnnnttcntnggccttaaattaaaaacaaaaaaattaaaaaagagtcttcaaacccataaagtgtgcgcagggaattgtcaggaggttaaatacccctttttggtttt

SEQ ID NO: 722960 - DNA, 115 bp, Homo sapiens
  misc_feature (110)..(110): n is a, c, g, or t
gttcataaaagtttttgggccctaaattttttcccaaaaaaaaaaaagttcttaagtcccccctttttttgggtaggggttgttcccccgaaggaataaatttttttttncctca

SEQ ID NO: 722961 - DNA, 463 bp, Homo sapiens
  misc_feature (289)..(289): n is a, c, g, or t
  misc_feature (292)..(293): n is a, c, g, or t
  misc_feature (299)..(299): n is a, c, g, or t
  misc_feature (303)..(303): n is a, c, g, or t
  misc_feature (425)..(425): n is a, c, g, or t
  misc_feature (427)..(427): n is a, c, g, or t
  misc_feature (431)..(432): n is a, c, g, or t
  misc_feature (434)..(434): n is a, c, g, or t
acgaaccgagtgtatacccggtagagcggctgttgacttatcttgtaaataagcattttaaagaatttaaacagggagttcccgtcgtggcgcagtggttaacgaatccgactaggaaccatgaggttgcgggttcggtcctccctgcccttgctcagtgggttaaggatccggcgttgccgtgagctgtggtgtaggttgcagacgcggctcggatcccgcgttgctgtggctctggcgtaggctgtggcagatacagcttcgattcgacccctagcctgggaacctncanntgccangggnacatgatgtaaaagacatctatataaagtactaattatagaactgtgtggggagttcccatcgtggcgcagtggttaacgaatccgactaggaaccatgaggttgcgggttcgtcccccgcntnatcnntnggataaggatctggcattgttatgagctg

SEQ ID NO: 722962 - DNA, 149 bp, Homo sapiens
cttgatcttatcggtgggtagtagtacgagcgagtgacacaagttcttgcaccgatcagatccaacttctgcgcaagatgctggacaagctgtgggacgacgtggtggccgggcctcgcccggagacgggcctcgacaagctccgcagg

SEQ ID NO: 722963 - DNA, 1008 bp, Homo sapiens
  misc_feature (1005)..(1005): n is a, c, g, or t
tttctcccccctcttttatgtgctaaagaaaaggtcatttcgatgcaaggtactgaccctgtcatcaagatccgagggtgctcctgacacatgacccactttcctggcatttctcttacacgcgacgaggtctgcactagtgagatctgaatgactcacgttgctttccagaagctcgggactattagccatctcagtatttctggatcctgattactgtgtaccactgaggggacagttgggtcaggagctgtgccccggatgtctgatgtcgtctcactagagcacaaaacgtccatgtacctactacaggtccagacctccatggctatctgtcccggggtcgcctcgatcccagcctccatgcggagttgcctaagagtgcatgttcagcataagcaggattgctcggtggtgcatgaaaggttacgggtccggtctcaagactgaataagaagagataaaatttgcttataaattatactggactacgtaggtcttttggctgaatcggtctgataccaacctgtttccaacctcttgatcgaaagatccttgggacataagagaagggcaacggtttgagcccagagttgacggcgggagtatctcaggggtacactatcagggggcctccataagcgtcaagcatcgtttaagggagagaggcccaggtggggactgggaatttaaggagagctgggaacggatcccttaggtgcgggagcatctgtggtagctggagatggtgggcgaaggtgtctggcgcgcggctgatgtgatggagagccgggtccagacccccagcgtgattagtcctggttgggcccttcacagaccgcgttggttagaaaggggggggggcagaaccgataagactactgtcgccaccgggacactcgtggcgactccctcccacacacttctgcgcaacacaacacaaaggggctgccctgcttctttcctttccctgtcgtcgtttttcttcttttttctctttgtggnata

SEQ ID NO: 722964 - DNA, 112 bp, Homo sapiens
tcgagccggtacctctccctactgtatcctagtataaacctactatcaatgatctagaagataatttaatttttaaaaataagacatctccaggtaggatacagtagggaga

SEQ ID NO: 722965 - DNA, 583 bp, Homo sapiens
tgctacagaacgggggggtggtttgtttttggaaagatcaaggggtttttgttcacagaattacatataggctaatatgagggcataaaacagcaacaaagaacaataaggcatacagcagtgaatacaccagggtaaggttgatatccgaaagggctagataatttggggggggctattagaaataaatgcaacagaggtcaataatcacaaaattttagggttagagcaagatcagtcaagtgactaaacagagttaccatctttaataggactataacggataataagcattttgggtttggcaaaggggcacatacggttaagaagggaagaagggacgataacatgcacattaactacacacttgaaaaattatgacccaggcagaagtttagctcaggtagtagtactaagggtctacatccgattcaaaaccacatagtccatggatcacagatgcagggtataagtcacgaaagtttcagaacacttggtgtggatttggaaaggtcattggcatcttctatgatttcacctttatctccattaaacttgctggtcccgctgggggatcctctag

SEQ ID NO: 722966 - DNA, 153 bp, Homo sapiens
  misc_feature (47)..(47): n is a, c, g, or t
  misc_feature (60)..(60): n is a, c, g, or t
  misc_feature (121)..(121): n is a, c, g, or t
acaggatggtcaggacaagccacctctggtaaagtgacatttgagangacccctgaaggnggggggttgagtcatgtggacatcttgaggaagagtttactggcacagggaactgcaaggncaaagtccccaagtactagggctgggggcagt

SEQ ID NO: 722967 - DNA, 289 bp, Homo sapiens
agagggcagggagagcaagctattgcacttattgcaagcctgctcatcgcctatggcatccacacaacccaattgtaaaacatatgatttgatcttttggggcacaactgttctgttgctgttttttgtttgtttttctccagagcactttggctagactaggcttgggggtccaattgggggagaagctctgggcacgtatgcaggcaagaaagctttctttgcagtagcaccagtaagggaaatgattgtatcacaaaacaaacccaatatccagagaatatccgag

SEQ ID NO: 722968 - DNA, 190 bp, Homo sapiens
cgttcaattgcggtcagcatcacgtcgtatttgcactatctcacggagacaaggtccctgtgagctagtgggtccctgtgcagtacttggcgtggcatgttgccggggaagatggagcagtataagactgttcgggcccagaaaggccgagggctggggactccttaaaacctactgagggcctgggcac

SEQ ID NO: 722969 - DNA, 1006 bp, Homo sapiens
  misc_feature (389)..(389): n is a, c, g, or t
ggagagatcactgacaaaatatctgtcaagccaggccacaaacaggtgtacaattatgaaaggagtggttggatgtgccaagtttggtaaagtggtgactgcatctgagatataggctgtgaggctgaactcttggtggcttccttctgtagcttccacagggagtcttcaacacaggccccgtgctcgtatgattacggtacacctatgtaggaagctgcgtgtgagtttactgtctctctttctgtgtgtagtgttttcggcgcttcctgatcgatgcacttctcccctcccaggagcctggggatgccacacatccagaatgttcatgggacaacgatcgtggggtgcaggggacctcgacctctcgcctgcccgaggtgccggcnccggtcgtccttggtccccgtgggaccatctcctagaccctctctagcttggtggagcattgccatcctgatttgtcgtgatagttccccctctggtgggcccaccgggcgcaggatagctcttttctagctgagcacatgtgtcttgctgcgttcagcgcatcctatcattccttttcgccctgttggcctgccaacggcagggcacattagagaacggtaaggctaacttgtactgctaggtcttgtccacctacgggctagcctttgctgacgctgggaccgggcctcccacggcgttctagagcggctagcttggggctggttctctccatcgtcagggttgcccctttggattggtactagccgagcttttacccctgtgcgctagggctcacgccatgctgtaagtgccctcttaccttttggtcctgctgttggccggcgacgaatggcgctcatggtcggatgcctgtggctgaccatggtcagtgaggccggagatctgtccccaccggcgaagtctttcagacacctcgggtctggcacgcgggcccgtccacttagcgctcgtccgaggcgtccagcctctcctgttgttgtcactccataagggc

SEQ ID NO: 722970 - DNA, 726 bp, Homo sapiens
  misc_feature (313)..(313): n is a, c, g, or t
  misc_feature (371)..(371): n is a, c, g, or t
tatgtgtctttgttttcgcaggtaaaaatgatacttttattggagtcaccaggagaaaagattcactgggggttcaagtcaaaggttcagaatcataacaggccaaaaaggttggatcccgagcacaagcccacgagggaggggaccaaaacagaccaaaagtgagacaacaaccccattattaaaaagatgaacgtgggcggcttcacacacctcacacagcattacacattacacacgggatgaaagtgttgggacagaggcaaattttcacggtggctcataactcgtggtagtctgttttaaactacanggttggtgtagggggtggtatattgggttgttattccaggctagtaaagaaagaggcngccaaaaggtgctgtgtggtgaagggggggaagaggcagaaatatgtacgcaaataagagatcatttctcccgtgggagggcacattgaagaagggagaaaacacagggaggacaggtgcgtgggagaaacggcacgtttgcctcaccaactggggctatactggtcaatacctatagtatcgggtccacaaagtgttttagttcacgtttcatagctttggagtgcctcattccggggaattaaatgagcgtgaaagacctcgtgtgaacttgtagagaagaccagggcctcagccagcccagccagcccctgagggctctgggcgctctagggatggagggtatggtaaacat

SEQ ID NO: 722971 - DNA, 205 bp, Homo sapiens
aggctgattccactctggtcatgcatactgcggcccacgcagacaagattcctgcagggctttgtgcgacagccattgatatcctgacaacagtagtacgatatacaaagcctccccttttcccagacttctcatactgccaaggctttcccgtgctgtggcacaggtgtaccctttcacacagtattacaatgccgtcatcagc

SEQ ID NO: 722972 - DNA, 133 bp, Homo sapiens
ggacaggggaaaacggccaagttcctaaaaatatgttttttttgtggggagcaattcatgatgggggtttttgtttggtttcccccccctccgtcccctgacgccgagtaacccttaaacctttttagttgca

SEQ ID NO: 722973 - DNA, 389 bp, Homo sapiens
tacttagcactaacgtgttctcccggtcaggcatctccaggctgtggttgtccggacgtctgtgatagaagagcaggagatgctgagtcggggccgagaggcctaagtcaggagaaagaaacagatctgggtgtttggtttccaaagaccactcttcccctccctccagacattcatctttccttctacatcctcgggaagttagacaaaaggcagtcacactgctttctcagtcctgcccgcagctgctaacacagagccaagagccagctttaccaacaaaaagtgagcgacaccagggccatgggctggtaaaccccagagcttatctgcagggctgtgaccactctgagcactctctcacttgctctcagtcacccagccgctcg

SEQ ID NO: 722974 - DNA, 458 bp, Homo sapiens
  misc_feature (212)..(212): n is a, c, g, or t
  misc_feature (326)..(326): n is a, c, g, or t
  misc_feature (332)..(332): n is a, c, g, or t
  misc_feature (401)..(401): n is a, c, g, or t
  misc_feature (403)..(403): n is a, c, g, or t
  misc_feature (412)..(414): n is a, c, g, or t
catggcactccagcctgagtgacaagagtgagaccccatctcaaaaaaaaaaaaaaaaaaacaaaaaaacttatgtacatagaaaaatgtgtatatgaatgttcacagcagcactgtgcataatagccaaaaaggggaaaactcactgaaagtgttcatcatgctgataaatggaataaacaaaactacaggcatggtgtggtcatcacaantggaatgctgttcacgccattaaaaaggcaatgaaatacctctataccaccacccacggcttgaacccttgaaacacattttgcataaataaaagagagccagtacaataaaanaaaaanaaaaaaaaagccattgcgcgccgcaagcgttattcccctttagtaagggcttaatttaaggccgactancntaatgctcnnngtaagttcggaacgtgctgggggggggggggggggggggggggg

SEQ ID NO: 722975 - DNA, 526 bp, Homo sapiens
ttttttttctttgtttatccttttttttcatttgcaattattacacactaacccgatgttttgtaaataaagtattgttttaaacggaccttcaagttcatgattcacacattttttatggaccctgggcaaaccactgtgcttatggggctacattttggggatggaacaatacaactgacagaagtggaccatctaaagggaggtacttgaaaaaaatgggataatgacccaatcaaaggtgaaagaacacaaagccttcggatggttagtggagaacacctattaagcaaaaaaatgtaggcctccctttatttcgggggcaatgggaccaggaagtgaacgtgtatcaggataaaaagagcattaccgccccttggtgagttcttaaacgaaatgtaactccacgagaggtgtttggtttttttggtggccaggccaaaattcataaaattttaccttgcgaagctgaatataacagcatgtgttttttaacatacgggtgcctttttaatcatgcctaaaa

SEQ ID NO: 722976 - DNA, 123 bp, Homo sapiens
ggtacccgtcttctgatccagtctcccccgcaaaccacccaccacagccttcaactgctcaggcgttgccgcttccacagccaccggctcgcccgccaccaacaccacccactggatcagagt

SEQ ID NO: 722977 - DNA, 271 bp, Homo sapiens
ccgggtgtggtggcacgcgcctgtagtcccagctactcaggaggctgaggcaggagaatcgcttgaacccgggaggcagaggttgcagtgagccaagatcactccactgcactccagcctgggtgacagagcaagactctgtcttaaaaaaaaaaaaaaaaaatcaagaattaggcgtgatatcacacacctgtaatcccagctactcaggaggctgaggctgagaatcgcttgaacccaggaggcgcctcttttttgaggctctgtctca

SEQ ID NO: 722978 - DNA, 81 bp, Homo sapiens
gccgaggacacggccctatattattgtgcgagaggggccgccccaagtccaaccgatgcttttgatgtctggggccttggg

SEQ ID NO: 722979 - DNA, 329 bp, Homo sapiens
taaaaaaaacaaaaacgacaaaaaaaaaacaaaacagaaaaaataactagggcaaggacagcccgggcaaaggcggggagggaggcagcaggggtcagggaaggtaaccctgaagcaggactggtaaagcaaataagatggggaggccaaggggggtggatcaggaggtcaggagttcgagaccagccgggccaacatagtgaaaccccgttctttactaaaaatacaaaaaaattaaccaggtgtggtggtgggtgcctgtagtcccagctactggggaggctgaggcaggagaatctcgaacccaggaggcggaggttacagtcagc

SEQ ID NO: 722980 - DNA, 453 bp, Homo sapiens
gaggagagtgaggcagaagcactcagaggcggatggaggagcgaggcggagcagctggagcagacgaagcgggatgaaagcaaagctcgagaaggcgaagcagactctggagaacgagcggggggagctggccaacgaggtgaacggtgctgctgccgggccaagggggactcggagcacaagcgcaagacagtggaggcgcagctgcaggagctgcaggtcaagttcaccgagggagagcgcgtgcgcacagagctggccgaccaggtcaccaagcttgcaggtggtgctggacaacgtgaccgggcttctcagccagtccgacagcaagtccagcaagctcaccaaggacttctccgcgctggagtccatgctgcaggacactcaggagctgctgcaggaggagaaccgggagaagctgagcctgagcaccaaggtcaagcaggtggcgga

SEQ ID NO: 722981 - DNA, 152 bp, Homo sapiens
  misc_feature (117)..(117): n is a, c, g, or t
  misc_feature (148)..(148): n is a, c, g, or t
tgggtgactagacaagcaattaaacaatgaaagatacatgagacgcctggagtttcatataataggtagatgaactctatgaagcttatagtatccagcagacgcctccaggatggntgccagcaaaagtgaagcagagccttcgcanacat

SEQ ID NO: 722982 - DNA, 602 bp, Homo sapiens
taaatgcttgttaacgataacaggaaggctggagcaacaccgactctcttattattaggagttatcctcgagactatcctctattctacatttcttctctactatcaagttcttctgacttttgctgatcctatatatttgggctggtatacataatgatgccatgtccttgaactctgggtcctgtctcctcagcttatattagtgcactgatggccctagtttagaatggttttcgttatgctccggagtagatggagcttttgagattgtggccgatcgcattttttactgtttagtttcctccttgcccagctctttcaaggggagctctacttttcctttcacagtctcctctcccagtctggtccattttctgctctgccagcctctggttctcatagtacttctcatactgctgtcttataggcggggctggtggccatcagagacttctggttcatatagagcccatatgcatactggccatactaaaatagctgagccagggcaggatgtcttagtgtgatcaccgactggtgctgaggctgtaaggatgcagaattgtggtcactttcttagaatctactgtctgccttgtt

SEQ ID NO: 722983 - DNA, 173 bp, Homo sapiens
ggatcatcagtacggagcaggaatcgcgatctctgggaacaactcgatgcgctgaaagccgatgttgaacgtctggcctcgatcaatgaagtgctgcttgacgagaacgccacgctgaaggcgcgcctaggtagcatgggcaaatgcccgcttactgatgctccgcttactga

SEQ ID NO: 722984 - DNA, 126 bp, Homo sapiens
cagcagcatagatattacgaccagtgaaattgacctgcccgtgaagaggcgggcacgacacagcaagacgaggagaccctatggagctttaattcattaatgcaaacggtaatatctatgctgctg

SEQ ID NO: 722985 - DNA, 159 bp, Homo sapiens
tccttgttcaattctcacacagctctgcatagcactgagtttgcaccatttctattctgtcaacactggcacacattgttttctcatgcaccaaaaacaactctcatgcataccaccaggttacaagcatctggtctgcacggttgcagcatgcacact

SEQ ID NO: 722986 - DNA, 754 bp, Homo sapiens
aaaaaaaaattttaacaagaaacaaagctaacaaaagaccaagaataaacactataagatgaaaaaaaattaaaatatgactgagcatatgaaagatactaagtgatatatagttacataaagtgatgatgagcacccacttgataatatagttgatgggaatccagaaacgttttgtaccaccacaggaatagtttcccagttaattcattatttgtttccacaaacatgccatgattgaaaggcttgtaatccaaagttacttgtgacagaccttgaatattgcaattagctcgtttaaagagccaggtgattttgaacaatggattgaaaaagatttggtacacacagagaggcagctttataatgatgaaattgtggcacatgatggctccgctacttacttgagattcattattggatcagccattgatcattttagatatgtgcatagcgattctgtataaagaacagtagtctcaatgatttcctcataatgatatcaaactgctctggcctgattttttaacaatctatttaaccatgaagttgtcacttgaatactgtattggatttttattcatccataaatcctttttttagaaagaatatccctgtcgataggtttgaccaatctattttagattgggcaccttttgaatccgccctttaaagcttattggcatttgccctattggatcttttcaatctatttggggcgcttattgttggatggaataactctgcttccctt

SEQ ID NO: 722987 - DNA, 496 bp, Homo sapiens
  misc_feature (2)..(2): n is a, c, g, or t
  misc_feature (103)..(103): n is a, c, g, or t
  misc_feature (111)..(111): n is a, c, g, or t
  misc_feature (185)..(185): n is a, c, g, or t
  misc_feature (204)..(204): n is a, c, g, or t
  misc_feature (282)..(282): n is a, c, g, or t
  misc_feature (335)..(335): n is a, c, g, or t
  misc_feature (351)..(351): n is a, c, g, or t
  misc_feature (371)..(371): n is a, c, g, or t
  misc_feature (380)..(380): n is a, c, g, or t
  misc_feature (385)..(385): n is a, c, g, or t
  misc_feature (417)..(417): n is a, c, g, or t
  misc_feature (419)..(419): n is a, c, g, or t
  misc_feature (440)..(440): n is a, c, g, or t
  misc_feature (442)..(442): n is a, c, g, or t
  misc_feature (457)..(457): n is a, c, g, or t
cnctctggcccatacctttgcaaaggaggggaggggtctacaagccagagctttcagaagagaagaaaatacatgcggtgctggtgctgtgtctggagcgggngatccttnaggtatgagaacaccacctccacccgatgacatcagacccactgactggtagagtccttggaaatcatacagtncacccatcccccgccaganacatggacacaccgaggctcagatggggaagggtacataccctagggcacacaccaaatcaaaaaggtgaagtcaggnctagaacacctgacccactttagcaggggactgtggccacaggcctggatgtncacagtagatcatganatacattagttctatgaatnacccccgtncaganaaatggctgtcgttgtcagggagcagccactncncaggggctcctgacctcagtnanaggtgagtgtgtganggccgagagactggatggtggtgatgaacctgaggacgt

SEQ ID NO: 722988 - DNA, 134 bp, Homo sapiens
ggcttcattcccatcaagtaatacaccagcagttgtcattcaacgcaggttttgtacttccattatatggtgatttttttactttttaagagcagaaacggaaattgacctccccgccatgtgtttaatattcc

SEQ ID NO: 722989 - DNA, 381 bp, Homo sapiens
aaatcctgaacctcaaatgatctgccccaacctgtctcccccaaagttttgggattaacaggcgtgaagcccaccgtgccccagccccgacacatccctttcctaagttgacccagaactggggtctcttgccttgctccccaagatccttatgatgtcccactaagcgcctaaggttgcaccagatcgctgcttcccagcctcaggtcttcaggacagctaatgtccacagctctgcccctggtctctcccctgatcccaggagccctggtggagaagctacagtttgccaatctgtagggatacactgggctaaaggcatgtctgaggatccttttgacctcaatattctacgagcccatggtcatgataaagagtgcg

SEQ ID NO: 722990 - DNA, 1212 bp, Homo sapiens
  misc_feature (454)..(454): n is a, c, g, or t
  misc_feature (489)..(489): n is a, c, g, or t
gaacatgcaccaatggctcgatgtaacaacatgcaaagcacctctagcaaaggaagcagcaaacacaggagagaccagtcaaggaaactcgattgttccatctttctacagaatagacttggccattgagtggtgaatagaccctgcctagacttattgctctccagaatagtacatgacacattactatagtgagagaagagcggcgtcgtgccactcgaggaatgcgcaatggaaatcacactgggttgctactactgatgagttctcaagtggatcgcatgatggtttcatatgctgaggcctcgtggcccgtgaatctcagcgagagattgatgtgataggcttgtcacctatgtagaatgataggtccctcaagcatgacctttaagctgacatacattgtcttccaggtactcaagaagccatgaccctgaacgtgatccattcacantggttccatgcgagatctatatttcgctcgcaggnaccaaaaatattggtgctgtgctccatgagtcgctaaaatagaactgtgtcctggcacataatggtatttggcgacggccttcgacggttagagagtggatacagaggcaactccatcacgaattgcgactctatctaatgggcctaatggcctgtctcctaggatttacctttgatcgacttagccgctatgtttgatcatacaccatacatagaaccgccctaaaccttacaaattcaaggaagtaagcagggcataggggagcgctttgctttttattgtgaccttccaatggaaatccccacaattcaacgcgcctctccgttcccacacacacctaccctgttggaccacgacattcggaatgcacctaggtgtaatataatcacagattgggaagcttctctaggaccgcaatgcgtatgggccaaggtagacctacaccactttggcacccttctaaggtcacaccatgggataacggtttcgcccttccaacacttacgcggactctactggacattactaccaccaagggaaattaaagaaaatctatctgttggaaacaacaacagggaaccatcctttatctgcacaacaccacagttggctttttggaccccaagactccataactttattaaagtcacccgtggcggtcccttagagttagaatctggttcctttctcacggagagttcaaccggacacccagatgttaa

SEQ ID NO: 722991 - DNA, 110 bp, Homo sapiens
tatgtaggcacacgctgctttcacaacagtggtccccggactcttggcctcgctgccggcaccgacggccaatgatccacccaccttgtggaccgcacggtgctcctcta

SEQ ID NO: 722992 - DNA, 149 bp, Homo sapiens
  misc_feature (115)..(115): n is a, c, g, or t
tctgcgcgaattcgctcagcgccggcggacatgcgcctgggaaaatgcgcttttcgatccaggggtgcatgtgggcggggaagttgcggccgatggagtggatcaggccgcgacntacattgcccagacacttcgagatgacgccaccc

SEQ ID NO: 722993 - DNA, 690 bp, Homo sapiens
tgcatgggcctattttaagatgattgccttgtagtcatagatgacggctccaagtatggagccagcatactatatcaacagaggattgcttttctttgccagaagcatctcgttatctctcattagtccacattgtcttttccctgtgtgtccctgagtcagtcacgggtagagcggatgaacgtgccgtgattttcatagactgatcttgtgtgagtagaatgcatgctgggaagcccaccagtatccgccgcgatttctcttttaccagtggggaagaatcacagtaatgcttgcaaggacatttcccttaaaggcaaaagtttccaattagacttctttttacaatttattcccatccctaagatgagctaatctccaaaacaaaaagacagcctaagatattttcagccaggtgcgctggctcacacctgtaatcccagcacttcaggaggccgagacggtcacatcacatgaggtcaggggtacgagaccagcctggccaacatggtgaagccctgcatctgctaaagatgcaacaaattgacagggcgtggtggtgcgttcctgtagtcccagctacttgggagtctgaggcgggagaatcacttgggcctggtaggtggaggttgcagtgagccaagatggggcattgcactccagcctgggtgtcagggatagactccgtct

SEQ ID NO: 722994 - DNA, 151 bp, Homo sapiens
gtgagttgagacagttggatatggtgaacatttacaaaataaaaaattagccggtgtggtggtacagcctatagtccagtactcaggagctgaggcagaagaattgttgaacatgggaaatggaggttacagtgagcaagattgtgcactg

SEQ ID NO: 722995 - DNA, 312 bp, Homo sapiens
agcccctgccccccgcccaagggcccctttttggggggcccctgagctaaaaatgttttttccctttttaaatggggaaaaaattaaacccgttttttgtgttaggtgggaattccctgaaattcccgtttccgcccccctaaatagttttgttgggccccccctgcccccccctttccatgttttttggggggggttttggggtccccccccagggttttagtttaatcccgctataccccctgttttttgcttttgaaattgggcctttgttccccccccttttttttttttggggcccgtttgttctta

SEQ ID NO: 722996 - DNA, 408 bp, Homo sapiens
  misc_feature (32)..(32): n is a, c, g, or t
  misc_feature (85)..(85): n is a, c, g, or t
  misc_feature (165)..(165): n is a, c, g, or t
  misc_feature (195)..(195): n is a, c, g, or t
  misc_feature (202)..(203): n is a, c, g, or t
  misc_feature (283)..(283): n is a, c, g, or t
  misc_feature (355)..(355): n is a, c, g, or t
  misc_feature (380)..(380): n is a, c, g, or t
accatcccagttctgttgtggacttgaccaangcattcttctcaatcagcattgctccagagagccaggaacagtttgccttcangggagggcgacaatggactttcatagtgttgctgcagggctatatgtatagccccattatatatcattttcttattaatnatgttatgttaaccgcgtagttcttttgcnggtttgnnttttcacaacacccctcttgcctgggattgggatgatgaggctgaaacagcccttctgatgacataagccctctgggtgnttaaccaagggtgcccatttaaactagatgtgcatgtaaccaccaatagaagttgggctaagggcctatggnagttatatggaagtgcttggaagcnccagtcagctttttagtcccagctatgg

SEQ ID NO: 722997 - DNA, 280 bp, Homo sapiens
tacttatgccattcagacttgttagagtagatgtgggtttatagactgccaagttttgcccagtacagtagtttatttatacactaaaaagttggactcattgacggagtccctgtagtagtttcagtgtaagatacagttttttccaccatacatctgtgcatttcctcttaagggtgactgtttaagaactttggtgtgcatagttactcagtttttatggaacggttgtatccggttattgcatatggcgctgtgcctccagtaaacagctaacctt

SEQ ID NO: 722998 - DNA, 177 bp, Homo sapiens
ggggggggattgtttttttttttccttgtttttgaacttccttggaggaaagcttgggaaacgtcccggggccaggttagggacttggggacgagccccccagttttgggagccggccgccctcggtttggggtaagcccccatgcccgtttaaaaaggagcccccgggccccccca

SEQ ID NO: 722999 - DNA, 877 bp, Homo sapiens
gcttgaaaggatccagatgtgatcctgggtgagcagcgtaggctctggttggttgagtcttgcagtgatccagatgtgattctgtgagacagtggtaggctcgtggtgggttagtcttaggtatccagatgtgatcctgtgtgagcagcgtaggctctggttggttagtgcgttgatggatccagatgtgatcctgtgatgagcagtgtaggttctggttggttagtgtagaggatccagatgtgattctgtgagccaagtgtaggcgtctggcttggctgtgagtctatgcagggatctcacggatgctgtatcctgatgatgagtccgctgtaaggctactggcttgcgttgagtcttcaagtatccagaatgggcaatcgcaactattcgagacagccgctagagcgtacatgggtaggcgtgaggtcgaggatttggttggggtcatgtaccctgaccccgttagggggttccacactatctgagtccaaatgtggggagtgcacataaagaccagggcatctataacgagtgaagattggagagacacctgctcccatgtggggttgcccatcgctgacacaatttgcctggaattaccacctttgcaagcgatctagacaatgaatgccaggtgggcgaccttaggggcatgggcgggcggaggatgtagggaaggaagggagaagtcaagaagggacttgtggtacccccctgggcacaaatggcgcccacccggcaactccgatcctgtgggccctgaagggcctgcgggaagaaaaccctggggcaagttacacgacccatcagctgatagcggaagaagaaagtgggcaacccttccgctggatgacccgtttaaatcgcaggagtg

SEQ ID NO: 723000 - DNA, 281 bp, Homo sapiens
gggggggattttgtctttttggccacagggggtttttttggccccccgggggggggcccgtttagggccttaggttttttccaggccccctttttgtttgtggtttggggggcggttttggggggggttttgtggggaatggggggctttgcgggggtttcggacccgggggggctttcccggtttccccttgggggggggggggttttttttgggcccgggggttagggggggcccccctttcccccccccgccccatttaggtttgccccccccttcca

SEQ ID NO: 723001 - DNA, 1284 bp, Homo sapiens
  misc_feature (376)..(376): n is a, c, g, or t
  misc_feature (405)..(405): n is a, c, g, or t
gtaaccacgctgttcgcggacaccattagggctgaaggctagagtgagggacttcagtgttgctaggatggacgtggtgagatgagctttgagaccatcaggcagtttactactcgtgctctgggctactcctaatgtcccatcagacttagtgccacgaagcacgagagatctatatatgttcctaatgacgactggtacgtcagccactagtactttcacaactggacagacacacttactaggacgagtagaattcattgattgcaagggggactcgagaagacgcgcttagagtagaccaatttttgtcctgaaacacaccgtttatcgctagcacgagcaccaagtccaatatgtgatgttgggaagatancatacatgtcagctggtaacgatctctgnctgtatacatgggatgatggttaactaaagcatatgtaaggaatcaccttatcgcggaatagctagtcgctagtcgagactatatcgtgggaatagttatatctcagacccagtgaatttgacggggaggacatgacactataccacccttggggatgttcctcccatagttcctcctagaggctttcgtacccctttgaataggtcaaacatcctttaacagtctcggggtatattcacaaggacatcctgtcttgatttcgatcacttttcaattctgtccagtttatcatttgccatcttaggctataggcctttgcactttatctatacctatcttcttttcgtctgttgtcccattttttccaggggtataaatggtcccccacgaaaactttttataaggtttctgtgaaacactgaactctctctgtcctcgttccatccaacactctctaacacaatttgcaccacatttagtaaccccttaaacttaacgaataacggggggggagggttgtcttacaaattattcgaatcgctgtcttccttatatccaagggctatgtaagcgctccggttagaagacgtttcacggttagcggtctcacactgggaacttttgaactgggtcagagaaaaaggaaggaataaaacggacttttttgcgaagagggactttgggggaccattgtttacactttaacttttatgccttaggggtaaagagagaacttcactctttccttcaaaatttttttaggcccttgacattatggttgcgatctttacgcattggttgaaatcgacttttcgcagttcattacaacggaagtacattcagaagattattgattaatatgtacacacaccacagaa

SEQ ID NO: 723002 - DNA, 319 bp, Homo sapiens
agcaattctggatcctcctttatagcgcatgtgagaatggaccaatacagtgtgtgtatgttgaactgtccttgcatttgtgggataaagctcacttgatcatggtgtatgatgtttttgatgtgctgttgaattcggtttgctaatattttgttgagaattttggcatctatgtttatcatggatattggcctgtagttcattgttgttgttgtatccttatctggttttgatattagagtaatgctggtcttatagaatgaatttggaataattccctccccttagatttttctggagtagtttggataaaagttgg

SEQ ID NO: 723003 - DNA, 92 bp, Homo sapiens
ggatttgctggtgcagtacaactaggcttaatagggacatggacgatattcgaaggatggaagaagagacgaagagacagctggatgaaaaa

SEQ ID NO: 723004 - DNA, 794 bp, Homo sapiens
  misc_feature (377)..(377): n is a, c, g, or t
  misc_feature (648)..(648): n is a, c, g, or t
  misc_feature (773)..(773): n is a, c, g, or t
cgaaaatgcggggggggggtgtttaaacttacgcagattccagaagcttatatgacatcaaggctgtcatgaacatctgcatccctcatacagccagactatcagatggagctgacgacaggctactggctctgttactaacctagggcgtgatgctagcggataagtgcgtggaggatgtcatacagacgcaccactcacagggacttagtgtctactacggagacatcgaagatgccaagacacacatcatctgttacgcaggataacgtgtctcaccggctacttgaggattagagcaagagacttgacagatacacagcactctcctctgctgaatcacatcttctttacaggacaatgggagagactctttnaggtcgaagacaccgaggaagaggactttcactgggaccaggtgaccaccgtgaatggcctatgatgaagcgcttatgcatgttgaacatacatcactgtaagaagctgtccaactgggtgctggtgtgaaatacctgagggatgcctccggcatcttcttcctgcctgatgaggggaaactacatcagctggtgaactcacccacgatatatccaccatgtttctggagaatgaagacacaaggtctgccagcttacatttacccctcgncattactggaacctatgatctgaagagcgtgctgggtcaactgggatcactaaggtcttaagcatggggctgacctctcctggggcacagaagaggcacccctgaagctctccgggcgtgcatanggctgtgctgaccatccactg

SEQ ID NO: 723005 - DNA, 1472 bp, Homo sapiens
atccttcacctgttgcctggctagagttgtctggctccactttgagctcttgcagaaccagccctttttcgtgtggtccaggaaagtccatgcctggcaccacctcctcctctagtgactccacgtagaagagagtcctggctggctgctgagtgccctgcccaggagccccttgctgcagcctcgtggcaactggaagcagggtgccattcagcggattgaaggaagaggaggaagaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccagcggagtcgcagaatgtgcttcacatcgaagtcttttcgcccagagcctgacatgctttacgcacagaaggcaaaaggctggcagctcacgcagggttctggaggctgggaagttcaagaccaatgcacgagaatttggtctaaagagaatcttcttgctctgaacacacatagtagaaggcagaagggcaagagagagaacaaagtctgtgtctccacatggcagaagagcagaggagacagaacctactcctctatggcaaccaccccatcaatgacaaaaatcctagaaggatgtatgtataggaagttgaagtgttgagaagagaatggctcagagtcaagcgggaacaagattcaaacttcagagagagagggaagaaaaacatttaaatatatctggcataatccaagactatttacgacaagtgttctgtgtttctaataataaaacagacttcacctcggagtacctgcagaactgggaccccaatgaccagggagaatgaagaacaacttgtttgaagattgccttttctgactcccagcttccacggagagattaactctgttggctgaagccctatcccaattccttggctagaccctgggtccttcatgttagaaaacctggctttactactactactactactactactactactactactgctactgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgctgcattttttaaaaatatattatcttattttactatttgatgttataattgttatatatttttccatacttcctcatactgcttatctcttacttaagaatttatgaataaagaattgatttttca

SEQ ID NO: 723006 - DNA, 924 bp, Homo sapiens
gatgccgcctttcgaagtgggtttggattttggacctttttgtctgcaaacgccttgtcctctatgtgctcccgttgggatgtgcaaaccgatgtttcgtcctgtcctagtgcgatccctcgtgccggtatggctcttgtagtgtaaagccaggaacgcctccgatgaactgtgagacgggtttcttggttaatcggtccgttatatgtcgggaccacggatcatcgctcggggcccatgcttgtgttagtactccgtggatgctagggtccgtcatgggagacggccttgtgtactcgatagaatgggctcatagcgatgtgctcgctgcccgatggttatcctgggtcccaaacgaacgtcacggataggcccttcgacgggagacgtgaccggagttatctagtgcttcgagccgtcaactcaccataaggcctgagcccatccatgtcgctagtccctaacagcgccttgtgagcatggacggccatgcaagtacatcagactcgggacctctgcggggtcctagctacacaccatccacagcactgctccacccacctcatagacaccggaccagtgggctgcagaccccctacaagcacaccgggcgcctggactactagctcacacgtcacccctctcacacaggaccgcggcctcgcatgcacggacaacctgctgcagctccctgcctcaggcgcaaagctatcggacttgttttagagccaggcctgggctgggctcatagacgcttcacagagccctgcagggcagctgtacacccagcagaggactccagccttctcggggcccaggcaatgggccagaagctgttgaccataccaggagtcactggagttaagggtctgtgctggggacctagtactaggcacataggcactcgtgcccacacattacccc

SEQ ID NO: 723007 - DNA, 128 bp, Homo sapiens
attcaagcttctaacgatgtacggggacatgtatataggtcctgatgccttctccaccccgcccctcgaccctgttgccacgttgtttcatgtgtttaaggtaagacagaaacccccccaagcaaaaa

SEQ ID NO: 723008 - DNA, 957 bp, Homo sapiens
ctgtggtgcattaaagtcaaagacgcgctggcgcactgttcagccacgtagccgtgtgggtagcacgaacctcttgctacagccttggtagaaataatgtggcgcctgaagagactttcgtggaagccgatcttttcggcggaatattagttatgccgcccgtcgctctgattatgcgccggggtgccccatattgtgaggataacatacaatgcttttgaaagaggagccggttgccttcttaacgagccaggtccggccgcaacattccgagaacgggctgttggtaacgtcgcacaattgtttatacggcacgtttcccacaccatggtgccagaggaagaaggttcacagcgccggttccaaaagccacccctcttggggttcgagtccccccgccgagggacgcaagcccggggtgcagaaaaacgccgtgtggggccgcgccacgaggcccgtggaagtaaaaatggggagccgcaatgtgggacagcgcacccgccctgttcagacggagacagaacgctccaggagagcaacagagcgctccaaagaggaaagcccaacctttgtgccgggcgaagaacactcggaaatacccctcggtgcccgcccgagacccacaatagtctttataatcccctataataatatcccgcggaatactccccaattccgcggaatcgagtagacctgtagtacagaccaggagcccaataggcgcccctctaaaccccgccacttggggcacataatggttacacccagtcgttgggataattccaaaggtgaccccccatctttgttgttgacaatccgcacattttccaaggctctaagtcaaggggggctcccaatttcaggcattccccggtgccccactgaaagagaaaaaaaatttttttggccccacaaaaaaacccccacccctagacccgtggtggggcgaaaaaaaca

SEQ ID NO: 723009 - DNA, 265 bp, Homo sapiens
taacatattacgacccgagctgatacgtttcaatagcatcaaaccaccttgatgatgggtccaggatcagctggcagaaggtgcgtggcagcttcttcccttcgtgggctggtggctgacttgctgaacttgcccgttgggtgggtcaaatgtacctagttaccccgacagcttcttcatcattgtcctctacctttcttgtgcccgctcggcaggccccaatgtggccctcccccaggcagcatgtgctatagagacttctaaa

SEQ ID NO: 723010 - DNA, 540 bp, Homo sapiens
ctggtctggaccaatccaagagcgacagctaaccgggaaaatcctagaatggcctgctgaaggctggtcctggccagccacaggcctgcttcctgttcattgcgaggtgtaaactgacgctgggagtggccactagatggcggcaaactcagccaagtttggcatgggcttccgttggcgctaccaactggcaagctgtgcaggttcctggcatccatttcattagcttcaaaataacgcgaccacgaatagttgattgaattttagaccccacgtaaaattcttctggacctcacttattgtgttggggcagggatttactgttctttcaattcacttggtctttaaagcatagagggcaggcagcaaaattaccctccacgtcctgacatctctaagggaataaagcttgggactgctataaataaggaaaacttgttaaagttcatgaaatcagctatggaaattgtggaacataagtcatggttccatttgttttatagaagtgtaaaaaatgaaatctgttcttcaagatagaaa

SEQ ID NO: 723011 - DNA, 153 bp, Homo sapiens
ctcagtcaagacgaccctgtgctgcctgagatcagccgtagtcgaatgagaactgtagtcagagaataactacatggtatactgtctggagctaatcctgtccaggtggaagtaaggagaatttcgatgatagtcagaggaaccgaagaggag

SEQ ID NO: 723012 - DNA, 322 bp, Homo sapiens
gcggtacctgcagctctcgtctgatgcaacactcattcctgctcaaccatttatttctacacaaatggatattcgggactttcaaatagttcaggccaagcgtggtggctcatgcctgtaatcccagcactttggtgggccaaggcgggcggatcacctgacctcaggagttcgagacaagcctggccaacatggtgaaaccccgtctctaccaaaaatacaaaaattagccagacatggtggtgggcacttgtaatcccagccacttgagaggctgaggcaggagaatcgcttgaacccagcaggcggaggttgcagtcag

SEQ ID NO: 723013 - DNA, 506 bp, Homo sapiens
ggaaaggttatagaaagtaaaggaactcgggagattcattaccccggttcagcacccactaccgtaaaagatcccaaacatatgactagaactccgtcacaccccattggaccaatctatcaccctatagaagaactaatgttagtataagtaacatgaaaacattctcttccgcataagcctgcgtgagattaatatccttaaatgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaaatagggacctgtatgaatggctccacgagggttcagctgtctcttactt

SEQ ID NO: 723014 - DNA, 107 bp, Homo sapiens
ctctagaggatcctgattaagcgcaggggggaccaggagcatgagcagaggcaggcaggtgggaggccatggagcttataacctcactacaggctcagattgctttg

SEQ ID NO: 723015 - DNA, 136 bp, Homo sapiens
acgtgtgaggaagtgtgctagattgactgcagattgaggataccagacccgagttgtctgattcacagatgaccagtcaatcagggacgtccgcacttcagatagatacgatgaggacgggaactgctctttaata

SEQ ID NO: 723016 - DNA, 865 bp, Homo sapiens
caagaaaagtgttaaagagcgaggccggttttcccaagggttcgtgccaacattaggccggtgtacaagaggaaggggtgggtaccacaaacctcgttgccaataagatataacctgtcggacccgattctatgccgattccgagaggaagtcgttgcacttgccccccggcagtaccaatgtttcagtcccagccgttttttctaatgcgggctgtaaggttgcctgctagaaccaagcggtttttggtccaggacgagcgatgggcgcagaggtgtacaaacaggcgagctcaaactaaggagccacaacttctggccaaatacacatttatgcagaaccacctgtctggcaacagactttgcgtacataaaatgttgcgggtgctgtcggctgttacatgtgtggggggaaacaatctctgtgggatagcgcactccattttggtacaagaaaaagttctatgtgtgaaaggtgcgaagctctggttggcccaacacaatcgctatttcatgtcaataatagcgcgtgcagttagagtacaacgactgcctcggtgagctaaggtgtcctcgtgcgcgacaaaagcggcgatgaggattctcacgcaccatgtttccaccaacgcgcgcgtgttatttgtcaactgagtgtgccattccacccactacttttgtccagttatacgtgagagttgacacgccttctcacgagaaacatacttctattttgatcttacagctcagttggttaaaaccatggctagacacacgcgccaaaacaggtgcgtccgagacgcgaatacccccccactccgcctcgcccagggcaaattggattttcccaaacaaacataacgcacaag

SEQ ID NO: 723017 - DNA, 1176 bp, Homo sapiens
cgactgcgcgccaatatcgatcccaccctcttcctcatccgcacattctccaatgtcatcagctccattgtctttggggaccgctttgactataaggacagagagctcctctcactgtttcgcattatgctagtaattgttccagttcacgtcaactccacggggcagctctatgagatgttctcttcggtgatgaaacaactgccaggaccacagcaacaggcctttcagttgctgcaagggctggaggacttcatagccaagaaggtggagcacaacacgccactggatcccaattccccacgggacttcattgactcctttctcatccgcatgcaggaggaggagaagaaccctaacacggagttctacttggaaaaactggtgatgaccagtttgaacctcttcattgggggcaccgagaccgtcagcaccaccctgcgctatggcttcttgctgctcatcaagcacccaggagtcgaggccaaggtccatgaggagattgacagagtgatcggcaagaaccggcagcccaagtttgaggaccgggccaagatgccctacatggaggcaatgatccacgagatccagagatttggagacgtgatccccatgatttggcccggcagagtcaaaaaggacaccaaatttcgggatttcttcctccctaaggggaccgaagtgtaccctatgctgggctctgtgctgagagacccaatttttttatccaagccacaggactttaatccccagcatttcactgaattagaaggggcacctaagaagagtgatgcttttgtgcccttttccattggacagccgaattgtttcggagaaggcctggccagaatggagctctttctcttcttcaccaccgtcatgcagaacttccgcctcaagtcctcccagtcacctaaggacattgacgtgtcccccaaacacgtgggctttccacgattcccacgaaactacaccatgagcttcctgccccgttgagcgagggctgttgcggtgcaggtctggtgggcggggcagggaaaggcggggtagggcggggttggcggaagaggcgggtataagatgggggaagatgcgggaaaggaaggggcgtggtggctagagggaagagaagaaacagaagggctaagttacttataaggtgcttcgagctggatg

SEQ ID NO: 723018 - DNA, 335 bp, Homo sapiens
gaccagccagctggccctccccggcgacctttgcatcgatggtgaactccacgcgcagtctgggaggcacgccagtggtgtggagcccggtgccactggccttcaccttgctggcatcatgagtaggcagcaccttgaccttgaaggggctccggggtacctcttcatctccatacagtactgagatgctgtagggcccttctcggctgggcacataattgacggtctgggcgccatcagcgttgtctaccacgtccactggctccaccaggcctttgggcccttgcactttgacctgcaatggggccacaccagccttgcttgtgtccacctgg

SEQ ID NO: 723019 - DNA, 705 bp, Homo sapiens
ttttttccaaacggagttcgctcttgtggcccaggttgggagggcatggccccgtttgtggtcagtgaacctccgcctccggggtccagcgattcctcttgcctcagccttccgagtagcggggattacgggctccgtgccaccacgcctgtggtaggaaatttttggtggtactatgactttgggatttaactctccagcttcaacagatacttctttggtccaataattctcaggaatgttctaggcagaacaccgggtttacccgtggtggatactcagaaggagtgtgctctaaggacttatatggcataatacatattcttttaattggcaatcctaggtactctaatagcatgagtggcctatagggagttggttgaacgtgcccttgtttttccaaagagtaaactttaccggattaaacaattatttcctatataatagatttctagaaacactgtggtttgtggtgcccagtctaaacgtgtgggctcactacataccccatgtgcaggtaccgtttgtgtaccattactcatttctgggatatccctttaatggggagatatttggccagtggtacctaaaaaactttcccagtctctaccttcatgatgtcgacattgaatgctcacgtttctatacaattttaccaggggtcagacacatattttataacttttattcaaagccaccaggggt

SEQ ID NO: 723020 - DNA, 333 bp, Homo sapiens
gcattgcagacgccatgtgtggaaatatgaggagaaatattccatcttggcagagaccacagaattggtttttttttacttatgtgctctggagggaactaagcgcacagaatctgtttgacatttgttatacatataggtgctctctcacctcccccatttctgtgttctttattcgtagcattgctgtctgcaagggagcccctagcccctggcagacatcgctgacttcagtgccccttttctctctgctagatcgatgttgatgcactggaggtcttttagcctgtcccttgcatcgcgcctgctggaggatgagagagctctgctggc

SEQ ID NO: 723021 - DNA, 726 bp, Homo sapiens
gggtctccaatggcatcactgcgtctgctggcttctacgctgaagttctgctactccccagacctcagggacaagtgtcgtggtgttcaggcttggtagcaggaagtacccagtgcctacatggctggacctcttctgcctcttacagacctgactacccgttcacccagagcacttgggcaagctgaagcatggtttgcctggtactcttgctctgggatgccattaaggagagagcaggattgctgttcttcctcgtctcagcggtgtgattaaacatcgagtgaagccatcgtgcgtatggaaaagacccatcgagattcttgtatgtacttagtgtttctttatttccttagtcctctctttccatccccaatatagtgcacccgcataagagaattttatcctgaagtaggcacagagcgtggtggctcacgcctgtaatcccaacactttgggaggctgaggcaggcagatcacgaggtcaggatgttcgatgaccacgcctgtaaccaacgatggtgaaaaccccatctctactaaaaatacaaaaattaagcgggtgtggtggcacacaccagtaatcccagctactcaggaggctgaagcaggagatttgcttgaacctgggaggcagaggttgcagtgagccaagattgcgccgttgtactccagcctgggcaacagagcagaccatctctgaagaagaatttgtttcctgaagga

SEQ ID NO: 723022 - DNA, 498 bp, Homo sapiens
  misc_feature (320)..(320): n is a, c, g, or t
  misc_feature (335)..(335): n is a, c, g, or t
taaaggacagaacggactaaagttgaccattggcaaatggggaaaaactaaaagatgagaggactggatcctcctctttcatgccctgtccacagtaagttatcacttctacttctctcatagccttcttctgcctcctggcaacaactattttcagaacacaatttactaccaatctctaaagacccttgaagctctgccattttatggttttatttgtatttcatccaatttcttttcaggagatgagaagcttcggtttcagaaatatcagagtcattttggaggagagataaagttttccttacctggacagattntatgggtgatatctntacaggaacaggcagcatagtgctgcccagaggggcccaccaggagcctgactcattctcctcatacataatacaaagtggtacaggccacagggaggcaccaagaaactgagccagcttctggagagacacaacttttttttattgatgaatgtctgttcac

SEQ ID NO: 723023 - DNA, 240 bp, Homo sapiens
tcgataggttatctgtttactctattgatattttcttttgctgtcagaagctctttagtttaattgagtcccacttgtcaatttttgtttttgctacaattgcttttgagaacttagtcgtaaattctttcccaagattgatatccagaatgctatttcctaagttttcttataagatttttacagtttgaggtcctaaatttaagtctttaattcatcttgggtcctatcaaaagacga

SEQ ID NO: 723024 - DNA, 574 bp, Homo sapiens
  misc_feature (566)..(566): n is a, c, g, or t
agctaggaagaaaggagtataactcctcaagaccaagctagagctgaactctgactcgccttaactgcagcattcagcttgatgtagcgagattaacatacaggcacgtggcaatgtaacgagtctgtattctttatgacccctaatgagcaaggaagctgacgaagtgcagggagtcaggagcaccttcagagcaaagacagtcagttgataacaatccactgaggagaataatgattccctacacttcccctaccccatgaaaaacagccctgccagaagatgcagatggcccgtaagatgactcactctgatgagctataacgccgctctcatttattaagctctgcactgaattaagggaaattgactacagacatggtagatactaactccagcatacagactatacacattgtcatggcacacccgacgaacccacagcaaagatggcatatgccggcgtgaagagagcaactgtcagagggagtctcggaaactgtcggatgggcgtgagtacataacaggcaaccacgatcgatgcgtattacagttgatgctcgcgntcattagg

SEQ ID NO: 723025 - DNA, 467 bp, Homo sapiens
taagtgtaaaactgtattttctttttatattttgcgatggagtctcactcagttgcctgggctagagtgcaatggtgtgatctcggctcactgcaacctccgcctcccaggatcaagcgattctcttgcctcagcctcccgagtagctgggatcacaggcacctgctgtcatgcccggctactttttgtatttttgtacaggcagggtttcaccatgttggccaggctggtctcaaactccccgactcaggtgagtcacccatctcggcctcccataatgctgagattacaggcgtaagccaccatgcccagcctgctttgtcattttggacagataattttgtagtctagattgggttttatttcacataacagtttttaagttctcaaatatagtctccttttctttaatggttactgacttaacgtgtaatgctgaattaggccattcttgtataactataagg

SEQ ID NO: 723026 - DNA, 565 bp, Homo sapiens
tgagcatgaggccaataagcgccacactttgcgcgaccatatgaaaagctttattccatcccatggtcccagggatgcttgtaggacgaaagcctgataccacgcttgcatcacggccaaggcagcaaacgaagcggatgctgtgacactggatgcacgttagacgcatgacgcttacctggctaccaataacctgaagcctgtcgtggtagaaatctatgggccaaaagatgacacacagactcactattatgctgctgatgcaatgaacaaggatacgggcttgcacatgaaccatcttctaggcacgaagtacatgcacacgggtctaggcaccgtgcactgggtggaacatgcacatacgcttactttactgtgacttaccttaagcacgctaacctcctgagaaagtagagagcaaattgctactcgggcagctgagcccttgtgcggatgggacggacttccccaactgtgtcaactgtgtacagggtgtgggtggttcaaccctcaccaaaaattatggttactaagaagccgtcaggagctggaagatagtgcttga

SEQ ID NO: 723027 - DNA, 810 bp, Homo sapiens
gacagaggtgtcagcgaaggtgtaatgagcagcatcccgacatgaatcagtaagtaagattatccaccatatccagcgtcaggaatttaacccataaggcagcagctctttttcagacaccctggaagcaatcgagcccccattgcagccatcatttgacacagaaaacctggcagaacaatctccatatacagcaaggtcatagagcggggcatcgttgacagcatcacgggtcagcaggcttcatggaggctcaggcctgcacaggtggcatcatcacaccacaagacacgggccagaagctgtcacttcaggacgcagtactcccagggatgtgattgaacaagacatgggcaccaggctgaagcctgctcagaaagccttcataggctatcgagggtgtgcacagggaaagaagcaagatgtcagccagcagaggcagtgcacagaacacatggctaccgtatgcaggctggacagcgaataccatggagattcaagatacctcacgggaggacctagaagacccaggcaagtgcatgggagagaacataagcaccagacagaagacacaccggacaagagggtaacatagaatgagcagcgagacggaaccaaaacgggatgcaacgaacacccacgaagacacatgccaacacatcacagaagcatgaccaaaaaaaacgcacacataaaagaaacctaaataaggacaggacacaaaaaagtcgcgccaacagatagcaaacaaaaacacaggggcaagaaccagccaggacgacacgacacacaggaaacacacgagaaacc

SEQ ID NO: 723028 - DNA, 652 bp, Homo sapiens
ccccgcggaggaggagaccccattctataccaacacctattctgatttgacggctcaacctgaagcttaatatacttatcctaccaggcttcggaataatctcccatatgtaactatactactccggaaaaaaagaaccataaggatacataggtatggtctgagctatgatatcacatggcttcctagggtaatatcgtagtgagcacaccatatatttacagtaggaatcagacgtagacacacgagcatatttcacctaccgctaccataatcatcgctataccccaccggcgtcaaagtatttagctgactcgcacacactccacggaagcactatgaaatgatctgctgcagcgctctgagccctaggatgcatctactgaacaccgacggtggcctagactggcatagtataagacaagtcatcactagacatcgaactacacgaacacgtacttcacgaagatcaggacactaggcactatgtcctatcaaaaggagcagtataggccaaacataaggaggcaacatacacatgactaacccctaagcccaggcacacaaccgagacacaagactacggccacaaaccaaaacaccatcatatacatcggacgtaaattcacacaacaaccaacacacacagacc

SEQ ID NO: 723029 - DNA, 908 bp, Homo sapiens
  misc_feature (38)..(38): n is a, c, g, or t
  misc_feature (170)..(170): n is a, c, g, or t
  misc_feature (356)..(356): n is a, c, g, or t
  misc_feature (358)..(358): n is a, c, g, or t
  misc_feature (373)..(373): n is a, c, g, or t
  misc_feature (379)..(379): n is a, c, g, or t
  misc_feature (392)..(392): n is a, c, g, or t
  misc_feature (395)..(395): n is a, c, g, or t
  misc_feature (414)..(414): n is a, c, g, or t
  misc_feature (417)..(417): n is a, c, g, or t
  misc_feature (419)..(420): n is a, c, g, or t
  misc_feature (436)..(436): n is a, c, g, or t
  misc_feature (438)..(438): n is a, c, g, or t
  misc_feature (443)..(443): n is a, c, g, or t
  misc_feature (446)..(446): n is a, c, g, or t
  misc_feature (464)..(464): n is a, c, g, or t
  misc_feature (467)..(468): n is a, c, g, or t
  misc_feature (471)..(473): n is a, c, g, or t
  misc_feature (479)..(479): n is a, c, g, or t
  misc_feature (484)..(484): n is a, c, g, or t
  misc_feature (497)..(497): n is a, c, g, or t
  misc_feature (502)..(502): n is a, c, g, or t
  misc_feature (504)..(505): n is a, c, g, or t
  misc_feature (508)..(508): n is a, c, g, or t
  misc_feature (511)..(511): n is a, c, g, or t
  misc_feature (523)..(523): n is a, c, g, or t
  misc_feature (528)..(528): n is a, c, g, or t
  misc_feature (554)..(554): n is a, c, g, or t
  misc_feature (556)..(556): n is a, c, g, or t
  misc_feature (558)..(558): n is a, c, g, or t
  misc_feature (560)..(561): n is a, c, g, or t
  misc_feature (571)..(571): n is a, c, g, or t
  misc_feature (577)..(578): n is a, c, g, or t
  misc_feature (591)..(591): n is a, c, g, or t
  misc_feature (596)..(596): n is a, c, g, or t
  misc_feature (599)..(599): n is a, c, g, or t
  misc_feature (602)..(602): n is a, c, g, or t
  misc_feature (610)..(612): n is a, c, g, or t
  misc_feature (621)..(621): n is a, c, g, or t
  misc_feature (774)..(774): n is a, c, g, or t
  misc_feature (778)..(778): n is a, c, g, or t
  misc_feature (781)..(782): n is a, c, g, or t
  misc_feature (792)..(792): n is a, c, g, or t
  misc_feature (812)..(812): n is a, c, g, or t
tccccccgttagattgttttaagtgtttgcttttcatnttttatagatgtaatctgattttcaaaaatcattaacactttttaattagtatcgactaagactttttccccctggaatcgaggttgtgtgtccgtcatcccagcccccggttggagcctgctctttgaacntgctgcgctcctcagcagcttctgtcctcttctgtgagtcagtcagcgagtgcttgggatccgcatccagccgtgctgggcacacaacaggctgtgtgtggaaatggccaccaccagtcgccttccccaccccaccacaaaaagagaagctgtgtctttagacaaccctgaggtatctgtgtaacnancgttctgtgtttganatttgngtaaagtatgcangcngtcttgtactgtgacctangancnnaactgtaactgcattngnaaccntgnaaaaattagatattgttntgnnacnnntagacngtggnaaatatagaaccntgaancnngcnccnatcccatgtctncccancatgaaggatccaaaaatgtttttcnangngnnctttgttccnctgganncttagagtcatgngtttntgngcngatttggnnnccttcctcngcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcntttncannagcaagtacnaaaggagaagaggacatccnttgaatgagtgtgttttgtacataacttcagatacttgtggacatgccttatatttgtcccaccactgtcagaattaagaacctttttaaatgaga

SEQ ID NO: 723030 - DNA, 469 bp, Homo sapiens
ggactcttgatatcagtgatgaaagtagtggagaaggaagtggaagtggctgtgagtatcagcagtgcccttcagagtttgactacaatgccactgaccatgcgtgggaagagtgccaatgagaaagccgacagtgctggtgtccgtccgggggcagaggcctacctcctcagtgtcttcggcatctggtgcctggttatgcagagagagtggagataattctcaaactctgagaaaaggtgttcatcaaaaagttaaagggcaccagttatcagtttgctagcatcctagggacttggctttttaaatgaagggacgagaatgtacagtttggagtatgtggccactggttaaggaagtgcggactgtgttgtctcattcagttttgggaggcacagggacggtgcattgagtgggttccggttcccccaaatgatgttaaatgtggcttggcacctaggggtaccga

SEQ ID NO: 723031 - DNA, 209 bp, Homo sapiens
  misc_feature (1)..(1): n is a, c, g, or t
nttaagctaatatgtcggtagtctggtttgtaggtgaccgaaaggtattcctagaaatgcattttgaagacctctttctataggtccacacggtgttttggtttggtgcggacgaccaggggaacttgaagataccgattcggtttcagacggttaaagtgtcgacgagggaacctaaagatcgattttcgtttaagagtcgaactaca

SEQ ID NO: 723032 - DNA, 971 bp, Homo sapiens
  misc_feature (504)..(504): n is a, c, g, or t
gctgtgagcagagtgcatcagccggacgagcagcggtggcggtcgggagcgatggtgaagatggcggcggtggccgttactacggcggcggcagtgagggcggccgggccccctaatgcgtgctcaacgactgactatgccggcgagcagcacggaggcggcggctggtggcggtgtgaggagccgtggtcggagggcggcggcgagcggttggggagaactacgatgacccgcacaaaatccctgtcctccccagttgttcacattcaggagcctgattgacggtgtggtggaagcagaccttgatggaggccttgcaggagtttggaacccatcagctatgtggtggtaatgcctaacgaagagacaagcactggtggagtttgcagatgtgttgggggcttgcatctcatggatgtaggcagacgaggaccagatatacgattggtggatcgggctcagcgtgccgttcagaatagctctaggcagagcgagaaggatcgnccctcggaccgtggggtacctcgtgagtgaggtcccggagcgtgatacagtgtgctttctcgtttaccatcctgaacctccagtttattcgatcacctacggatgattcgtttacactatctgtaagtccgttgatgggcctgtccagagaactcgtcatttccaggaagactggagttcaggcgatggtggaattttgacgtcagttcaaaagtgcccagcgggtcaaggcctctcgtgaatggggctgatatctattctggctgttgcactctgaagatcgaatacgcaaagccttaaacggcgttgaattgtgttccagaattgctcagggatacttgggacctacaccagaccccgagtctcagtggaacaggtggcgctggaggaacccgagaaacgccagaggaagcccctctcctggcgaattcacccgagaatattggcagggcccacggtgggtacca

SEQ ID NO: 723033 - DNA, 702 bp, Homo sapiens
  misc_feature (3)..(3): n is a, c, g, or t
  misc_feature (65)..(65): n is a, c, g, or t
  misc_feature (68)..(68): n is a, c, g, or t
  misc_feature (139)..(139): n is a, c, g, or t
  misc_feature (199)..(199): n is a, c, g, or t
  misc_feature (214)..(214): n is a, c, g, or t
  misc_feature (221)..(221): n is a, c, g, or t
  misc_feature (229)..(229): n is a, c, g, or t
  misc_feature (234)..(235): n is a, c, g, or t
  misc_feature (277)..(277): n is a, c, g, or t
  misc_feature (296)..(297): n is a, c, g, or t
  misc_feature (300)..(300): n is a, c, g, or t
  misc_feature (311)..(311): n is a, c, g, or t
  misc_feature (326)..(326): n is a, c, g, or t
  misc_feature (341)..(341): n is a, c, g, or t
  misc_feature (353)..(353): n is a, c, g, or t
  misc_feature (380)..(381): n is a, c, g, or t
  misc_feature (413)..(413): n is a, c, g, or t
  misc_feature (424)..(425): n is a, c, g, or t
  misc_feature (428)..(428): n is a, c, g, or t
  misc_feature (450)..(450): n is a, c, g, or t
  misc_feature (496)..(496): n is a, c, g, or t
  misc_feature (500)..(500): n is a, c, g, or t
  misc_feature (536)..(536): n is a, c, g, or t
  misc_feature (680)..(680): n is a, c, g, or t
tanagtaaaaattaagccaatttcaatcattttggtcatcatcccagtctttcttcccacttggnggnttgggcccaccagctggttttgccatgatgatctgatccactctaagtacagtgactgcagcattagtagngagtttgatagcccaatattttcccaggtaagtatctagaataccagcttccagcatgtnctttacagcaggganttcggcntcaatatntaatnnaacgtttttatttccttcttgatgtactgcataaagtttagngattacttcattggggttnngtncagggtttttngccagtgcgcggggnatagcttcaaatgcntcagcaaacttnttaatagcatactgtttaagtccaggnnatgtctttccatatgatgtgatttgtttgggnaattgaatttnngtngcgccaggtgcgggtacaagangtttatcccttgtaagaactttgaaagtattaacaccatcgtctantgcnctttctatgtgatccatcagattgtgttgtagagcntcgaagtactatggtagaaatggcgccatcttccttttcatgcttaaaaaccaccacctgagtatctccaacttctgagaggtaaacactgtcacagtgtcccatttcttcaaggacaggaggtgtcaatctaggaagagctgnagcaccaacagttttacaaagt

SEQ ID NO: 723034 - DNA, 524 bp, Homo sapiens
  misc_feature (360)..(360): n is a, c, g, or t
  misc_feature (471)..(471): n is a, c, g, or t
  misc_feature (485)..(485): n is a, c, g, or t
taaaattggcagaacttaaatagagagtatggagtaggtggcagtagtgaatcgtgttaatttcctgatttccatggttgtactatggtgacgtcggagcatgtcctgttcataagacacacactaaaatatttgggtgttattgggcatcatgtttatgatttaatgaaatttcaaaagggtttggttaatattgtgataatataattctaaaagttcattgagaagaaagggaatgggtaaaaatgctattaaagaggaatgagatattggagtttaccacctagagtgcttttaaccaagaatgtatactttagtcagtcctttattgtgattcttgtaggcaaaaaaagtattganttggagaaaaaacggctctctcaacctaaggcaaagcccaaaaagaagaaaagcccaccttgagaactcctgtaaagctggaatcgattgatggaaatgaagaagaaagcntgaaggagaactcngacctgttgaaaatggtgtgtcagaccagaaggggggag

SEQ ID NO: 723035 - DNA, 1223 bp, Homo sapiens
tgcacgagtgtttgcgtcgcgtggggcctgatcgtgcggggagcatgactgatatgtggttgtgttctccaagcgttgctcgctgtgcggtcgagaggcccgtcatgtggtggtcataacctcggtggggccccccgcgtcttctgttccgccgcgtggtgcgcgacggcggtgttgccggaaaatcatgcgtcccgcggctccccggatttttcgcggggaagttttacgacgggcctggttccagaagaaaggaggtgacccgcccccaaaaagggggggaacccacaaagtggtgagagggggcgcccaacgccctgtgggtctgtaaagggacacaggggtgcactccagtaagcgtggacagaagggccgcaacgccccggaccatctctgggacacccgcccccccgcaaaaggttaaatggagaggtattgttggggttaagacccatgggaaaaacggcgttttccaaatctggggaagaacatggggaaaaaggccaccaaatgcgcccaggagccattataggagccctctccaagaggcccctccaaaattgggccccatgagcccaccccgttttccccgtgtcttccccggttcctgcaccacaatgggcaataaataagaaagaaaaaggggaccatacaccacggaagaaaattgccccccaaacgggaaagaaaagggacaaccgcgaggagaagagggaggaatgaccacaagcacccatggacccccaggaaacctgtttgatgtaagagaagattgtatgtaaacaccagcctccagagccatatttttgcgtcccagagaagaagaccccgagggggaggcccacctgttcttggagaggagaacatcaccacccagaggtggcacccgatcttaccacaggtctctttttatctttgggataaaaataccattgaagagggatagatagctttatgacattccaggaccggatattaagtgtgaaccagaacccataggctttttatagatattttttttttacaccatattttaagccagactgctaaactgttctcctgtataagttatggtatgccatgagcctgtgtaaattttgtgaatatgtattatatttaaacccggccaccttggaatccccttaattcctgtaaaaagaccaatccatctccttgtgagtggaagtagttattctggaattaaaaaagaagatacctattga

SEQ ID NO: 723036 - DNA, 574 bp, Homo sapiens
agcgggggggggggcggagggggctcttggccgcacccctctctcgccgctctcccccccgggggagccgtcgcagcctctttgcactagtctctccgctctctcggtcatgtgaccttaacgtaaccggacaggaaaagccccgccgccgcccgccgccgccgctgcctggagacaccagaccgctggcggcaggcagcagcagcacgccagcgaagaggcaggaggcggctggcaggcggggaaggacatgcacaggcccgaggctgcccaaaaggcgcctcctcacacagcccccccgccgcagaagacaccggcagacagtgagtgtgtcccgttgaaacaactgacatacagcccgacatcttcagctatctcttacacttgatgtacactgggaagatggcgcctcagctcatcgacccggttcgataagaacagggcatcaagtttctgccacgcctacccgctcattccaggaagccagcctcgccagaccagggagccttttctccaccctgaccaagttttcccacctggcttctacatagtatggcatcagatgcaagatcat

SEQ ID NO: 723037 - DNA, 880 bp, Homo sapiens
gagatcagccaggcaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccggatgatcgcaccatgggcactccaagtcttgtgcaaacagagtgagattccggtctcaagaaaataaaaaggaaagggagaacaagaatataggctttatacctctttccttgtgtcttcaacgggcgcaatgaaaaatttccgtgaaatttcacaaaattcgggtgggaaataatccaaaaaaaaattttataaggtttacacaatattttacttcctttatagtaaaatgagtatacttaaaaaaagccttcaggggtatataatcttctaaacagtctacaattcagggtgcagtttacatttaaaccaattatgtcctctagtgtgagaaaccaaattaggcctattttcacactgttgtgttaggcctcagggcctaccaattggggtgccagataaatatgcggaagaaattacacttgaattgtgtaaaaacaatccgtttgggtttacaatgggcaaaatttcaaaagggccgtgtattcattgtaatctttgaaatattatttaattaaattctaagtattgaatgttggtgggccttaaggtacataagtactcagtttataaaactaattaatggtggtttaccaagctccttcttttaaaagtaattttaaaaaacatgggtttccaaaggattttatgtgtgaaacgttcaatgtggtacggatatgtattttcaatttattagcattggaatgggggaaaatgtgtacatggggg

SEQ ID NO: 723038 - DNA, 130 bp, Homo sapiens
ctgaggcggcggcgggagcccggtatggcgtctggtcttcgcgtcgtgcccgcggagccagacagctgacccccggacgcggggagaagatggtgcctagacggcctcgtggcccgccacgcgccgccac

SEQ ID NO: 723039 - DNA, 154 bp, Homo sapiens
atgttcagcctcatccgtcggctgtgtgatctcgcatccacgctgcgtggatcgatctcctactgatgcagctttatgcatcctacttcaggttgcagcgcccatgcgcgcgtgcgtgctagaacccgggcgctctgtcggccggccagtctgc

SEQ ID NO: 723040 - DNA, 643 bp, Homo sapiens
ccacggccccttccgcaggctcctccccagaccctgaacctgggctaccaggtgcgaagatacatgcagaaggtgaaaaaaccacctgatgaggactgcacgcatctgcatggagcgactggtcacagtcatcaggctacagtagggcgtgcttcggcgacatagggcagtgcaggcctagagactcagtggcgccgacatgggccgcgtgatggccgacgactggtaccacactgccatgtgcacatcgaacgagcacaatggtacataccaaatagagcaaccacaacggaaatgagcacgcacctgcaacgctgccaccaacacatgacaacaaggacccactcataacgagagagacgacacgaaccggagatagccgccacgcacagacactgagcgcaatgaactgagcacgaatatcacaacgcatcaaatcccaccacaaccatcagacactgacccccgagaaataataccccctgaaaataccccaagacaaacaactcacagaacaagtccgcaaccatacatggacaaatccccccaaacaaggagcacgaatcaccaagtgggggaccccagtgcaagacaaacccccaccaaaacaccccccgagcgaacacgcacacgaattcaacac

SEQ ID NO: 723041 - DNA, 816 bp, Homo sapiens
tgaatccttcacagccaattggaccaatctatcaccctataaacaacttaatgtaagaataagtaacatgataacattctcctccgcataagcctgcgtctgattatgacactgaactgacaattaacaggccaatatctacaatcaaacaaacaagtcattattaccctcattgtcaacccaacagaggcatgctcataaggaagcggtttaaaagaagtagaaaggaactcggcaaatcttaccccgcctgtttaccaagaaagatcacctctagcatcaccagtatcagaggcaccgtctgcccgagtgacacatgtataagcaggccgcggtaccctacaccgtgcacccggtacgcgataatcacgttgtaccttaattagggacctgtatgaataggctccacgaagggttcacgctgatctcttactcttgtaacccagatgaaattgacctggcccgtgaaagaggccgggcataacacagcaagacgagaagaccctatggaagcattccattgtattacattgcaaacagtacctaacaaagccactaggtcctaacactacctaacatcctgctattcaaaaatttgcgtgttaggggtcgacctcggagcagaactccagaactcgcgaagcagtaactatgctaaagaacttctagccagtcaatagcgacactactaatcactcaattgtatcccatataatcttgaccaatggaaacgaagttaaccctaaggggattaaccagtcggccaattcctaattctacagaagtccattatccaacgatccggggttttaacga

SEQ ID NO: 723042 - DNA, 132 bp, Homo sapiens
cgggccagtacgtgattgcagtgtgcagtctcgcgctcattgcagcctgtgcctcctgggttcaagtgactctcgtgtctcagcctctcaagtatcttgggattacattgcacactactcacgagtgcccag

SEQ ID NO: 723043 - DNA, 1118 bp, Homo sapiens
  misc_feature (879)..(879): n is a, c, g, or t
  misc_feature (888)..(888): n is a, c, g, or t
  misc_feature (892)..(892): n is a, c, g, or t
  misc_feature (898)..(898): n is a, c, g, or t
  misc_feature (902)..(902): n is a, c, g, or t
  misc_feature (904)..(904): n is a, c, g, or t
  misc_feature (906)..(907): n is a, c, g, or t
  misc_feature (911)..(911): n is a, c, g, or t
  misc_feature (919)..(919): n is a, c, g, or t
  misc_feature (921)..(921): n is a, c, g, or t
  misc_feature (923)..(923): n is a, c, g, or t
  misc_feature (925)..(925): n is a, c, g, or t
  misc_feature (944)..(944): n is a, c, g, or t
  misc_feature (951)..(951): n is a, c, g, or t
  misc_feature (953)..(953): n is a, c, g, or t
  misc_feature (963)..(963): n is a, c, g, or t
  misc_feature (979)..(980): n is a, c, g, or t
  misc_feature (982)..(982): n is a, c, g, or t
  misc_feature (986)..(986): n is a, c, g, or t
  misc_feature (988)..(988): n is a, c, g, or t
  misc_feature (990)..(990): n is a, c, g, or t
  misc_feature (992)..(993): n is a, c, g, or t
  misc_feature (998)..(998): n is a, c, g, or t
  misc_feature (1001)..(1001): n is a, c, g, or t
  misc_feature (1009)..(1009): n is a, c, g, or t
  misc_feature (1012)..(1012): n is a, c, g, or t
  misc_feature (1017)..(1018): n is a, c, g, or t
  misc_feature (1021)..(1021): n is a, c, g, or t
  misc_feature (1024)..(1024): n is a, c, g, or t
  misc_feature (1030)..(1030): n is a, c, g, or t
  misc_feature (1035)..(1035): n is a, c, g, or t
gctgtttcccgttgttcccgtactgtttgctctctaacgtcctggccatggttgactcttggcctattttcgtaccgatcctctacctacatatggtgtatctcacctttcttgtacactacgttaatgctcgtggtatactgccgttatagctcttggtgctcccctcgaacggggatgatcgtactatgatgcggccctctgtatgccccctttcgggtctgcctggaaaggcccccctatgccggtgctagggcttcaagttagtgggccgggctgctgtgcggaaggaatgcctctggtcccccctagcattggccatcctggagactcccacgaatcgtcgcctaaggtcccatggaccccgtggcggctgtcctgggtacgacctcgtcgtcttgtgcgctgcgtccaatgcaacgacgttgttccgcccaaggacagtcgacggggcacatggttaacctgaactatagtaccaggggcttgcgtgtgccatcgtcacccaacggtgggcctcccagtgatgtcaagtactcgtatagtaaacctacagctcatgctcgtcgacactgcacgtcccgatacgctgactgtggtttcggatcctggccttcctcgtgtaaccagttcgggaagcaggagccagggagtaacgaagagatcaaagagttcgaccgcgggctacaacgtcaaattcgatatgttcagcaagtatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccnggtgatagngaangacctncccnantnntttntagctcananantntgtggccccgcccgagccnctgccangnccttggagcnttccaccggcattatnncngccntncntnnaaacntgntggtgggncanacccnnaantcnagcgtncaccncgccggaggaagttcccatggcctgctgggctttgctcggcccccccacccctggctaccttgtgggaataaacagacaaatt

SEQ ID NO: 723044 - DNA, 267 bp, Homo sapiens
agaagttcaataccagctgttgctgcaaaaatttctctgctcggagcaaaaatgctctttttgaaactttcaactgggctctgtccatgggaggtacagttcctgtatctgagggattggaacactcagacttgctgatggcaaaggagaattcctagatgcctggcttatgctggtggagaaagatggtgaatcccaccacggtgcttgaatctccacattcctttcttaccctgctattggaacttctaaaaactaggggggaca

SEQ ID NO: 723045 - DNA, 1106 bp, Homo sapiens
gcagctgctcaccaccattgcccgcaccatcaacgaggtggagaaccagatccgtcacccgtcgacgccaagggcatcagcacaggagcagatgcaggagttccgggcgtccttcaatccacttcgacaaggatcatggcgtgggacgctgggagcccgaggagttcaaggacctgccgtcagtcagtcactgggcttacgtacgtggtagaacgaccgtgcagggtgaggccgagcttcaaccgcatcatgagcctggtcgatcccaaccatagcggccttgtgaccttccaagccatcgcatcgacttcatgtcgcgggagaccaccgacgacggacacggctgaccaggtcatcgcttccttcaaggtcctagcagggcgcaccaagaacttcatccacagcttcgaggagctgctgtgggagagctggcccccagaccaggccgagtactgcatcgaccgcatggcgccataccagggccctgacgccgtgcccggtgccctcgactacaagtccttctccaaggactatgatatggcgagagcgacatgtgaggcccccagagaacctgacgccaaaagaccccgacaggcctccagggaggggacatgggaagaacccacagagcaccaattcactccacatctgtatctatgcaaaagcaaatactctgagaagacctccgagggatgtaacaggagatgggacagggaacggaggatggggcaacggatcacttactcgtctacgcatcagagaagataagaacaaagaaggaacgccccggcacaggtagaaggaaaaacttaaggcaccaagcattagagatctgaaaaaatatgcactacaacgatagtcgatgtaaatgaccaaggaagggggccaagagaaatcacgccagagaaccaccggggtaccgtcccaagtaccccggggaagcgcccaaacacacaaggaaacatacatgctctgatagccctaaggaccaagtgctggacaagccaacatcaagtcaaggtagcgagaaaaaaaggacaaccagcggaccaaacagaagaaggaaacaagccgcacagcgacaaagccacggagacgacaaacaa

SEQ ID NO: 723046 - DNA, 621 bp, Homo sapiens
gtccccactatcctcgcacgaatttggctgaagtctgttcttgtgccacgagggccacgagaattggtcttattgggggccccccgcgttgtgaatagggggaaaaggactataatggggtcaccgagcacccacaccccgcttctataccgcctccacgtcaagcccacgcggcccactcactgcacgctcacgctgggaagcactcacttctcctcgcttttgtaacactaagggtggtggtgcccctcggcacacgtggccacccactgcacagttctacggcctatggctaaggagggccaaatcggccccggctctcgcctcgtgttttttctcccacacactaactttttctgaatatgaagggcacgcaacctgcctctgaatgggagaatcatgccactactcagaaagtgtcctcctcatctaaagctcatctgtttaatggtgatgccttgcgtaccggatctggttacctgtgcagttgtgaataccccgaggttgggcagatccatgtctctagtcctaccccgttttaaaagttcctggtaagatttgacctccttcttcccgccaattaaagtaattggtgactttggtaacaacaaagaaaaaata

SEQ ID NO: 723047 - DNA, 954 bp, Homo sapiens
gcgctgtcggatacttggggtgagcggaaagcatggtggggacctccgatgccaggtagcaagaggcggagtgagcccccggagcctcgtgcccggcctgccggccagtggcactcgggtactcccccgagcaagctggtgcccggggcttctccgcagccgatgcccgggagcctgacgaccgggttccgtccgcgcattgggtgacttcactgccgacgacctggaggagcttgacaccctcgctgtcacaggccctgagccaatgtcggccgcgggtcgggacgtgtccaggtgatcatagggtccaccaagattatcagatggcatgtcaaaaaaatccttcagggaaaacacagagaaactgtcccatattaaggcgatcacttctcggaatttaggaccggtacctttcagggcacaaagtaccaaagaggaaaccttaaagcggaacccgatgacctgtactcgcgacgaccgagagttcctcattgcacggacttggcgaacatttagcaattttggcggagacctacactacattcaggaccggaatccgttctacgagggacaccaggacgaacgattcacactttgcttcttgacgcaatggagaaaaccccaaggcaccttcaggtgacaacggaacccgtgaattctccagaaaagctccacttccttgggagtctggactccaggtttacacgatgcccgagattcgacttggcattaggacaaatgctcccagaccagttgaacgacccaattaaacttggttggctccctccttgtgtccatgggcagtcctaggaaacagccttctgggttataaaagcaggaagcctttccgccaacttggcgacaccttttttcctccaacgggccttagagcggaagttccttccacctgcgcaagggggggtacccctgtggggaggagaacccccttgaggg

SEQ ID NO: 723048 - DNA, 180 bp, Homo sapiens
tcatgacattgtaaatatcagctgatttttctgaatatcaacgtgtgaaaccaccgcacagtattttgactctattcgatcatcaagtgggttctttgaagaatccatgagcatgtacctagaaatcgtgactgcttgaatactgtatttacttgcactctagtcagacaccttcaaggg

SEQ ID NO: 723049 - DNA, 913 bp, Homo sapiens
  misc_feature (336)..(336): n is a, c, g, or t
tgaaatggagtcttgctctgtcacccaggctggagtgcgtggtgcgactcagctcactgacctctgcctccggggtcaagcgatctcctgcctcaccccctgtgtctggatatcggcgttgcacacccccaccaccccgggctaatttcggtatttttagtacgagagggggtctcacggcttgtgggtcaggctggtcctgaagcttcctgaccctcgtgatccgccctccatcggcctcccaaagttggtgcgatacacaggtgtgagccaccgccacctgtgcaggaacacgattttaaagctgctctgaagacctaatacgtgctccacacncatttaacaaagaccacgtcgctcgatacatcacgatacctcgcacgcgaggaaactaccactgcgtcaacaccccagctcacacccaactactcacgggcgccccacatactccgcagtagtcacactccttccgctacaacgacctcgccccgcgcacgcgcccgcgccccttggctccacggcccaccacccccactgccactcgccaccccaccccctcggtgaacgcagccacgcgccacggcacccggaacacccatgtgagcccccccccgcgaagccttcagacgccaaccgacccaccgaacgcacaccatccgctgcagacacccgcgcgccattcataaccaacacacactcacacccaacgcccctcgcatgacctccgcccacaccgcccagtctggcccccaacccaaccatcgtcacgtgacacacacccggcagaaatcccctacgcaccaccgccaacggtcaaggcaccagccgagcgcgcgagaaaccgcaccccccggccacccgcgcgccccgaacaagccaccttgcccccaacacacagaacccaccccagccc

SEQ ID NO: 723050 - DNA, 411 bp, Homo sapiens
catcttagaggactccccgcccgttgacccgtgccacggacctgcagagtgcccggcatgccatctgatcaacctacatatgctacataagggccagatagcgaccatggtgatcattgaatgactggtgatcttatggcaaggttcgatggatcgagtggtggcaaatatcttcgagctgaacctgcaggaccagcgattcgttaactggggtaaccatctccttcctgctggaatcagtgaccagacagaacctccactcaatacaccagaacacagagagtatctcgcagaacttatgtgtgaatcatttaacgtaccatgactctaccttgcagttcaggcagcgctggccttggcggcctctcggacatctcgaccagtgggtaaacgtacgtcaacggggatagt

SEQ ID NO: 723051 - DNA, 352 bp, Homo sapiens
gtttccccccccccccccccccgggttttaggggaaaaaaaacccattgggggcccctgggccccttaatggatcccccctgggggttggggttaggccccggggaggaaagggggccccccttttccccccccctagtcccccaaaacttttggggggggggttccccccggggggttttttttttttaaaaccaaccccttttaaaaaaagggccccgttgggggttttccaattttttggggaaatgcttttttttggtttttcccaaggcccccccccgggaaaatttttttcccaaagttttggggggggggtttttttttttttaaccaaaaatttttggggggga

SEQ ID NO: 723052 - DNA, 794 bp, Homo sapiens
  misc_feature (359)..(359): n is a, c, g, or t
  misc_feature (392)..(392): n is a, c, g, or t
  misc_feature (410)..(410): n is a, c, g, or t
  misc_feature (427)..(427): n is a, c, g, or t
  misc_feature (472)..(472): n is a, c, g, or t
  misc_feature (487)..(487): n is a, c, g, or t
  misc_feature (490)..(490): n is a, c, g, or t
  misc_feature (498)..(498): n is a, c, g, or t
  misc_feature (511)..(512): n is a, c, g, or t
  misc_feature (516)..(517): n is a, c, g, or t
  misc_feature (520)..(523): n is a, c, g, or t
  misc_feature (527)..(527): n is a, c, g, or t
  misc_feature (530)..(530): n is a, c, g, or t
  misc_feature (537)..(538): n is a, c, g, or t
  misc_feature (542)..(543): n is a, c, g, or t
  misc_feature (549)..(550): n is a, c, g, or t
  misc_feature (555)..(555): n is a, c, g, or t
  misc_feature (560)..(560): n is a, c, g, or t
  misc_feature (562)..(563): n is a, c, g, or t
  misc_feature (569)..(569): n is a, c, g, or t
  misc_feature (585)..(585): n is a, c, g, or t
  misc_feature (592)..(592): n is a, c, g, or t
  misc_feature (597)..(597): n is a, c, g, or t
  misc_feature (600)..(600): n is a, c, g, or t
gtctcaaactcctgacctcaggtgatccaaccgcctcagcctcccaaggtgctggcattacaggcatgagccaccacgcctggcccatctcttattttagagaacctttctctgttcatcatttaggttgacataatcaatcctcacaacagccctatgagttgcggggactgttatcaccctactttatagggtggaaactgaggcataaagaggctagctccaaaccaaactgctgataaataggagagccagtgtctgagcttgagcccagcctgaatcactgtgcagcgtcatctttcgtcagataaaagaatgtaagaggctgggtgcggtggctcacgcctgtaatcccagcncttcgggaggccgaggtgggcggatcacttgangtcaggagtttgagaccngcctggtcaacatggcnaaaccctgtctctactaaaaatacaaaaattagccaggcgaggtngcacatgtctgttgnccnagctactngggaggctgaggnnggannatnnnntganccngggaggnngagnntgcagnnagccnagatngnnccactncactccagcctgggcnacagagngagantcngtctcaaaacacaaacacaaacacaggtactccctggggggccacgggatggagcagaagcgaatgactcaggtgtggggccaggtaccaggctgtcactgactggtcagaggcacgggaggcccctgtgcaacaggtgccatcgggccatgaggcctgaacaacgaaccgcgccagccaacgggcagatgacc

SEQ ID NO: 723053 - DNA, 529 bp, Homo sapiens
cggctcgccttctgcgtggagttctcgcggtctgggtttcgctgtctgctcttgtgcccggggtcattttgtcggcgtcgtggtgccctctcttgcccagctggtggcacagcgaggcgtgccccttctcccgacgacgttcgatggagtagggtcccagaccgttgtccctgaatgagcgagatcgagcttggcccgctcccgccccctccttccctccctccttccttccgccgctaacatggctaacaacaagcccgcgctgacaggcaactcgcagccgcagcaccatggacggatggcatgcatgctggctcatgcaatcagcatgcatgttgctgtgtcgtgctggatgtgctgctagccaaagccgggctggtctcctgtgcgaagcatgtggcagatgttgctccctgctcatggggcaactgagaagacacatgaacgcatcaagctcccatgatcctagaccaacaatcctgtcagtcgccttacttcaaatgtacagctctactagctcaagacctac

SEQ ID NO: 723054 - DNA, 542 bp, Homo sapiens
tgcaaggtgataactaagccggcaagctgcctttcaacactcatgcagtcacgttgtccacctgagattctcaacagggtataaaaggaaggtctcatcttgcctcacaggaagagtgggctcagtgtggctttttttccaactatggagaaactcagtgctcatctactttaagtttccacatatggcttgctcatagccttggtccttacctttcctgccataactttctagaagagcttaatgggatttttttttctaaaaaatgtaaatatgcagttaggcattattttatgtaaatgcattgggtttttactgtagcatttggcaataaatggctttgggggtgatgaggtggggaaggattcagcaggtggttcagtagtcaagaagcaccggccgccaatgagaagtttcagtctttggctttagccatgcctctgaaggtcattggatgcaacgcagatgaggtaggaaaaacacaagcagtggagccaagtggcatatgtgtacggaatcaatcaaaatgtcacttgatgttc

SEQ ID NO: 723055 - DNA, 127 bp, Homo sapiens
tctcctcgcgtagggtgctcagtcgttgtctggtgtagtacttcaatggccagtcttccggtaggctttcttgaggcgactcctccttgtgttcaggtcattgttgctgttccctgtgccgcacccg

SEQ ID NO: 723056 - DNA, 271 bp, Homo sapiens
ccgccaaaagcccccggaggagttaaatgtggatgttgcttttgcccccacggggggatttgagtccagctcccccccagatgaggtgcagcccccccgagagagctttgcccgtcccccagtaacccggccccagcctccagggccccaaatccgcccagcctctccccgctttgggtcctgccctctaaccctcggctttgctggtcatgggaagaacagaattggtcccgcctgccactaattccataaaactgtcttgtgggctgga

SEQ ID NO: 723057 - DNA, 341 bp, Homo sapiens
gcatgtcttaccatacacactgtggctagataaatcaaagtgaactttgatgatgttcttacttgcatttactagaaatctgagaaagactgtaatcagtctgtaaataattatcttgcgtaacgagaatagtagagcacaatatatatatatcacaaacccaatcacactctatgtaacattacagcatggaattgacttaatcagcaataacagcacactggctgaagaatgctgtatcattagtttctcactattacgctgatttctatgactggcatgaattattagccttttccattagtaggcatgtgctctgctgctctgatggcaccacggac

SEQ ID NO: 723058 - DNA, 390 bp, Homo sapiens
  misc_feature (26)..(26): n is a, c, g, or t
  misc_feature (349)..(349): n is a, c, g, or t
tgtcacctaggctggaatgcagtggngtgatctctgctcactgcacctccccgactcaggtgatcttcccacctgagcctcccaagtagctgggactacgggcatgctccattatgctggacgaatttttgtattttttgtagagatggagttttgccatgttgcccaggctagtcttgaactcctgggctcaagcgattcacccatctcggcctctcaaagtgctaggattacaggcatgagccaccacgctcttacttttaagctaaaaaagaaaatcttaaatcagtaaatcttactctgaagtcatagtcccttctacatccctgtcttatgtctcccacgtctncctagaccgtccactcctccacagggtacccgaaggcttcg

SEQ ID NO: 723059 - DNA, 122 bp, Homo sapiens
ggatatttaattttttttgatgtattaaatgttaactatgtggtcagataatcccattttactttagtaaccagaaaattgtaattcttagtgtctaaaattcacacattaaactcataggt

SEQ ID NO: 723060 - DNA, 873 bp, Homo sapiens
gctctctttggcctgaggttctgtattctgggaaaggtatacagggtgtgacgtagtggatggaagctgccccaggaggctggatgtagtggtgtgacaagacgagtgcagacaggtcgtcgtcgtctgcccagcagcaatgggctgcaaagatagtagaactcgtggttgcttatggatcatgtgtgtgatttgtgcaagccaggttcaagcccttggcctcaggaaatcagatagggaccaatataagtgtccttccaccttgtgagccaagcccccatttgaccgacactctatcagtattcttgtgtgctggcgtcttcaaatagaattttcaacatgattcttagatgtcacacaacttgtctgctaactagcaacggaagaacaccttcttctagctgctgcaatttgcctaccctccctcaggtgcacattggcgtagctccagagaccctggtcttatgagacctatgtgtgggacacctggtacacgatgcgcctttctgcgcgatcagcagcagcagctgtatacctactaactatgctacagcctaaagtcctccggattctgcattatccttccaaacacttccttatcactctgctgcaatgttgaaaaagcgcaggccacgccttgaaacaacgttgcatgccaaaccgcgcgtgcgcatttactcggcccaaggccatgataggcatgacacgcatggcccaacagtgtcgttgagacgagacacgtcgtttccgggttatggtggcaagcactggttgtcgaacacaatgaatcctaccgaaacagtgcgcctaccatgatgacacgtggtgtccagcagacacagacatgggattcagctcgtaagcaagtccacg

SEQ ID NO: 723061 - DNA, 161 bp, Homo sapiens
aaatgaaggaaggagctctgtctgtactacagcagttcaaggaaagtgacttatcacatgtcagaacaaaagtgcatttgatgtggagtaatcaggatcgacataagctaccaatcctgtctgaaatattccatcaagtctttctgcaaccaagggggagg

SEQ ID NO: 723062 - DNA, 975 bp, Homo sapiens
attgtatgactctttctgttgtgttgtgttacgtgtgcggttgaagtggttttttccgtgtccgccatactcgtggtgcgcgcttccgtcactcgtgggaccagccccctcgagtgttctgcgcccggttgtcagcccctttgtagccgtgtgtcgcctctagcagctgtggcaatggttctctctggagcctccctgcgcatttctctgtggccccttaaagatggggtttctccctctggggttccggcacttccccgggttgtgtgcccctctctccgccggcggctctggtagtttcgcaactttgtgcccccctcttctggcggagtggcaaatggttgaactcttcctatttggggcggtcttttcgtccccccgtgtcatatttggggggcctttctcccccacgtccatagggtgcgtccgccgcctaagcatgccccatcaccagctctgtcgtgatgaaccacaggcccccacggtgtgcccggttgtccccctcgcaacgctcttttccagagacgtcgttcttctcctccgtgccgccagtttgatgctcgccctgaattcacctgggaaaatgcatagtcgagatacaaacattcgatgtgaagaactcatctgatcatccatcatttagcaagcggcgggcttccgctcccacccctccctactatataagacgttctttgcgcacccctcataaagagacatcaaagagtgtggttaaaactatttctatctgcccaaagcatccacacactgagtatggtccccaattagtggcttgccccctcaaacattttttacaataactcgccgccctttaagattacatttcccttaggccgccttcacccacatatttaatcgagtttttctccacaccccccgccccctatcatacgttgggcgtcccatcctttccccccccaaaataataattccttttccccccgaccacaaaacaca

SEQ ID NO: 723063 - DNA, 309 bp, Homo sapiens
gtccaagagacatcacacagaaacattccaagcctgtgataaactctctcaccctaaaaccaatataaactcttagtccataggagcaagcactcctaaccaaaaaaaaaaaaaaatttgtccaaaaccccttttaaggtttattctcaaaaataaactcgtcttttagtgtggagccatttttcatgtatcttttctctttctttacttcttacttttggtgctgaacccttgggatggttgttggggatacaggctgtcttgcatcccaggtagcagtgcacagcagctgctcatcccgctggactc

SEQ ID NO: 723064 - DNA, 708 bp, Homo sapiens
tggaaatgatatcatttacgggggaaggcgcttggtgaagtaggccttatttctcttgtcctttcgtacagggaggaatttgaagtaaataaaaaccgaccgggattacctccggtctgaacctcagactcacgtaggactttaactcgttgaacaaacgaacctttaatagcggctgcaccatcgggatgctccgtgactccaacattcgaggctcgtaaaccctatgtgttgatatggacctctagaaataggatgtgcgcgtgttactccctagggttaacttgtggtcccgtgggctcaagtttattgggaattcaagtggagtattagatagtctcggcttgtgacgtgggttgaagtcttagcatgtgttacgtgctcggaaggtggggtctcgtgcttccgaggttcgccccaaccgaacatttttaattgcaggttgggtagttctaggcaccgtggtgggttggtaaggtacggttggctttaataaatttaaagccccatagggtcttctcgtctggcgtgtgtcatgcccgcctcttcacgggcaggtcaatttcacgggttaaaagtaagagacagttgaaccctcgtggagccattcatacggtccctattaggacccagtgattatgctaccttggcacggttagggtactgcggccgtaaacatgtgtcctgggcaggggggccccaaacggc

SEQ ID NO: 723065 - DNA, 1206 bp, Homo sapiens
  misc_feature (1206)..(1206): n is a, c, g, or t
tcctactgcgttctggtactgctgcgttgtctggctgcctgcttgtggtgtgacatgttatgcacgcagcgcctggttgtattggcgcagggttggatgctgtggtctgaacgagggtgcgtctgtgtgcgcgtggactgctgacatgtcttgcctgtcttcgtgtccttctgggaacgtagtgctcttgtgagagcctgctctgtcggaggacaccagacgttttctcgacctctcgggagcgcatactggcgcgcaaggactcgccatgtgccgcgcgaggcgtgcgatgggcgtcgtgttggcgccacaaccccgagcgcgaagtagctctcgcgatggtgacctggccaccagttgtgtcttatattggcggtggcgcgctctgcgacccgttgggcgtcttgcgggacgagtggccacctttgtgagcgtggctaggcggaatgggcggggactgagttgcacgcgtacgcgcacgctaggcaggtgcacttacgtactgctcaaatggctatcccgcctgtggatagcacgcgcgcccacattgtggggcggcgatcctcgggtgcccccctctttgttcccctacccacgcgttgggcgtcgccgcgtgggccttcgcgggggacggctccgtcgggtgggacttttgggcgtacccctcgagggtggtcgcaacagcttttgtaatccaagaagagggaagagaggctattggtctaaaccacaaatactatctggacagaggggcccacagactaatttggtggtgcgcctgttggcctcctcacaaggccatggttgttcatgagacatgctgtcgtggcgaccgagtatatgatgcgaacgggcactttagtaaacacccgtcaaactaggaagacttggggcgaatattgctgatgatttcccatcccgtcgttggcgaccaagaccatatggccacaatgttggagaggcctcccaaacctcatcataatgtaaccctcttctggctctacgttctggagatcgcgtccccaaaagactggtattctgttataggaccatcccgtcgtcctttttgtattgcaacacaccaccccagagaggttgacagaaaaattaccatgttcgccacacatgttgctaaagagtggtgtgatcgacacgttgcgccgcaatatctaaaactacacaagaatgagggagagagcatcaccn

SEQ ID NO: 723066 - DNA, 141 bp, Homo sapiens
  misc_feature (131)..(131): n is a, c, g, or t
aattccgatgaggggggcggcaagtggtcataacacccaggcttctgctgtggaagccactgactcctgtcaccctttggaggtgaactgaatttccctttcagacaggcgcggtatggagctaagatgtnaaacctctct

SEQ ID NO: 723067 - DNA, 726 bp, Homo sapiens
  misc_feature (50)..(50): n is a, c, g, or t
  misc_feature (92)..(92): n is a, c, g, or t
  misc_feature (94)..(94): n is a, c, g, or t
  misc_feature (105)..(105): n is a, c, g, or t
  misc_feature (108)..(108): n is a, c, g, or t
  misc_feature (111)..(111): n is a, c, g, or t
  misc_feature (115)..(115): n is a, c, g, or t
  misc_feature (131)..(131): n is a, c, g, or t
  misc_feature (133)..(133): n is a, c, g, or t
  misc_feature (144)..(144): n is a, c, g, or t
  misc_feature (160)..(160): n is a, c, g, or t
  misc_feature (167)..(167): n is a, c, g, or t
  misc_feature (190)..(190): n is a, c, g, or t
  misc_feature (192)..(193): n is a, c, g, or t
  misc_feature (222)..(222): n is a, c, g, or t
  misc_feature (231)..(231): n is a, c, g, or t
  misc_feature (243)..(243): n is a, c, g, or t
  misc_feature (246)..(246): n is a, c, g, or t
  misc_feature (252)..(252): n is a, c, g, or t
  misc_feature (275)..(275): n is a, c, g, or t
  misc_feature (303)..(305): n is a, c, g, or t
  misc_feature (312)..(312): n is a, c, g, or t
  misc_feature (316)..(317): n is a, c, g, or t
  misc_feature (319)..(319): n is a, c, g, or t
  misc_feature (322)..(322): n is a, c, g, or t
  misc_feature (329)..(329): n is a, c, g, or t
  misc_feature (334)..(334): n is a, c, g, or t
  misc_feature (345)..(345): n is a, c, g, or t
  misc_feature (358)..(358): n is a, c, g, or t
  misc_feature (361)..(361): n is a, c, g, or t
  misc_feature (376)..(377): n is a, c, g, or t
  misc_feature (383)..(383): n is a, c, g, or t
  misc_feature (423)..(423): n is a, c, g, or t
  misc_feature (432)..(432): n is a, c, g, or t
  misc_feature (434)..(434): n is a, c, g, or t
  misc_feature (439)..(439): n is a, c, g, or t
  misc_feature (466)..(466): n is a, c, g, or t
  misc_feature (477)..(477): n is a, c, g, or t
  misc_feature (501)..(501): n is a, c, g, or t
  misc_feature (522)..(522): n is a, c, g, or t
  misc_feature (611)..(611): n is a, c, g, or t
  misc_feature (725)..(725): n is a, c, g, or t
cttgtgctgtggagttccgcacactgacctgggagacacgggtagtgganggagaggggggggggggtctggcggggctccggcagtggctntnctctccatggngcngtncgtntttacagcggggcgcntnggggagcgtcntttcagcggagttgcncataggncctgggagcgggaaggcgccagntnngggtcccagcagggcctccctcaggccanaacgctggntgtgccttcagnggngtgagngcatttccgagccagtgtcaggngcggggcatgctgggaccaggggggccnnncgcttgntccnntnggntcactcnggggngcgcgacaaangatttagtctttnaanagcaagacacttagnnattgtncatttgctcccaggtgaggagaagcttcgtttaagatgangtgcgtgtntnttttnttggtaaaaagcaaaggggaaaacccnaccattggcangagggcactggagaggcttatgtncaacgacgtgtcgcgcgaggntggcgcgggattggcactcactccaaaatttctttggagcagagagacagatcgtccagataacaacttttacactcagcaagccaganacaaaaagaccacctgaaaaaaaatatgttttgaaaatctgcatttaaaaaagaatactcaactgcatttgaaattttctggatttttttctgcgaaacaccacgagatttggnc

SEQ ID NO: 723068 - DNA, 259 bp, Homo sapiens
ggctataacggtgtcgagaggtagtatgtgccgtgagtgatagcgtgctgggcgggtagcctcatctgggtgatgatagccagggtggggataagtgtggtttcgaagaaagatataaaatatgattagttctggtggcgtgacatgttataagttaagtgagattttgtagcggagattgagtatagacgaggtagacgttatttctcgtgatagctggttcactgtgataatgtggcgttggacttgccagtgatgt

SEQ ID NO: 723069 - DNA, 106 bp, Homo sapiens
atactggagggctatagtcaatcaaatagctatactgatagaaaaatagacacacagattaatggaacagaatagaaaacccagagtcaaagctgcatacttacaa

SEQ ID NO: 723070 - DNA, 281 bp, Homo sapiens
cccctgtcctaccatatacacccaaaccccagaggaatccccaggtacattaaagtctgtccctgttaatgcttcctcagatgttcttgggggtaattcttattttttcttctcagtttgttggtgagaattgggggtgattatctgaaaaatattccggtataaatcaacttttctaacaccagtttgtactatctacagagcctgaactacccccaaaagatttggacagtctagtgggacctgaaactaaataaataaataaataaccctgaaagaga

SEQ ID NO: 723071 - DNA, 365 bp, Homo sapiens
atacattgacgatagaattacggaacaactttaatgaaggaatgtacccatatacatattgaactttattcatattgtattatcaaggtatagactttttaggttatgatacagttaagccaaaaacagctaatctttgcatctaaagcaaactaatgtatatttcacatttaattgagccgacttatttccacaaatagataaacaggacaaaatagttgtacaggttatatgtggcatagcataaccacagtaagaacagaacagatattcagcagaaaactttttatactctaattcttataataattaattttgagaaacaaagataaaatcttgatacccaggttgaagtgcaaggaaaa

SEQ ID NO: 723072 - DNA, 789 bp, Homo sapiens
  misc_feature (693)..(693): n is a, c, g, or t
  misc_feature (777)..(778): n is a, c, g, or t
tcaaaaagataatccaccatgatcaagtgggttttacaccaggggatgcagggatggtttaacatccacaagttaataaatgtgatacaccacacaaacagaattaaaaacaaaaatcacatgatcatctcaatagattcagaaaaagcatttgacaaaatctaacatcctttatgattaaaaccctcagcaaaattagcacagaaggaacatatcttaaggtaataaaagctaactacgacaaacccacagccaacattatgctgaatggggaaaagttgaaagcattttccctgagaattggaacaagacaagacactttcaccacttttattcagcatagtactggaagtcctggccagagcactcaaagagaaagaaataaagggcatccaaattggtaaagaggaagtcaaactgttgctgtttgctgatgatatgatcatatacctagaaaaccctaaggattcatcttgaaagctcctagaactggtaaacaaattcagcaaagtttcaggatacaaaattaatgtacgcaaatcagtagctctgctatacaccaacatcaaccaatagctgcagaaataaaataaaatacttaggaatatacctaacgaaggacatgaaagacctctacaaggaaaactacaaatcactactgaaagaaatcacagatgacacaaacaaatgggnaacacatcccatgttcatgaatagggtcaatcaatattgtgaaaatgaccatactttggtagatttgcaaaaagcaatctacanngtcaatgcaat

SEQ ID NO: 723073 - DNA, 123 bp, Homo sapiens
gtgatgtctcacagaaaaaaaaactcccccgccatgggtccctcggcttcctgccttggggggcgcacgtttcggccttgtgggaaagaaaaggaaaaaaccttagggttgcccctccccgga

SEQ ID NO: 723074 - DNA, 153 bp, Homo sapiens
aaccttcaggtcatccctgtagactgcagtgcaaactcccctcttatcatgtgagcacttcctggtaaacgctcgataatcgagtcacaggctttctccagctcggtccccattatgcccacagactcgccccacctgcctgcgaacctatga

SEQ ID NO: 723075 - DNA, 1238 bp, Homo sapiens
  misc_feature (1)..(1): n is a, c, g, or t
ngtttagtagtaactagagtgcgatgtcagatatgtatacgtctgatgttttttgtctatatactgttgtagttatacatctaatgtttttcttgcctcctacttcattttgatgtgtctctcatttgtctctgctatgtttatctgtctttctatcactcatctgttacacgttttttgtttctaccaccacctctttgttttgttaattatgtcgtgttgcttctatccaccaatcttatttctcactttttactattgtagtatttcgctcaactgacaagcaaacgccaacttttgtcttgtgcgttgaatatctttcttctcgtggtgcccccgttgttgtgttcctccccgaggggtgcccccgttgaccacccatgttttccctatcttctatttttgttgtccgtccttttttcgtgtggccgaccgcgcctggtgtgcccccccccgtggtatatattaattttattctctcccttctgcttttctcccaagtggtagtaattgctcgtccatggtcaccaaattttgggttacaacttggacccaatggaaacttggtaatttaaggaaattttggggagaagccccccgagtacacaccttgctctgtttaaagctaatcaattgccttttttctttattgttattatgtgtcacacagccgatgggaagcaatttatttataagttctggggataggaaacttttttgcccgtaccttttacacattcccgagtttgtgcttgacttcactcttgactaagacacgatgaggaatatttcctagagatttgtttttagtcttatttggatcctgtcaccacctgcagccttgttattgtcctcacgctcgttctcgtgatcctcgggaacaaacgtggtgactgagagcttccccacacccccatctctgaagaactgggaactcccactaaagacacgccaccctgagtccctacgcctcaagcccccacggattgcccttccacctcgccacaacccccccgtggctccgcacccctagagaaaaggtgttgttgagtccctaaatatggtgatagaggcttttgcactactgccgcttaggctgtaattagaaaatttgttgagatgtcacaataatccaggcttcacatcacaaatgttgagaaactaattttttgcacattgtatcattatttgtatatttcataacttagaagactgagttaaatacccactattaaaga

SEQ ID NO: 723076 - DNA, 784 bp, Homo sapiens
tctggctaccgggactaaaatggaagcgttttgggggtcgcggcccggacttggggcggggggtccggccccaggaaagtttaaccggcatttcgggtcacactcccgattccttcagtgggatccgggcgttcgtgaattttacaggaggtccaattcacggcggacccagaaaccccatgtgtggtgaccgggacctaacagatccttcgggggttaagttctcgagggcggaggtggtgatgtgccgacagaaaaatgtgtcgtgggatctcccaaagcggggcctcccttgtggattatcgatttcgcggcaacacattcttctttcggcattatatgtggccgatgtctcacaacaccacaggttaccaagtggtgtggggggtgccccttcgtgggggcagaataatagcgcgcgtgaattttcttcccacgaataattgtgaaaggacaaaggtttctctcgtcggccgagaaagttggtgtgaactgtggagtgaagcggagacttctcgtgggggagctgtgtgcaccaccgagcgtttgttgtctccctaagaaagccttattccatcttcctagtgaggtcttagcacctgagggggccccgtgttacacaaggcgcggggcgccctgcggaagttattgaccccctctttggggggggcacacccctcttgtgggtccatttgcggaggggcttattgcctggaatcgggaggaggaggctttcccctcgggtatattgctggggcccatcgctttggggttgtgagcccat

SEQ ID NO: 723077 - DNA, 1601 bp, Homo sapiens
tatgtcaacgctgtgtttctctcttgtcgatgttgttgtcttcgcacgatcgttggtttgtgggctcccctgtatgtttgtttgttgttatgttggcttgctggagtcgcttctttttttttgttgttcatcgccccctcggatggtggtgttatttctcggtgccatctatgttgctccttccttattttgtccgcatagtggcggtgttcctatactcccggtttgtttatttgcggccctctattttggttgcgtcaccacttttgcgggggggggcatcgttatatcctccactcctctgtgttactacaatactttttctgtgatctagtgctattcaccgggtggttgtttccactccgtttggggaacacccttgggggacgcccctactttttttgggggtgtgttattttggttgctcgtttctcgctgatgatccttcttgtggtgtgtggggctccgaaactcacacattggggggggttgctgctcccctgttatacacctcttggggggggggttttctcttatcagtagttttcctcctggggaccgcgctgtttgtctctatctcatcgtggtgtctctggatattgttgtgtgcgcttaatacactagggggcccccacttatgtttcgggggccacactcgccacggcttcctggcatttttggcctgtacataaacggggaccccacgtcacggtgtttttttgcgagacactggtgtctctctttggtgggacccacttgttccacccacaaggggcccctgtgggtctctgtgacaccaccttggagacattccctcggatggtgtcctcttctcccgagtgtggtttctggggtgccacagcgcgctttggggcaatgggggtcaacaatcgcgaggggcccccgcgttccccacgttttaatttctaaacggtgggccactttggcccacactttccatttgtaaccccctctctatagagaagaaagcctgtgagagggttctctcgccacgctttgccacagagaagggccccagcgagagtctggaggtatcgcgggaacacatcaccctttttctctccccccgccacatgtgagagaatgcccactctctcccacagggccctctctcccacaccgtctggtccacaaacacacacacggagagagagatgtgggatatggaggaaaccctggcgccaccctaagggacacacacagagggggagggagagagaaagtgagaagagaagccccgcgggctaccgccgcgacacacaaagggagagaaagaggccacacagggggtctccccacacagagagagagaattgagcgccggggctgtgcctcacggtgggccacatgcctcatgccctgagccccgtggagaagcacttttgcgagatggagcacgagactcacacacacctgagaacactataggagagtgccccactttgttttgtgaaatttaaaatggctgcaatcccccccacacctttccctgacccctgtatatagccccgcccggcccccggcagggcccacaccttttccttttgtttaattaagccctggggtcacctgtggaaaaa

SEQ ID NO: 723078 - DNA, 543 bp, Homo sapiens
aagcagttaatacatgatagtttgtgacttgatgcgtgagcgtcgctgatcttcccagcctgttcaccaaccccaaatgctaacattcagaatggaagcttcgtgtacatgtcaatatctagtcacagccgatcgcagggcgggatccgcaggtagttgatcatggattagtcccttaccttgtcggggtactctctacaggctgatttaacgagacaaaaggaagctgtatgggcctgtgccgaactataccagtggtggaacagttgaacagattgtgtaccttgtcactgtggcataatagaaccgttgatgaacctcttaactgcaaaagatcccaagattattctggttatcctgggatgccatttcaaatatcttacaggctgctgagaaactaggtgaacttgagacacttagtataatgattgaagaatgtgggggcttagacaaaattgaagctctacaaacccatgaaaatgagtctgtattaactgcttggggaaccgagctcaaatcgcaatctggtctagctctaccatg

SEQ ID NO: 723079 - DNA, 200 bp, Homo sapiens
  misc_feature (5)..(5): n is a, c, g, or t
agtantgacacttgagtgtctggagctgaatgcctggttgtcatccggcagaggttcctcggcgggggcaggcctgactgtctttggtgtgctgcaggccaagcaagtgcaggaagcccttctagtccagggcgtcaccaggcaggagcgtggcctgcgggcttattcttgacccctggtcttgccgccacattgggtct

SEQ ID NO: 723080 - DNA, 655 bp, Homo sapiens
cgatgggccggataccgcagaatgatagtctagaaaacatgtaagagaagcagaaagacgtctacatgataagaggagacgagtcggcaacacgagcccaacaagaagacacacacgagacacgatccaccatgaggaatgacagcacctttttgaccacgaacatcaaaacaaaataagccaacaaaaacaacacaaaagagaatcaaactaagagaaactaacaaacaagcaccacagtaagcacacaaacatcatacaagaagagcaagcaaacacaaagaaaacacacaaaaacacaaaacacacagaagaacacaaagaaaggagaataacaagaagaaccgacacgaaaaaagaataaaacaacagagaagaaagaacaaaagagaagcacaccgaaagaagacaacaacacacacaaaacaagaacacaaaaagaagaaatcaacagaagaaacatcaacacaaagacaatagaaaacaaaacacaaggacaaagaagaaacaacccaaaggaaagacaacaaacaatacaaacaaaacagcaaaaataacatgacagaaacgaagaaagtacaagcagaagatagacaccgaaaacgatagcaaaacaaagaaaaacacaaatgagaacaaaaaacacaaaaagata

SEQ ID NO: 723081 - DNA, 203 bp, Homo sapiens
gcctctcttctagttattttgaaatatatcagtagatcgtagctaataactatagtcactctaatgtgctatatgagcataagaactttatagtgtctaactgttagtactcattaaccaccctctcttcatcctcccccacttccgcctacacacccttcctggtctctgatatctatcgttacactctctacccccatgag

SEQ ID NO: 723082 - DNA, 998 bp, Homo sapiens
  misc_feature (223)..(223): n is a, c, g, or t
ataccctctgaaacactcatctgtaatagtaggatatatgtgctatgatcatacgaagtactatataatttagggctcaccgtggaatagtgcctctctatgtatagcttatcacaaggatccccacgtattcgtgtcgccacattatggaacctactctccatagaatccctgctaagcatccaacaatagccttcattcagctccaaacttggtgatgccntgagtggtcacttcttacttgattaattcgagcgcccggacgtcacattgacccgagtggtgcttatacctcatgactcaatcgctgaagctgctcagctgcaataatgaacgtaaaagacttttacgatcacaattatcattatcatcatgaggtccaacctgacttagggcacattcggttcgggaggctattattaaagcttggactgaatcctgcattattctcttttgctcttggttggacatcaacatccattcagcgcacaccaaaccttggtttcatgttagcgagtccatccggtgcttgtatctttacatgtctcatataatatgcccatatagtttgttcctatggctggtctctactcgcccagcagaacctaagtgcccccgtgcactcctgagtattcagaggagcaaattactaatccgtctaaaatactgctgaatcaaagtcctctgtgcattcgggcacactatgcacgacaagttgggagcattattttccaggattatttgacccctgtctactcttttcactggtttttgtggcttattccactccgaagagtcctccagtagcatttaaacccccaaatgaagttcggttccatttctcccctcatccacctttgtttttccctcatctaggggttcaggccgggtggtcatggcacacccctgggtttaaccactgggtccccccagggctttccgttaaagcggcgagcgcggtgtgttccccttcatggttccagtcggcgcgacttggg

SEQ ID NO: 723083 - DNA, 212 bp, Homo sapiens
tactggttgcagcggtggtttgaaacggtgaatgctggacaattgtaatgggtatggagacatgtcatattagtaatgctagggtgagtggtacgaagttttttcataggaggtgtatgagttggtcgtaacggaatcggccgtatgctgttcgaattcataagaacagggaggttagaagcagggtcttggtgaagagggtcttggtgtgg

SEQ ID NO: 723084 - DNA, 132 bp, Homo sapiens
gtcgttgtactcgtcctttctccagggtacttaacccagggtactttcccagggtccttttccacagggtcacttttacacagggtggcacagtcccagcaacattgtcagttcatacttcaacactcaagt

SEQ ID NO: 723085 - DNA, 590 bp, Homo sapiens
gatctagtaggatcccagttcgaggagtatctctccgtgttcgaatctctgatgtcaataaggtcgtagagcgatggatggattgccttgccctatagttgctttgcgattcatacggttgcacttctgtgtggatctgataaatggcgaatgaggctcgagctccttatgaaggatttccgagatacattgcactcatagggcctttctcccgtgtgaatcctctgatggagaataagtaaggagctctgactgacgcctttcgcacactctgtgcattcaaaaggtctctctctggtgtgaactctctggtgcctaatcaggtctgaactgtgactatgaaagccttcgcgagactgcacacattgtgaagggcttttctcctgcaatgaatcgcgcttgatgctcaatgagacctgactagtgaatgaagtctttcgccgagacacagttaagacgtagagtctctctccaggtgtgaattctctgatgctccataaggtgtgagctctggtccgaagtcgtttgccacactgatcgcacgtgtaaggtagcgtccaaggatgcgaaatgcgatgactaagtaggtc

SEQ ID NO: 723086 - DNA, 359 bp, Homo sapiens
gaccttgatttgggtggcattgtatgcatttgctacattatgtggtgggatgatctgtgtgttttgtggggtaggctgtcacaaaaaggagagattcctgagcatatattgagcccaaatactgtgagcaatgagaatgagtttccattttctttctttttgttgacccttttcctcaccctctctgctgtacacagagtaggaaagactgtcatttgcagcacagacagaaaatgttccagggcttgtgccattgcagaaaccccttcctcccctgaaactggtcagctgtctaatcagagaggcacccagaccacgacgtggctcctctccctgcctctgcttgttcaggcaccatc

SEQ ID NO: 723087 - DNA, 966 bp, Homo sapiens
  misc_feature (12)..(12): n is a, c, g, or t
  misc_feature (61)..(61): n is a, c, g, or t
  misc_feature (65)..(65): n is a, c, g, or t
  misc_feature (131)..(131): n is a, c, g, or t
  misc_feature (399)..(399): n is a, c, g, or t
  misc_feature (414)..(414): n is a, c, g, or t
  misc_feature (441)..(441): n is a, c, g, or t
  misc_feature (495)..(495): n is a, c, g, or t
  misc_feature (516)..(516): n is a, c, g, or t
  misc_feature (553)..(553): n is a, c, g, or t
  misc_feature (592)..(592): n is a, c, g, or t
  misc_feature (598)..(598): n is a, c, g, or t
  misc_feature (615)..(615): n is a, c, g, or t
  misc_feature (622)..(622): n is a, c, g, or t
  misc_feature (656)..(656): n is a, c, g, or t
  misc_feature (666)..(666): n is a, c, g, or t
  misc_feature (721)..(721): n is a, c, g, or t
  misc_feature (730)..(730): n is a, c, g, or t
  misc_feature (759)..(759): n is a, c, g, or t
  misc_feature (814)..(814): n is a, c, g, or t
  misc_feature (819)..(819): n is a, c, g, or t
  misc_feature (881)..(881): n is a, c, g, or t
  misc_feature (888)..(888): n is a, c, g, or t
  misc_feature (921)..(921): n is a, c, g, or t
ctgtccaacccnctgaacccaggagacagggcaggcaagaaggagagcccagggagaagcnaccncaccaagggaaaattgtgggagccggaagaggtagggggagacccagccatcctgttctgacttcnagcaattccttctgcccccagtcatgaggggctccctatccccccatcccatggtcccaggtgcagcaatgagagaggggaagggaagagagaaaggaagacaagtaggtgccaggggaaggcatctctgccctgcatagctatatggccctggccatgactacaagcaaaagtgggtgcagaaggctgggccaagggctgtggtatggagtggatactcagtaggcatggttggcaatgtagagtaactttcccgccgccccaccanctcctccactgcctncaaacttgccccgggccgcaagcactntcacctcagcccgcctgaagaactcctcagtggcagccccagcattgtcccgtngccctcgccaggaattgagtncagaggcttgcagggcacgcccataggagaagggaanctcccagggtcggggaagggggcagcggttgaaggcatnaaggtngaatgaagcctctcctncgccctnacccccagacaggaaggtcactcctgggacagcngggggcacanttcgacgcagggcagttacagttgccatggcaatctcctctggggtatacttgangggacaggnatggcccggggtcacatgttgggcttgancagggtcccctccaggtatacatgaaggtcactcagggccttgtacacagcagcnaagancttctctgttacatactgacaacgtttgagggcgtggtctccatcaggcaatatttcaggtnccacaanaggcacaatgccattttgctgggagagactggnataaggggccagcccgttggcgttctccagaatggcaagttcaga

SEQ ID NO: 723088 - DNA, 680 bp, Homo sapiens
  misc_feature (189)..(190): n is a, c, g, or t
ggggcggagcgggaccccagccatggttgaaggaataggacggcccataacttgtgctcggttcgaaaggcccacctttttcaaggttggggtacccctaagaagtgtcagttggcgcgctcaaaatggtggggaacctgcccctatgggaattgggcccatactgggggtaaaccaagctgtgctctnncgggggggcctgcgacatgtctcctttgtgctggtcaatcagcacgtgttcgccgttggtagcctcatcgttcaagaagtggtttatatcccagagagagctattcattatcgcttcctgaagcgtgtgggccatgctctcagagtctgtgtccagatagtcttgcactgtgtgcatcagcactgcatactatcgtcaacgggtgcggtcgagccctgccgttgtctgtggatgcgatggacaccctcacgcgtgctcaaaaggtctaggccttcttggctgagccctctgcctttgtggcttcagcccctgtgagtgctggcaccccatctgctcctgctgaggctccagccccagataaggttcatgtcaagcaacactcggaggagtggttccagcatgtggtatttggtcacgtggactaatcacctcacggcacacgacttaagcagttttctttgctatacaaggaaataacggcgtacttctt

SEQ ID NO: 723089 - DNA, 107 bp, Homo sapiens
atcaagctaggtgcatgatgaaaaataattagacccagttctgactccctgtttgttagggcttttattagtacttgacatggctgagcagaggaaaaaacagttat

SEQ ID NO: 723090 - DNA, 405 bp, Homo sapiens
taactgcaggtatataacatcttatcaggtctcccatggctaatcaggaggataaagcaattttatagattactacatggtccagaatctacgcatcggatgtatcctatttcttctactttacttgatacatacaaaagcaaccactgtattttcttcaaatgtaaaaacgaaaaatagatacccatgccaaaattcatgcgtgtaaataggccaacagagccaaacttacaaagaaaatgaaatgacttgtttctggacagtggttttattggtaaagatataagacatattggctctattacaaactcaggtaataaagcactaagcttgatttttgtattgctacagtctctttcttctaaggggaagaaaatctccccaacaataggatgctacctgaag

SEQ ID NO: 723091 - DNA, 400 bp, Homo sapiens
gaggagctcacattgttgacaattaacccaatccaagagacctgcataaatcaatcactacagggaaaaaaaaattgttcttgatctacagtgacaaatgtgtagacaaggatgctgactgctatgctgtgaggaacccaagcagcccagtggggagatccaagtgttgtaaagaaccgaggcacctcaccaatagccagcatgggcttgctggtcacaagagtgtgccatcttggaagcagatcctccagccccagtccagtcttcagatgactgcagtcccaactgtcattcgagttcatgggagataataagccagaactacccagccacaagccactcttgcgttcctgacccacagaaactgtgtgagataataaatattagttgttgttttaaa

SEQ ID NO: 723092 - DNA, 132 bp, Homo sapiens
tgatagcttgagtcacaaatgtctgcactgaagctgaatcactgtgcaggcccacggccgtgtgtcagcagacagtgaaggagggcctgggctccatgctgagtccacctctcaaccctggacagtcggggc

SEQ ID NO: 723093 - DNA, 391 bp, Homo sapiens
gcggccgctactactactaaattcgcggcccgtcgacgtcgaccgcgtcgacttttttttcttggagacggatctcgctgtcgcccaggctggagtgcaatggtgtgatctaggctcacagcaacctttgtctcccgggttcaagcgattctcctgcctcagcctcctgagtaggtgggactacaggcacacaccaccacgcccagctaattttttgtattttagtagagacggggtttcaccgtgccgcccaggctggtccgaactcctgagctcaggcaatccacccgtctcagcctcccaaagcgctaggactacaggcatgagcaccgcagccggccaagagtttacttttggtatgtctacacgaagaaacatcggtcgacgcggc

SEQ ID NO: 723094 - DNA, 329 bp, Homo sapiens
agagaaaattgcggatcatcttgatcagacaagaaataagatatacagcagtcaagtttaaaacagtgatattgcatgtataggatgcacaagtttcctttatcttgatgaccggcttctacgtggtgaatatgaagatccaaggggctcagtgacatgaggagagagaacgatagatagtgctgtaaacaggcacacactgatcggggaggcaaaatctgttgcctctaaagtttctacagttctgcacatttcaactcatttctcaggcctgctgagagcaattaggtcctataattggccatgatgactccatccgcaatcttctt

SEQ ID NO: 723095 - DNA, 870 bp, Homo sapiens
ttggacagtttgtgagagagatacttctggggtgtcctccccagacgccgttcttgtgggacacgcgcgccgagaaccacttctgagtcctgtgcaggggtctccccaaacccccctgggcgttcgagacccgccgaaaggcttgggcgccctccaaaagggctcttccgccgcctttttcaaggctttcccgccgccacctttttttgggcgcccccccctcctttctccgctgagctcctctgctcctcctctggggcatttgcgttgaggtggccttcctctgccgcccgcaattatgggcttccaccacgccaatcgtcccctggggaccggctgcccccccaagggtaccacgaacagctacggggcatccccagacctgcctcgcccggagtcaacgggggacctccaggagatgctgcgaaacccgccctgcgcgagaacaaccggggcggggcaatcggcttcgacccacggagcaatatcccccgaggatgcaccccaggggcgggtttctaccccacacagctcggcgccaccgagaccgtcgtcgacgacagaatgctggaggacccaccccgccacaaagcaaccgaccccaatgcggtggggctgcccggggaattagcggtgctgcatacacctgacgcggcctccaagtcgtggattatctcttagggctcctcggttatacaaggcagagagatgacagtgatatcggcaccggggccttagagctgggctcacactactcccaaaggatacgtttggggtttcaccaggtaaacagagtttttactggcgttctacccccgagagaaggagccaaagcagagaaacaggccgttgttaacaaccaaacataac

SEQ ID NO: 723096 - DNA, 755 bp, Homo sapiens
  misc_feature (118)..(118): n is a, c, g, or t
  misc_feature (167)..(167): n is a, c, g, or t
  misc_feature (205)..(205): n is a, c, g, or t
  misc_feature (219)..(219): n is a, c, g, or t
  misc_feature (240)..(240): n is a, c, g, or t
  misc_feature (244)..(244): n is a, c, g, or t
  misc_feature (249)..(249): n is a, c, g, or t
  misc_feature (255)..(255): n is a, c, g, or t
  misc_feature (259)..(259): n is a, c, g, or t
  misc_feature (261)..(261): n is a, c, g, or t
  misc_feature (267)..(267): n is a, c, g, or t
  misc_feature (278)..(280): n is a, c, g, or t
  misc_feature (287)..(288): n is a, c, g, or t
  misc_feature (295)..(295): n is a, c, g, or t
  misc_feature (298)..(298): n is a, c, g, or t
  misc_feature (308)..(308): n is a, c, g, or t
  misc_feature (315)..(315): n is a, c, g, or t
  misc_feature (322)..(323): n is a, c, g, or t
  misc_feature (331)..(331): n is a, c, g, or t
  misc_feature (342)..(342): n is a, c, g, or t
  misc_feature (354)..(354): n is a, c, g, or t
  misc_feature (406)..(406): n is a, c, g, or t
  misc_feature (409)..(409): n is a, c, g, or t
atctgtttcatgtctaggtgttgtgggtgtggctgttgaaggaagtttgcagtcttgcagcttttattccctgtgcaacaaaagattagaacatgttaaagggatttttaaataaagntgcaaagagtacaaatgataattggccatgcaaataaaaactgatttgntgatttttttttaaggggggttggcagttgattatgtnctggatgattccgnctatatatgtgtgaataatgnaagnatttnacagcntgtngntttttnaattaacgtannnaatgctnnaaaatanatntatattcagntaaccgntttcagnngatttttngaaagaaacanaggttaaatggnggattaaagtttgagagaccctttaaaccattgccagcatgcacaatgcctntgnttctgcagttttagaaactcgccgtcacttataaaccctcttgccccttttcactctacagaatagtgcacattcttcttacattccaatcagcagattttcttgcattaaattattgcaattccacactactctaccttgatatactgcgctggaagacttagcactgcatcgttcatgcttcctactcaatgctgtctcgcatttctctcctcgtcgtcatccggcctcgaccaactctctatactccttactctatttaatcgcctcctctcttctctcacttcatatctttctactgtccttctgcttctcccttctttcttctacctcttcctctcccccg

SEQ ID NO: 723097 - DNA, 615 bp, Homo sapiens
  misc_feature (383)..(383): n is a, c, g, or t
aggttcaggcgattctgctgcctcagcctcccaagaagctgggattaaaagcacccgccaccaccatgcctggctaatttttgtatttttagtagagatgggattttaccatgttggctaggctggtctcaaactcctgacctcaagtgattagcccgcctcagcctcccaaagtgctgagaattacaggtgtgagctaccacgcccagccaaaaaactgcaaacttttaaaaagtggcttttagttaactaaaaagatagttctttaaaatgaagaagaacaccaagtttaacccaataggatgaaactgtagagcacagatgcatcaactggtgttcatggacctttgaatctcctattaatattctattgaaattttatntaaatgcatgcatctatgtatgtatatttctttagtaatttttatcacattttcaaagtgagttcttaactcaaaagatgcattctactaaggcattctactaaggggattcccattaagatcaggaataagactaatgtgcccactaacactgctattatttagtattgttctagaagttcatgccagtgtaattagaagtaaagcagaaattaaaaggaaaaaaaaaaaa

SEQ ID NO: 723098 - DNA, 278 bp, Homo sapiens
aaggcgcacgatggcgcgtacatacaggagagaagccctacaagtgccccctctgccctatatgcctgtggaaatcttggccagcctcaagcgtacatggtcgcatccactactggtgacaaaccctttacggtgtagcctattgcaactaccagctagcaaccatgagcatgacacctcaaactgtcacatgctgctggcacacatggcgagaagccctatccgctgtgccaccttgcgccatataccactggtccacgtgggacaacactacaatg

SEQ ID NO: 723099 - DNA, 556 bp, Homo sapiens
taaggttggagggggaatgcgggagatggtaaggggtatggagactgtgtcatttaagtaatgctagggtgaggggtaggaagttttccataggaggtgtatgagtgggtcgtagcggaactcgggggtatgctggtcgaattcataagaaaccggggaggtttcaagaagtagggtgcggggtgacaacagtagtggtgcggtgtcgaagtccagggggagaggtggccgctcactagtggtgggtcccctaggagagatgtggtccgtgcgtggaaggttcgtgtacaacaaagtcacgggtgtgggtattccgcaggtagagaacgaagtagggcgacgaacggggccgcgggggcgattcaccgacggtggaacgcctcgaccgacatacgatgacgcgcacccgccctctcgcgcaagggcgccacagggtgcttcgctggggacctcgagcccagtggggtggagacacacatcactcctcatcgggccaggcgtccctattgtgcgccgtaacctaccaaaagggggcgtgtgttagagcacagagaca

SEQ ID NO: 723100 - DNA, 659 bp, Homo sapiens
gggcgcacgggccgtgacatggtggcccggcaggccctgctgctcgcggtctaagtcgccgcctgggccagtcggcgtgccgctgctgctgccactattgctgctgcttctgcgcgcgcagcccgcatcgggagcctggccggtgggatgccccgtggcggcgaggccccggggtcgggccaggtggctggacatatgcggggcagccataacccgttcaccgtggatctgcgcaccggtcgctgggaaccaagacccacagcggcgtctctgatgctgtctccagggatccgcagcgcgtgctggagtactgcagacagatgtacccggtagacgtgcatgagttgcacgatgtgtgagcaggcatacgcaggccatctcgccatggtagcgctggtgcgggggttcccggagcggaagatgagccacagacaccacagacagacaggttgtgcccttccgctgcctgcctggtgaatttgtgagtgaggccctgctggtgcctgaatggctgccggttcttgcaccaggagcgcatggaccaatgtgagagttcaagccggaggcatcaggaggcacaggaggctgcagctcccagggcctcatcctgcacggtcgggcatgctcttaccctgtggctcggatcggttccgtgtgtg

SEQ ID NO: 723101 - DNA, 361 bp, Homo sapiens
agctctctctctatgtatgtatctctctgtctctctctctctctctgtctgtctctctctgtgtctctctctgtccctctctcgcgcagagactgagccgattcgaaaaaatactcagtccaaggctgatccgtacgtacacaagatgactggtatatggagatggcaagcttgtctgcggggctttttggtcttaagcgcaactgctattatgccgggcctcctttccgtacccggtgaaaccatcgaatactgattgcatagacacccgatgcactgacccatacatgactagagataactctatattctagctgtcatctgcatacatatacctcgtgcatgggagagcagcatagtc

SEQ ID NO: 723102 - DNA, 279 bp, Homo sapiens
taacacaacactgtcctccttgtattcatgggagctacattaacgcactcattagacttatgttgtatgcctccacagatgacaaacctgtactcccatcacatcctcccacagcgtataataatccagtttaagcacgatgcagctcccaatagtgcttctccggttctctcatgtagagcaacgctggatccactggctccttctacagggtctataagaatctcacagtagcgaacatcttaatagagccacttacaagccaccacacagcaaaaa

SEQ ID NO: 723103 - DNA, 362 bp, Homo sapiens
cccttttttcccgaatttgcaaaaccctttaaaaagcccctacttttagcccttttttttcagcaaggggtcatttttcccgaaaaattttgtacccaaataccgggttatttaaccaatgtaaaatttctcatttttagtgaattaaactttcccgtaattttacatctcacctcctttttatgatgctcaggttgcttaattattggccaacctaatggtaaaatgtttttactgtattagagccttacttttcggttttttaggtatttttcccgtttttttggggtgcttggcctcaattttccctattttatctttttaaaataaaatatcatgcctgcttctggtttgtttttgga

SEQ ID NO: 723104 - DNA, 1150 bp, Homo sapiens
  misc_feature (838)..(838): n is a, c, g, or t
gtgataagtgtccatgaaatcttcacaatttctgttcagagattgcagtaaagacaggcacaagaaattataaaagtatgaatttggggaactaataaatgtccatgaaatcttcacaatttatattctgctgcggcttcagccagtccctccgtttggggtccctgacttcctgcaacatatctctgcatccatgacctaaatatgtgactcctctattctggctgcacccagcttacaggaagattatgacattttgctaagtaaagtgtatcttgtgctgatctcctatgttattctgtgactaagaatgcctaacctggggttgcagcccagtaggtctcagcctcgtttcacctcaacactattcaagatggagtcgctctggtttgaatgcctctgacatagagatccattgtaaaattatgaaaaaaatttatttgaatgcagtgaataagaaatggaagacctaggatgggctattctgaaagatttagcaatatttgtatttgtcaaaatttaagttttccgttaatacttctgaatagatacattgttttattctgtcaagtttaaatagatacgcttgataatacaaggagttcccactgtgaaagaaaaataaatctcctgatgccaaaattactaatccaatagaaaagtcaagctggagactacatcaggcaaacctgtttcctattttattcttaaataagatagctacacagataaaaagctacatacctacctcacaatttgctcagaaggaaattcctagtgaatagatgacagacagaactcaaagttatctctctgaggctcacctgagacaaatgcngatctgtttgtttcctctgccctattaattttaaaatggcagattcactgagccaggctaaattcgtgtattcagtgggagacttatcaggactcaaataaatttattatcttttctcttatctacttatggacgggggaagcccccaactcaagtttcctggtcttacctgacacaccatgttcatttttaacatgttatggatgctctgatttctaaatgtttaaagatggacccaacacctgggacggcataagacccgagggggacagggccaatacactggggaaaactccattctgtgcaacaagg

SEQ ID NO: 723105 - DNA, 281 bp, Homo sapiens
tacatttctgtttcctaatggtaaaatttaggccccaggcgtggtggctcatgcctgtaatccccagcactttgagaggccgaggagggcagattgcttaagtctaggagttcgagactagcctgagcaacacagtgaaaccctgtctacaaaaactacaaaaaaaaaattagccaggcatgttggcccgtgcctatagtcccagctactcaggaggctaaggtgggaggatcgcctgagctcaagaagttgaggctgaagtgccctccaacctgggcgac

SEQ ID NO: 723106 - DNA, 401 bp, Homo sapiens
  misc_feature (20)..(22): n is a, c, g, or t
  misc_feature (27)..(27): n is a, c, g, or t
  misc_feature (34)..(35): n is a, c, g, or t
  misc_feature (39)..(39): n is a, c, g, or t
  misc_feature (46)..(46): n is a, c, g, or t
  misc_feature (49)..(49): n is a, c, g, or t
  misc_feature (54)..(54): n is a, c, g, or t
  misc_feature (380)..(380): n is a, c, g, or t
  misc_feature (387)..(387): n is a, c, g, or t
cacgaggatgcgcaggcggnnntgccnttcagcnnttcnctgcggnggntcggncagctcagcgccaccgtggcccggtcggccgcagtgaacagcacgtgcaggcgcggcgccgaaggatcgtcggtgaaggcgcccgcctgttccagcgcctcgcccatgtgcggctccagcttcttggtcatcgacgacagcgacttcgcgccgtcggtgtccggcgtttcgatcaggaagtcgctgtagccgtcgcacagcgcgcgcgccgcgtcgacgaccggcgtcacgcggtcgcccggactcatgccctcgaccgtgcggccggaccacagcagctggcgggagaagcacaggtcctgccagcgcagcacgcgggtcagggnccacagngcgccgccttcggg

SEQ ID NO: 723107 - DNA, 163 bp, Homo sapiens
tcgttcactcactttaccacggtgcttactacgctgttaacctgttggtgctgctctgtgctactcacgacgcttctctgtgcttgatgggctctgctcttctcagggccctgcccatcaaaagtcagtgttgccagtctgttcttgcagcttgtggccatgg

SEQ ID NO: 723108 - DNA, 426 bp, Homo sapiens
agaggtatccccttgggcaggacactgtgctccttcaatttcctacacctgcgtatcagtcctcaccagcaggtaggacatgcaccagctcctccaactccagcgccagaaccatgccgcctactaagccccatgcccccagccaggcctcctccacctgtgctttcagcatatcgacgctccttctgctactgttccatctccagtgggggctgtgactgctgtgccagctccatcacaaacgcctggttcagctcctcctccacaggcgctgggatcatcctatcccacctatccaggatatcctgggtattgccgaatgcccatgcccatgggcttattatccttatgcgtctggccagtataatatgccatatccaccagtgtatcacagagtcctggacaggctccataccctggacccct

SEQ ID NO: 723109 - DNA, 439 bp, Homo sapiens
cacgaggataaatggcgctttgccggtacagcggcaggtggtcgcagtacttggcggtgagcacgtgggcgagcagcccggggccgggcagcccgcccatgatcgggcggctgggggcgggcgcctgcacgatggcctcgcaccggccgcaggcgaatttcgtgcgcacgtggcgcaccacccggaagcgggccgggacgtactcgagctcttcggacacgtcctcgcccaggtgcttgagcgcgccgccgcactgcgggcagtcgctgcaggttggcagatgttccatgcggctgcgcggcaggtgatcgggcagccggttgcggccggggtgtcgcgggggggattcgatcgggatgacctcggcgagtgcggcgagatcgactgatgcgccacgggcctcgccgtcttcttgctgggccgtactcaacccgagatc

SEQ ID NO: 723110 - DNA, 104 bp, Homo sapiens
gtcgaccaaaatcaaaactgcacatccacacggcagagatctcaaagattatgcgagaatgtcatgaagaaagtttctggaagagagctctgcctttttctctt

SEQ ID NO: 723111 - DNA, 180 bp, Homo sapiens
gaatgtgtttgaaatgcaggtgtgctctggtatgtaatgcaccatatgtgaacacacctgtggaattaaagttgaactagtcaatttgatacagtggcaaaataactaagcatacacaatactggtgcaggctggtgaaacagggatgtagaatgcacactagtagatagcctgcatagc

SEQ ID NO: 723112 - DNA, 391 bp, Homo sapiens
agatcgactgacaggcatgcccgcctacagcagattggaactgtttaccagacgcaagatatgtctataaccctgcgagaaggcagatataaatcgataaatggcgaacctagaggtgatggtgcaggtgggaatagtgattcagataacttggacagcacagactgcaacagagagagtagcagtggtggtaaaagccaagagttaaataaagggatggatgtgaattcctctaaatacccctcaccgctccttcattcccaagaagaaaagacaagtactgctacttccaaaactcagacacgacttgaaggtgaagtgactcctaattccttgtcaaccagctacaagacagtgtcattgccattaagctctccaaacataaagctga

SEQ ID NO: 723113 - DNA, 552 bp, Homo sapiens
  misc_feature (67)..(67): n is a, c, g, or t
  misc_feature (87)..(87): n is a, c, g, or t
  misc_feature (97)..(97): n is a, c, g, or t
  misc_feature (114)..(114): n is a, c, g, or t
tcgtgaggagtaaacaggtcatctattcacaaaactgaatcttcattaccccacaaacatacaaacngcttacagattgctgaaatngtctcaattnggctatcaaattcattnggttttcctcaaattcgtgtaaaaaaaaaaacccacaaactggccatctactatttctccaggactgggcagtcggccctcaaaagcttcagacgagatccaggagtataagccggaaaaagagaaacctacaacaccgggaaatcggcctaggtccccatataaatccctttacacctcagtacgaaactcccccattatatcagaaaataaataaagggttaccataagtaagtcccagaaaaacaacatatggccgacctcagggatttttaccaaccactcgctttcccgggggcctgggcacactggcatggcgggtctaggatcctctaggcacaaggcgggctcgcctcctcgggggggtggccaagccaagcggcgtgttaccttcatcaccaaatggcactcgctccttccgggaatcttttttcctag

SEQ ID NO: 723114 - DNA, 423 bp, Homo sapiens
agaaatctacaatcttgctgagtgcttccccaccccgtgaacctgcaatggagaaatgggctaagaatccagggaaccctgtggacaccccacctctcagctttcttgtaccttccaggcagctgtggcgactggagaagccaccctggaactgcacctgcagctgtgtgatctgaacacactggggaaactcgagtgacacccactgggaggggccctggaagcagagggataaactgaggcacttggtaactgcaaggttagggccctatgatgttctgttcatctttctttcttttttttttccccaagacagggtttctctgtgtagctctggctgtcctggaactcactttgtagaccaggctggcctcgaactcagagatccacctgcctctgcctcccaagtgctgggattaaagg

SEQ ID NO: 723115 - DNA, 144 bp, Homo sapiens
cgtttggtgccgctctttccacgattggcttctgcggttcttggaggaaactattgtgcacgcgagtctctcgccgacagttaacgattttgttagcacagttcagcagacactgtccagtctccgttgactattgctgacacc

SEQ ID NO: 723116 - DNA, 555 bp, Homo sapiens
  misc_feature (255)..(255): n is a, c, g, or t
  misc_feature (270)..(270): n is a, c, g, or t
ttggtgcgcctattttgttccaaaccccccggccccctgcatagttggggtacaaatcccccttttccctgggcgagccgggggggccctgtggttttcccttattcgggggccccctccaggagaggttgtccccctcccccgctctccccccggggttttccccgggtggtgggcgcctgttccccccttttccccagtttttttggggcaaggggaaggggcggtcccttttcgggccccaggggttttttnaaagggggatgaaangggcccttggggacccccagtttttttttgggttgggggggcccccccccattagccctcctggggttggcctttgtttcccagaactttttgggggccccgggtttggccccctggggtggggcccccctgggccaccccgccggggtttttttttttttctgtcccccccccccccccccccgggggggggggttcccccccccgggggggcccccccccccgttcccccccaattgggttttttttttgggggtttttttaaaactttccccggttccccca

SEQ ID NO: 723117 - DNA, 808 bp, Homo sapiens
tcttggaaatggagtctcactctattgcccaggctggattgctgtggcaccaatctcggctcattgaacctttgcctccgttggtaattcaagtgattctcctgcctcagccttccgagtagcgggggattacgggcttgcaccaccatgcccagctaattttggttaattttactagagacggggtttcaccacttgggtgaggcttgtctcaaatctcttgacctcgtgatccgcccgcctcagcctcccaagtgtgcttgggtattccgggcgtgaaccattgccgcccggcctcattggccattcttgacgctttaattcaacccttgcaaatgtggggccactatgttggccactggagatctttagagaacatctggttatccgggaataactcttctgggagttgctgcggggaagcactgcagttggggaggtactgggtctaaaaagagcttccttcggcttaaaatactttttggatcggtcggtggcaagggacctcaattgagccctagtaattgggcggaggtcgagtggtccgacaacataaaaggaagcatcctttcttccccaaccttttttttttcctcaccaaaagctttcaccattgcggtgttcctttcattcatctcatgagacgtccctcggacctgctggtgctgcactcccttgtgtcccctggtcattctgtggggagctctgccaatttggggccggttaacccgctcgttttttttccccccatgccatattcggctttcttccccgagactgcggctcgcggggtttcctggggataccc

SEQ ID NO: 723118 - DNA, 590 bp, Homo sapiens
  misc_feature (314)..(314): n is a, c, g, or t
ggaaatcgcttcaaacatcagaaaagtagcccgtgtaccagtccaaacctgggagggatgggacccagcaaaccttctaggagggtggttctctaatttaggaggatttaaaatgctggtggggacagtcattttcatcactggggtcctcctgtttctcccctgtggtatcccattaaaactcttgttgaaactacagttaacctcctgacaatccagatgatgctcctgctacagcggcacgatggataccaacccgtctctcaagaataccccaaaaattaagtttttctttttccaaggtgcccacgccnaccctatgtcacgcctgaagtggttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctgggctggaagacacgtaccccctgaagatcaagagggaggtcgcctggtactacatagcagtcacgttaggctgggaccaattcc

SEQ ID NO: 723119 - DNA, 115 bp, Homo sapiens
gtgctagtttctctagccatcagtgccatctggtcgctgcaggcacacggtttggcggcgcatgacttagcagatgaccctcgtggacccttaagggcacaacggctgggtaacc

SEQ ID NO: 723120 - DNA, 335 bp, Homo sapiens
  misc_feature (327)..(327): n is a, c, g, or t
  misc_feature (333)..(333): n is a, c, g, or t
cgtgttttttaaacctgatattttcattcctaattgagtgacagccatcttttaaggtgttgggcatggaaccccaggccttacctgcttggcaagtgctttacccccgaactacacctgaagctccattccttgtcccttcatgcaccatttaaaggtgggaactatattttgactttatctacctctgagaaagaggaaaatgtaattattcacagagtttctcaaaatggcatctttcctcccaaactgggagccaaattcctgcagaaaatcatggacaagtaaatgggtgacagatgtcctgaagggggtctcaaagatgcnaggggnac

SEQ ID NO: 723121 - DNA, 903 bp, Homo sapiens
agcctatgttgactcatttctaaagcttgataatataaatgtgtggaaggaaataatactttgaaagagttgcgtgtgattccattaaggttttttcccctcatttattaggaataggatagtgctgactcagttccaactctcagaagtgtgccctgtattcaagtttgaaaaaggttcttctgtctagttttacactctagtttcaattttgataatgctgtgggtttccaaggtagtctctatctgttgctgaaagcttgatttaaatgctagcttttaggaattaaaaggggaaagaaaagaaaaaaaaaaaccttgccctaatttgagagcattgtcacctattatataagtagttcatttttttccctaccaaatctacgggacactgaaaaaattaaaaagtaaaactaaatttaggccaggcacagtgcctcacgcctgtagtcctagcacttgggaaggccaaggcaggcagattacttgagcccaagagtttgagaccagcctgggcaacatggtgaaaccctgtctctacaaaaactgtagccaggcgtggaggcgtgtgcccatagtccagctactcagaaggctgaggtaggaagaactcttggacccctggggattcggacggttgcagtgagctgagatcaccccactgtactcccattccgggtgacaggagaggacctgttccccccgcccaaaaaaaaaaaaaaaaacacaaaacgcaacacaacacagcgccgacaagaaccacgcaccagcaaacgcaagaaggggggggcgcgcgtaaaaacaacccagggggcacacaaacacaccacacactttagaagacagagccccagagcgtcaaaaacaacaggcgcgcgcgccacaccgcgcgccgagaacacc

SEQ ID NO: 723122 - DNA, 592 bp, Homo sapiens
aattaaggtgcaaatacagaatgatgtctggcggggcttggtggctcacgcctgtaatcccagcacttggggaggtcgaggtgggcggatcacgaggtcaggagatcaagatcatccgggctaacacagtgaaaccccgtctctactaaaaatacaaaaaattagccaggcgtggtggcgggcgcctgtagtcccagctactcgggaggctgaggcaggagaagggcgtgaacccgggaggcagagcttgcagtgagtggagatcgcaccactgcactccagcttgggcaacagagcaagactccaatctcaaaaaacaacaaaatcatcaccacaatgcatacaataaaactattcagctgggcacagtggctcagacctataatcccagcagtttgggaggcccaggctggtggatcacttgaggtcaggagttggataccagccggcctaacatagtgaaagtccatctctaccaaaaatacaaaaatggttacagaataattatacatgtttataggggtacatatgatattgtgatatatgcctacgatgtgtactgatcagatcaggatgtataggatatccatca

SEQ ID NO: 723123 - DNA, 771 bp, Homo sapiens
ccttttgaatgcagcatttgtgggaaatcctttagatgtcgctccacacttgatacacatcagagcaattcacactggctgaaaggccttatgagtgctagtgaactgtggcgacacacttctttagcgcacaagctcaacatcatacttacgactatcggagcaaactcactttcggacgacaaggtcttttgcagctgcatctgagctgtgcgcagagctttttagctcaaacattccctacctcattcggtcaccaaataagttcacatctagggcaaagaacttacaaactgcacgcaaatgtggcgaacattttttactgcgacagtctccgacactccattagctcatgcagcagcagttcattactggcagacaaacgccttactgcagctgcacgctgacatgctgggaacagctcttatagcactacatactctcagccctcacttaacacatcgcgagaacttcacatctggagcagcagacccttactcacgtgctcctgcactgctggccccgccgctcctttacccccctcctttctcactctctcttcagctctctgcactcgctccaccaccagcattcaagcacctgtctcttctcccgcagactgcgcgcccgccttcccccccccccttctcctctgccttccgcactgtggaccttcgatatcccctcccctcttcttgctcctccttcagtttccctatcctctaccctcctacccccgctcacgcgccctcccccgctccgccccccccc

SEQ ID NO: 723124 - DNA, 179 bp, Homo sapiens
gactggttgtacttgaggatctctgtatgggcggcctcttcgtcctgctgggctccttgcacgttctcgtcgttcctctgtatggtttcctcctgttccttatccttgtgtgccttctgctgtttgatggtgcccttctcatcttttgtcgtctctttgttctgcatggagtctgcccg

SEQ ID NO: 723125 - DNA, 405 bp, Homo sapiens
  misc_feature (85)..(85): n is a, c, g, or t
ctcctcgccaaactttttttaagtccctaaaacataattccagtggaggacaaagtgggaatgctgtgccaaagagcatctcctnccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagctatgaagtctagcattcctagaggaacgtcatgcaccaggtaaattccgccatgttgcctcttaatgagctttgcg

SEQ ID NO: 723126 - DNA, 500 bp, Homo sapiens
  misc_feature (111)..(111): n is a, c, g, or t
  misc_feature (204)..(204): n is a, c, g, or t
ggcaaagctctacttcacgtgggcgccacaatttggcgctctctttctgtgctcccagctctcggatacagccgacacatgggtttcggagaactgaaaagccctgccggnctcatggtgctcaacgattaacctggcggacaagagctacatcgaggggtatgtgccatcacaagcagatgtggcagtatttgaagccgtgtncagcccaccggctgccgacttgtgtcatgccccacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtctt

SEQ ID NO: 723127 - DNA, 666 bp, Homo sapiens
  misc_feature (105)..(105): n is a, c, g, or t
  misc_feature (640)..(640): n is a, c, g, or t
  misc_feature (660)..(660): n is a, c, g, or t
agaacaaaaatgtttcttttattttgaagcttatattttatactttgtgtttttatgtttctttatcctaaactcttttttcaaccaaactcttagcatctcctnccgtaatgccctgcggaaaaaacttcattcttcttcctctgtgccaaattttctaaaatttctggctcctgtagatgaaaataacacctctgattttatgaacacaaaaaggtagggcttaatttagatatatcaagcctgggtgttactaagtgttgaatatcattagatatacaagggtgttttaattactattttgccatttaaaaaatcatttcagctaaatctgttgtatcttctttcttatacttttttcttactgaatgccatttttaaaaatgtgcaaccaacctgttctctagttttgacgaggattagtttaagtgttatcttaagaaaagtctttgccaagtctctgagaccagtgtttctggttagtgagcatatgtctgtttcaaatcaggatgtctgatctgttcaggacgtctaatctgtaagttgaggggattgcttacttacaggtacataacttgggtataaattggaagggccttctcaggttgtcctgtgaataggagaaaacatttatgattgngtttatatattgataactgnattttg

SEQ ID NO: 723128 - DNA, 590 bp, Homo sapiens
  misc_feature (37)..(37): n is a, c, g, or t
  misc_feature (59)..(59): n is a, c, g, or t
acactctcactaactcctttattatgatttctttganagaatatgaagacagccataanaaagactcttattgaagttgagagggtctcctgtaggtcttcacttcactgtgtctaaacattggtctgttgcttgtgctttgcttttctctcaccctggatgaccttcaaggctcttccaaatgatttctctgattccctgaaatactgaaattgtgattaacagaagtttcaagtgttaatcaatatcaagatagtagttgtctcttcctggggaaactagaaatgaaaaccaaacataggcctctgtaatcattgcacagattaaaaatgaaaatgcagctgagaaacagaggaatgaatgagaaaaccctaaacctagttctagccccaggatgaggtctttgtcatgagtctgacgctagccacagccggtaagagaaggaattccctagtagtgtagttgttacaagggaatgagtcattttgcaggtaattgttcttcttccattttccacttgctgtcagccactttacagaggagtcggactttgttctgcttaagagaagtctctttccttttattgttta

SEQ ID NO: 723129 - DNA, 128 bp, Homo sapiens
gtacttagactgaacttgctcgagaggagtctcgcggacgtcagcaagattcagatgactactatcttgacttaccctttaaaatcttccactgcatcaaaatgggcctcagattttcataagactat

SEQ ID NO: 723130 - DNA, 1403 bp, Homo sapiens
ccgaagaggggaaatgtgtgtaattgataacctgcccacagcatgcccctgccctttgttctcagccaagtttctctagaacgctgcaggagacgatcaggtttgctctgcgaatttactccgaagagtgttcacgtgtaatatcttgtattgttcgccctataaggggaggacaggtcttatctaaggccacaattctccagacagtttacacacataaaacccatttacacctcattaactggtgtaaacggttggtcacctgtgtaacattttgaaacacctttaaaatgccttcggatcattgtgcatagtacattgttcgctgtgccttggaccaaagttgtggctactgtctatgtgagattaggtgtcactacgcttaccaatctgggttcacactggggcccacaaattggacagaagactcgaaaaacagtgaatcccttcgccattcggacaccaggaaaggatttcaaagcctgatttatagggccaacttaagagcaacgtgcccccaggaatgtgcacgggccaccattttatagataacgggcaggttgatcaagtcacaattaattgttacgttgggaaccttcgaattgttgacctgttgccttgacaataatcctctgccaggcaaggtacacagcaatactcgggagtattaaacgcggttatacataagaggttcccccaaggttcatacatgttccgcttacattacaaggtatttgtggtgtggaccctcccagacgttccaacacctttggcactcacaactcggtttgtgccttgaattttttgtcaacacagagaactaaggtccactacgcatttccaacgcttcgccagagcgaaaatgtaatttccaccaaaccagatcaaagggactcaaagaacctttaatgaaacgttggacacagattcaatcaagggggctgtggcatctcctgggcactgcaactacttcagatacacttcggctacgacagtggaagacaggacatccaggccacgaagaacttcgtttgtgttcccccttcatcccctaacaagccaagtgtgtaaagcccgaaaaaggggcactttacagaaaggggtctccaaaaaggtgttaacggtctaaaaacaccaaaaaaaactcttcaaagctgtcgacaacacatcaccatatcgatctcattacacataatgtaacacactggcacaatcttcccgatactatcatttttaaccaataacgagagcagcgacaaccatcatccaacactattggtgaccatcagacaagatccacacgcccacacaaacttcctgtcgaacaacacacctgttctgacaacaacacgaacactacctctatcccccgtcaaaatacaatgtcgcgcacataacccctc

SEQ ID NO: 723131 - DNA, 401 bp, Homo sapiens
  misc_feature (85)..(85): n is a, c, g, or t
ctcctcgccaaactttttttaagtccctaaaacataattccagtggaggacaaagtgggaatgctgtgccaaagagcatctcctnccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagctatgaagattattcagagctgggagagcttcccccacgatctcctttagaaccagtttgtgaagatgggccc

SEQ ID NO: 723132 - DNA, 415 bp, Homo sapiens
gctgtcctgggcactgtgacgtttctggctggcaaccgaatgctggcccagcatgcagttaagagaacagcacattagttccagaagaagtctgaagaccctgaaggctgaaatgaacatttaacaaggagtggggacagttcatggtgtgaaaggaagaactggggacacaacaggagggaggagatgcctgttcgttaaaaagagaaaagctgagctgtgcttacatgtttacttgtttctcactttttgcttcacagagcagacatgtttgggcccagattgtctgtccctttgtcttgatgcctggcaagatgctgtgaatatcccaggctacccagatgttgtatttgaaaagttgaaatctgtaattcatcatcagctttggaataaagagaatggtggactcccagaa

SEQ ID NO: 723133 - DNA, 281 bp, Homo sapiens
ggctacattgggcatgggccttcaaactttttggagtagtgatgaatggtgaaagtgcttatatattataggcatgagaaaaatctcgcagtaaaagcactagttaattaaataggatgctggatttcattggctggcaagaaatgccaaatattgggaaattaaaacttattttctttatttgttttttccgaggcgggggggtgcaggggggggacccgtcagagggcgacgggagggcagtgaacgcggggcaggggcgggggcaatgaaaacacgga

SEQ ID NO: 723134 - DNA, 359 bp, Homo sapiens
tctctagaggttccccttctgtcagccggtgtggggatgtgactgagggcccgggtccagaaccctaccaacgccgagttgctcaaggtcctggcgaatcccaacccgtgatgagatgaatgttaaggtgctggactttgaccactttctgcccatgctgcacaccgtggccaccaacaacgaccaggccacctattacgattatgcctgaacgacttcgtgctgtttgaccaggcacggaaatgtcaccgctcattggagctgcctgaaattccggcatgttcttttcacactgcgtgataagatgactgcaggaccgttgctccgcgtaaggtccgttgctagggggttaccgagct

SEQ ID NO: 723135 - DNA, 197 bp, Homo sapiens
gagtcttacaacacataagcttttagagagcagagtttcatattaattacctgatgtgtcagtagtgcctgacgcagtgcctggcacgtaagaagcactccataaactcccccaattatacgtaaaatgtccctttatttatagaaacagagtatcacgctgttgcccaggctgaactgcagtggcgcgatctcgga

SEQ ID NO: 723136 - DNA, 107 bp, Homo sapiens
actttcacaggacacatcctaataaaattgctcaaaatcagtgataaatagaacatcttaacgtgcataccaatagtatagacacatttaattaaacagaaacacca

SEQ ID NO: 723137 - DNA, 982 bp, Homo sapiens
ttttcctgaggcccgggagccaaccgagggcgttcctgtcggggctgcagaccggtgggagtgtaaggcatggccaggccggctgggctgcatgagcgccggcacgggtccacgcctcgggtgacgggcttccaggatgttcgggcgcggggcggccatccgcatcccccaaaccccgcacctcctggacgtgagcctcctcagacgccgtgggaaccaaccttccgtgtccgctgttgctggcccgctatcttagcagcaggcttgacgcgcgatcccaaacccttggcgagtgccccccttggacgtgagaacgatgagcaatacgagtggggaagcccagttgcaagggcgcccctcccgaagcgccattgcccaatttgctgaagcagccccagacacttcacggctgctgatgtcaatgagtaaccacctacctgtgcccaaatgccccccaggccaaacagcggactccatggtgggccttatgtgtaggggccctatcattcccttaccatcaccctggtcggcgtgttcgagtggcatgtggggtggaccgtgtgtggcccatcaacatgttccgcccaatgtcaagctattaggcagatgagggaactgcatgaggcttgcagcaggagctggtcttctgaatgggaagaacccaaggttggtacatggcttggccagacgtggctaaccagccactagcggattcgcactggtggatcgcagcgacgttggcttgcccccttgtcccaccttcagacagctgggtcctggcttgctggggcctgcatttgttccccggtgcacttgggccccttgtggtgaggggccatatcctccccacctcagagatttgtccgtgcgacaatacaactggcagcgttgccttggttggtgccgcccctcgtcttgaaggtctcggagcggcgcacactgtctcgttgcgtgcacacgagcggccatgcggggctccatg

SEQ ID NO: 723138 - DNA, 1117 bp, Homo sapiens
ggagacgctgtgctgttagactcatctcgctagacctaaggcagcactatcgctgctatctcgtctaaccttgggcccaaggcagggtccacatgtatgacttcacgcaggcagaggcaggtcagtatgtgttcgtcgtggcgtagcgaggatagctgcacttcgccatctgacgatgtcacgacagcatcgttacgacaacagagagagataagtgtgacatccttaagaaacagaccgagggaaatggcaacagggaacgacggcttgtgacaatacgtgatacgcagtcgctgatccaagcgtggtacatgatggcgtagcttcagacgtaggcatataggttaccgtagtatagtaaggactttctatttacccgacctcatcaataggtttcatctgcgattaagatgcacacgatgatgcgaagtctcatgtgttgagcagcttcgacacgtttaagaagcgcacgatttgtacggacgcgaggatggctccctggctattccttgacacgaaacgtttggcttcgcttttgtgagtcaccatgccaagtgcaatgaaggcgattaacgtattcggaccgagtgcgaacacacgagtcgagaggtcagtacttcgcctacgcacagggctcccatggaagtgacaagcatctgtcggatggacaactgcagagcattgtgtagatagcaccaagacagcgttccgactgccttggagagaacaattcaaatgccggggactccactaagccttgattccccacaaccttttataggaaagcaaaggtggatactgtggtcgcctaactagtttgatcagacatatacctaggaccgagtactcacgtgaaaactaatcccaataccctccacttgaagactgggtacacggggtaccaaattggatcgatttctactcgaaaggggttgttaaacagcaagccagcaagtttgcgacggttttcaaaaggaaggaataaggaccgttgtggcaacgtggcttagcgatatttacccttttacagccatcttgccttggacccgcacttgcaggaagtttagggaacttgcgagcacaagggggtttacaaaagttccgtagcttttacccg

SEQ ID NO: 723139 - DNA, 105 bp, Homo sapiens
aaacaatgatgtattttttaaactgccacattcactcctgaaggcccactcatctccttcagcatcccacagatgaatgcagtggtacctgagctcgcaattctg

SEQ ID NO: 723140 - DNA, 1634 bp, Homo sapiens
atgactctgactcgttggtctatgaaactgacatggtagtaaaacactctcttcctacaagtctatccacgaggagcatgtcagtctcccatggacggtagactgcatcggaggtatgagactacgagtgcaatgtgtacgtgactgactgagtagagacgaccacacgtgaactgcacatggcatacgcacgcacgctacggatgccaactaccgcctgtgttccctctactgcacggtacactgcgtgaccaacattcctgtaagctgccttgctgcacacgcctaccatctctgtcaatccccccgtgtaccctaagccaagccaacttgcgttccaatgtgcaccaaccgcctctgccctgtcacctgatgagcacaacctatcagacccagtgtccgcgccatcactggcccgcggtgactgcccgccccagcaagcacactgaacatacgaatcgagcaggtacagaatcggcgagacccgagcgggaaccagccactgacccccctcggtaactggcgaccgccacggccctcccagctccgctaccgcgacaaggccacccgacctgagacgatgcacaacccccgtcccctccacgcgacgacccggcctctcccaccaccaagcccgactcgccactcactcgctcgacgaaacccccccgacttcccaacgccccaccagccgacccgccgtcctccgccacccagagcacccaaaacccgcaatcgccacgccaacagacgccgcgcactcacaaccgaccgcaagcacaaaggcaacgggccttggacccagtatggcccgcgtggtacaagccgccaagcaagcccccggcccagcacgcaccggcccccccccggcctcacacgatcgccgcggcgccccaggcacaccggacccggagcacgcccccgaaggcgcctcaccagcaagcaacccggcactaatacagcatcccacacacctgggcaacgcccatgccccagcacataccgtaccacccctgccccctcacaccccaaccacacacctcgcacgcgctgggcggcccaacaatggaaccacggcatcaccacgcacacgacccgtgcacaggcctgcattcaccacatcccacacaccagccgccagacccacacactcgccgagacgccaacacaagcgaatcaccccgacagcaaaccggcaagagccacacccagaccaccaacaatcggaccagaccctcgcaatccaatcgcacctcgcgtgacccaccacacgacagcccccacaacgcgcaccacgccaaccgctaacctcggccacacacagcacatcacaaggcaagaagctcaatccctcaccctgccatcgaccacacacaccccccgcacccgggcccacgccaacccgaacaaccctgccaccacgccacaccggacacacagccacaccgcgaccaaccccaccacgcccccctctgcccccacgaccaccaccgagcagacgcgaccacacacaccgggcaccccacagccccacccccccccccgcaccccccccacaccgcccacacgtcctcaccacatcacgcacccacctcaccaccccccaccgccacaacacacccaccccgcccacc

SEQ ID NO: 723141 - DNA, 237 bp, Homo sapiens
gatccggactatttcttcttccggcacagtcagcagctggaagaagatggcgctggtggacagcaaaggctttgatgagtacatcacggagctaggagtgggaatagctttgcgaaaaatgggcgcaatggccaagccaggattgtatcagtcacttgtgattggtaaaacacctcaccatataaaactgcagagcactattgaaaacaagcagagcttttcattgtaccccgagaa

SEQ ID NO: 723142 - DNA, 182 bp, Homo sapiens
tcaagcccccggggacattgggaaggggaccccccccccccccccccccctttttgccccgttttgtggaaaaaaaacccccccttagtctttaaaaagttttttttaaaacgggtttgggtttgggggggtttgttctttttattgaatccatttaagtaaaaaaaaaattggttctttta

SEQ ID NO: 723143 - DNA, 402 bp, Homo sapiens
cagtggcactttaacatcagcaaccgcattcaccgtgggagctgcggtcaggacacttgccttttcttcttgcttcgctttcgttcttcatccctgatcttccgctcagctcccttgtccacagcaagaccttgatctaggcagtaggcccggtgcacaggcttgttgctagcggttgtcgtccctatcggtatcaacttgaatgataagaggcaaacccttcactcccttctgggaaaagacatctgtgcttaagcagttcacagagatgaaaaccttagcttcatcgtaaatatcccatgtcaaggaaatggcgtaatacgcaaatctcctcgatgtatactgatagtattgaagctatctttatagtcagctatgtcaatgcatcttcgtatcgcggtg

SEQ ID NO: 723144 - DNA, 478 bp, Homo sapiens
gttaacattgttaacggtaacctcatcagaataaatgagcccgcgcattctcctgttagtgctttttatcgcctataaaggacattgaacttgtgacaaactggttcatggtgtagcacgttgtggtaatgtgtgcctaggtaagtccatgagccccacgtagttgcattgatcataaaaatctgtcttgaacttgctcttgttcagaacatcagtgtcagacaatgacacagagcataggccacccgcaggatctcatgattaaaggggacctctcccgcttcagaggccttgacgtactccaagatgagcttgacgcggctgtgcagcatcttgatggcgctgtgctgtgctatcaggtgttcagcctcagtggagttctctccactgcctgttgctgtcattcgggctacgtggtctacaccaatgcgttccgcttcctctgtggccagagtgtaggtcagctcagcaaacagca

SEQ ID NO: 723145 - DNA, 364 bp, Homo sapiens
ctctcgtggatccccttagctgcatctggtgcaacctagtctctactatatatcatacacacaattggctgggcatggtggtgggcgcctgtggtcccgtgctactcgggaggctgaggcaggacaatcgcttgggcctggaaggcggaggttgcggtgagccggggtcgcgccgctgaactccagacctggatgacagagtgagactttgtcacacacacacacacacacaaaaggtaaaggacttgaatagtcatttctctaaagaagacatacaactagccaataagcacacgacaagacgcttaacatcattagctatgagggaaatgcaaattaaaaccacaatgagataccatttcac

SEQ ID NO: 723146 - DNA, 928 bp, Homo sapiens
tcggttccaagcgctgttttgaccccttttgacccaaatagttctccgtaaatgccgggtgctctcccgggttttggctccccagcgtttgttaaggcccgttgtcttggacccacaaagtttcctctctcaaaaaagggtaatccccctctgtagaaattagcccacggggtccaaaaaaatggtcgactcgtaagttgttcaagcagattcaaaggcctccaacctgtgtaggccaaaattggactcttgttaaggttcctcttgaatggcgccaagatttaacagtgggtgtcctacacaacatcacgcggcgggtgtaagtagacatcctctttccatgcgggggtgaaaaaaggtttgctaaaagagattttggtgaagtcaacgtgtctctcgtcgcccccgggttgttgatcccccatctataggggccacctgccctttttgaatcagaaaagcagggggaccttccacacgccgtcataaaagtgtatgagtggttaaaaaacgtgcagtggcgttcatcaaaaaaaatccttgtaacaccgacatgtttttgtacagaacaaggggtgtgtaacccgcaaaggggcgagcttataagaagcccgctgtggtatatcccacccccccccatggggggagacttggcgctccatttctaaacggcctgtgtttgtatcccgcgattttttttttccttccgccgggcttgctaaattgataaaagaataattttatccgggggattgtctatgatcgcacacaccttgggtggagaagaaaacaaattgttgcaagtaggggaaaaaactgtgaggaacacaaattaaatctgcgatcggcgtcataaagaaaaaatataaccaaagtaatgcgggaatctctaccaagacataccacaactgacactctctcttcagga

SEQ ID NO: 723147 - DNA, 306 bp, Homo sapiens
  misc_feature (68)..(68): n is a, c, g, or t
tatgtttaattatatatgtaagtaatgatgtatgagattgagagagggatttggaataggttggattngaatgaggtaaaagaaagagtaattagaaggtttaggataaagacgcgagtaaaaatattgtcttaatacgttagtggaaccggtccatatggcatatataaaatatgcgagtaatatgttaaccgacaaagagacggggggggagagatagatgttggtttgggaggaacattacgggcgccggcgggtgaggggcagaacgttgagtatgtactttgtctaatcgtgtagatgcgg

SEQ ID NO: 723148 - DNA, 388 bp, Homo sapiens
cgaactggcgaccttctgaaggctgcttctatataatgtcaacatctctgctaataagaaaagactggggaggttctgtgggccactgggttctccactgagcaacccaccggagaagagaaggaattatatgtcccaagggaacaagatgctgctgagcttccacacagacttctccaacgcggagaatgggaccatcatgttctacaagggcttcctggccatactaccaagctgtggaccttgatgaatgtgcttcccggagcaaatcaggagaggaggatccccgggcccagtgccatcaccgtgtgtcactaactacgtcggaggcatacttctgtctcctgccgtccaggctatgagcttcacgaagacacgctgccctgcc

SEQ ID NO: 723149 - DNA, 274 bp, Homo sapiens
gttaattcttagccaaccaactcttgcgtggaagcatctacataggtctaccatcaagccccagaagagctgaagatgaccttgggctaccaagcctgtgatcggctgattggcctttgaccgaacatatcttttggagcgtgtacctgtcccacgtggagtcaggatgtagtcatctttgttaatttgtcctgcgaatgattgccatgttatatacactgattctcgtactcgctctacatgataccctagtctcgtgtgatacgagtcctct

SEQ ID NO: 723150 - DNA, 216 bp, Homo sapiens
ctgctcgatctctagcaggatccccgtatacgtgtggtacgcaactaagagcctagaaataaacccacacatctgtgtccatctgattctttacagacagatgctgaagggtatcagaatatgccactcccaaatgtgctgctttggcatagggattattctgagttgaaggcaactgagaagaagcagatgtatgaaaagctgcgaatcccagca

SEQ ID NO: 723151 - DNA, 186 bp, Homo sapiens
tacaatcatcaaagcaccaagctcaggatatacccaggattctctggggaaaaggcaaaagaagttggattgccatatatcagcatatgctgtgaaaactgatagtagctataaattagagattcacattattagttcaattcaaagtattagacagagggctacattgacaccattcctagatac

SEQ ID NO: 723152 - DNA, 332 bp, Homo sapiens
cacttggctatgcttttgaacgacgacgctgagataccgcgtacgcatttgcgaaaggctcattggcataaacgagagcagatatgtgcctctcggtagactatcttacaccgactgcacatttaaagctgctttgtttaagccaggcccagtggcatatacctgtagtcccagctacttgggaggctgagtcaagaggactgcttgagcctaggagttcaaggacagcctaggcaacataatgagagcccatccctgaaaaactttttttaaaaaataatgtgttaaatgtctgtcttacctgcttcatataatatcatagaaaatatctg

SEQ ID NO: 723153 - DNA, 119 bp, Homo sapiens
tcgatggctaggaggatcggcccaggcagaggtttgacttgcttcttatcagcagctagtccagctcttcttaccgatgtatcaggttcgtactcgttggtaccggagcgcgaattcgt

SEQ ID NO: 723154 - DNA, 302 bp, Homo sapiens
ttgccccccccccccccttttccccccctttccccccccccgggggggtttttttttggggggggggggggtggttttgtttccccccgtttttaccaaggggggccccggccctggttgggccaaaaacctttttcccaattcccttgggggggggttggcccccccccccagttttttgggggtttttttttaaggtttttgggtttttttttggcccccccttttttttccccccctcccctttttcgggggggggccttttgtttttaaaaaaaaaaccctttttttggggccgggga

SEQ ID NO: 723155 - DNA, 1491 bp, Homo sapiens
  misc_feature (20)..(20): n is a, c, g, or t
  misc_feature (36)..(36): n is a, c, g, or t
  misc_feature (43)..(43): n is a, c, g, or t
  misc_feature (48)..(48): n is a, c, g, or t
  misc_feature (73)..(73): n is a, c, g, or t
  misc_feature (87)..(88): n is a, c, g, or t
  misc_feature (101)..(102): n is a, c, g, or t
  misc_feature (115)..(115): n is a, c, g, or t
  misc_feature (126)..(127): n is a, c, g, or t
  misc_feature (137)..(137): n is a, c, g, or t
  misc_feature (232)..(232): n is a, c, g, or t
  misc_feature (238)..(238): n is a, c, g, or t
  misc_feature (266)..(267): n is a, c, g, or t
  misc_feature (284)..(284): n is a, c, g, or t
  misc_feature (287)..(287): n is a, c, g, or t
  misc_feature (323)..(323): n is a, c, g, or t
  misc_feature (332)..(333): n is a, c, g, or t
  misc_feature (354)..(354): n is a, c, g, or t
  misc_feature (356)..(358): n is a, c, g, or t
  misc_feature (363)..(363): n is a, c, g, or t
  misc_feature (372)..(372): n is a, c, g, or t
  misc_feature (376)..(376): n is a, c, g, or t
tcttggtccaaaattttatnaaagggtcttataaanagcaacntccanactccaaaatacagttgccaagganacccggtaatggcnnggggggacgggtnnggggcatgtggcngggggctctcnnggctttcccnccctttcgtggtccgtgaaagtggggggtgggtgggcagatattcctcttctctttggggttctccacaatgtgcctcacgtgtggctcagggcnggggcntctttatagggccaattctttaccacgnntgtgggtctcccagggncangcatgtgatctctttcccctgtgtgagtgccacagnacacacccnngtgtgtctgtgagccaacacncnnngtggncgcacacgncagnggtgtctcacacgcgataagaacgtgtataaacgaggggtcttctcgcgcgcgtggtggatctctaatcgagcggcacatctcacacacacaaacttttcgatgtgagcatcttatagccgcctctctgtgtgtctctctccggagagtgtttctccacgaggaaacacacaacaaaagctctctcggacgagactctgtgtgggggccccccaactctctctcccagagtgagagtggaaaacacgcggcagaggcgcacacaccagatatagcacgaggccccctctcgcggccacagagcgcaaagagcgcccctctctctaaaagagagagtgtctggtgatcacacaggcggaagaagagacactctctgtgcgctgtgcgcgccacagatggtgcggcccacacacagagacactctctctcttagtgtggcgcccccacccctatgtctatcgcaggccatataaaagaggctctcttataaccagctggtgtcgccctctggtgtgagaaaagaggcccaaaaaccctctctatctctgtggaacactataccaagagacgagctctcgaggtcttttccgccgaaaaaatcgcgcacgcggagaccccttttttttttacagcccgagagagaacaccttttttcgtgggtgtttcccgtgggggtgggactctacaagaaattaccagtggccattttgcaggacgtcccggggcattcgggcgtgggttaacccttcgggccaccctttcaaaagttttccgcgaggagaggtgttacgccccatattctttacgaagccacaaagctcttcccgagaagtttaaacaaaacaccgcttcatcttagcaaggtaccaacgcctatctggaacacagaaatcgccccacatcagagcggggaaacaaaaaactttccccctacattcctgtggcgagcaaaattagggcgccctcgtgggcgcccagaaattatctggcaccaccccaggggggcctgtggcgataaccctttatgggacacccggctaaacaaagataacagtagggcgccagcgacgagattaaacacacagcgcccggcgactatcgtgggcgcaccacaag

SEQ ID NO: 723156 - DNA, 295 bp, Homo sapiens
agctgaggagcgacaggcagtgatttgtgggtagcattatgcactttgtccatcaaaagctgtagctcggtatcttgttcgatctgtataagtaccaagggtttgttaacttaccagctagttggacaatacatgggtatgtcctctatctacatggcagcagcagcctcaggtactttctcgtcgatggtatgctcaacattatgctcggccatcatgagcgtcaagggtgcctcctctgtgacgccagagaggtcagatccagtgttagagaccttagtgatgagcagttgac

SEQ ID NO: 723157 - DNA, 343 bp, Homo sapiens
catcagccatcacaagagcatccatggagtggccttcaaaatgcgtgcgcctcgggcactcaaatagcttcggaaatgtgccatgaaggagatcggtgctccagatgtgcgcatcgccatcaggctcatcaaagctgtctgggccgaaggagtaagcaatgttccattacaaatccgtgttcggctgtccagacgacgtaatgaggatgacggttcggcaaataaggtatagtcgttggttacctatgtgcctgagatcacgttcaaggctctgcgtaccgtcactgtggattcgatctaatctctgatcgtcgcatcaaataaagttataaatctgcggtcc

SEQ ID NO: 723158 - DNA, 378 bp, Homo sapiens
cacgaggcctcgtgccgaggccgcctcacgccccttctcgaaagagcgcgacggcttcgtgatggccgagggcgcgggcgcccttgtactcgaatcctatcaatccgctgttgcccgcggcgcggagatcctgggcgtcgtgcgcggatgcggcgaaaaagccgacgactaccaccgcacccgctccaagccggacggcacggccatcatcggcgcgatccgcaacgcccttctggacgcgggcgcggcaccggaggaaatcgactacgtcaacgcccacggcaccagcacgcctgagaacgacaagatggaatatctgtcgctcaaagccgtgctcggagaccaccttgcttcaacgccggtcagctcgaacaagtc

SEQ ID NO: 723159 - DNA, 748 bp, Homo sapiens
  misc_feature (8)..(8): n is a, c, g, or t
  misc_feature (10)..(10): n is a, c, g, or t
  misc_feature (168)..(168): n is a, c, g, or t
  misc_feature (503)..(503): n is a, c, g, or t
  misc_feature (551)..(551): n is a, c, g, or t
ggagggtngngggcatgatttcctgccaatatcagaagtttcacaggcttcttgtgtatccataaacacccatcccattaagacgcctagaaaacctggccctccccaagcctttattgaccgcttgtgaatgatcccagggtgtgtctgaccaacagctcttcctgnagggagacaagtctctcctaggtatttggttatcaacctcaaccatttgctcagccttccccaagaccaggcacctcggcagagatttctgggttgtcaggcagaaccgagcattcaagggtgataactcactggagtccctgaaatccctgattaacgcaccaggtctgtagaggtgcatccacgttgcaggtattttcccttcttgctgaggagaaacctgggtttctcagctttggcacagtcacaacacttggggtcagaccattcatggtggtggtggtggggccgtcccgtgtattgtaggatggttagcagcatctctggtctccatnctctaggtgccactctaccctcccagctatggctaccccagatgtctncagacggtttcaaatgtcatggagcaagggagtgctggactacacaggctgaagctttctctgccgagatatagatattttcctggtgacaatctttcaagctgacatgaagacatggccaccactggaacgggggtgtgctgccctggccgtttgtaattgtgaggaagctctgaggaagcatgggttgcattttt

SEQ ID NO: 723160 - DNA, 139 bp, Homo sapiens
ggctgtgtctctctatttctgtatcatgccatctccctcagcactagcatagtgccagtgcttcacttggtgctgggttcatatctgtcaagctgatgtattatcacacacttttaaagggtttaatgatattgtttta

SEQ ID NO: 723161 - DNA, 802 bp, Homo sapiens
  misc_feature (8)..(8): n is a, c, g, or t
  misc_feature (10)..(10): n is a, c, g, or t
  misc_feature (168)..(168): n is a, c, g, or t
  misc_feature (557)..(557): n is a, c, g, or t
  misc_feature (605)..(605): n is a, c, g, or t
ggagggtngngggcatgatttcctgccaatatcagaagtttcacaggcttcttgtgtatccataaacacccatcccattaagacgcctagaaaacctggccctccccaagcctttattgaccgcttgtgaatgatcccagggtgtgtctgaccaacagctcttcctgnagggagacaagtctctcctaggtatttggttatcaacctcaaccatttgctcagccttccccaagaccaggcacctcggcagagatttctgggttgtcaggcagaaccgagcattcaagggtgataactcactggagtccctgaaatccctgattaacgcaccaggtaaaagcatccagggttgaaaccagatcaggaaggttattgtcagcctggggctcctgtagaggtgcatccacgttgcaggtattttcccttcttgctgaggagaaacctgggtttctcagctttggcacagtcacaacacttggggtcagaccattcatggtggtggtggtggggccgtcccgtgtattgtaggatggttagcagcatctctggtctccatnctctaggtgccactctaccctcccagctatggctaccccagatgtctncagacggtttcaaatgtcatggagcaagggagtgctggactacacaggctgaagctttctctgccgagatatagatattttcctggtgacaatctttcaagctgacatgaagacatggccaccactggaacgggggtgtgctgccctggccgtttgtaattgtgaggaagctctgaggaagcatgggttgcattttt

SEQ ID NO: 723162 - DNA, 232 bp, Homo sapiens
  misc_feature (3)..(3): n is a, c, g, or t
tantggctcgagcgctagcggctgagcaataccttcaaccccttactatagagttcatccaggaaggccatgaaaggagggacgctacacgtgtcctggcaggaaaacaaaagttgacgatgaaaaaaaattcaggagtcagctctgacaatgaagatgatgatgatgaagaagaggggaataacccttcatccctctctctttgcctccaagaggtgtacccattcgagag

SEQ ID NO: 723163 - DNA, 497 bp, Homo sapiens
  misc_feature (1)..(1): n is a, c, g, or t
  misc_feature (36)..(36): n is a, c, g, or t
  misc_feature (54)..(54): n is a, c, g, or t
  misc_feature (63)..(64): n is a, c, g, or t
  misc_feature (71)..(71): n is a, c, g, or t
  misc_feature (100)..(100): n is a, c, g, or t
  misc_feature (178)..(178): n is a, c, g, or t
  misc_feature (245)..(245): n is a, c, g, or t
  misc_feature (265)..(265): n is a, c, g, or t
nccgcgggcgctccctggtggtgcacttgaagactncagttagtaaagagtctncccgagctnnaagaggncctcaccagcatcgacagtgttaaagacnggcttcgagttaaggagattggcgcacctgtctggcgaaggggacgatgattcctgacctgcgtcgcgagttccgatnggagttactggactagcattaccctccaatcgggcaccactccttcagggcgctgagacctattaantctatttactatttgttganttatttttccgtcagttatgtaaataaactactcttcttcctcccctgattattgccattagcctttaaatctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaacc

SEQ ID NO: 723164 - DNA, 628 bp, Homo sapiens
  misc_feature (445)..(445): n is a, c, g, or t
acaaaacaccccctgccgacccttgttgtgaaccttacgggcccacggcaaaatggcccaatgggagccctcgcaaaaaccgggtttgtggcattggaaaattcgcccttacaggggaggaatttttgtcacacatctaaatgagaaatcagtgcccacaagtctttgaaaggggggtagggatttccccttccttattatccctaatcttttaaccaactcccgggaaatccaattaccaattttcccccataaaaaagaagggggccctgaatatttttgggtaaaataaagggtttaaaacggcttttggccccagctggggggctattattacaaaaatgggtaaatcataaacccttcttcccccccccattttttttcgggggggggcatcaaaacaagggtttaaaccccttgggcccgtgggttccaaaagcttggnggggtttagggtgttttggccccccaaggactgttgggcaataatttgttttggccccccccgggaaaggaaaaaaggggccccttttgaggttaaaacccccccccttttgtttttgtttggcattttttgtttttaaccccccggggggggttaaaaggcattaaaataaaccccagggta

SEQ ID NO: 723165 - DNA, 411 bp, Homo sapiens
  misc_feature (8)..(8): n is a, c, g, or t
  misc_feature (388)..(388): n is a, c, g, or t
ttcggcanagggtaactgaggaatcacaaaagaagtgaaaatgccctgttcttgccttaactgatgacattaccttgtgaaattccttctcctggctcatcctggctcaaaagctcccccactgagcaccttgtgactcccacccctgccagccagagaacaaccccctttgactgtaattttccattacccaaatcctataaaacagctccaccccatctcccttcattgactctctttttgaactcagcctgcctgtacccaggtgataaaaagctttattgctcacacaaagactgtttggtggtctcttcacaaggacgcaagtgaaattattatttaaggccttccaacatatctaatatctggaaccttcaactctttcatnttactaggcttaaatggacatca

SEQ ID NO: 723166 - DNA, 104 bp, Homo sapiens
gcggccgcctactactactgctcgaattcaagcttctaacgatgtacggggacatgttcttattttagacctgttttgtaaataaagctgtttcccaagaaaaa

SEQ ID NO: 723167 - DNA, 306 bp, Homo sapiens
  misc_feature (71)..(71): n is a, c, g, or t
gagaggattcctccaaaaggccagaaagatccttggaggaaaaatggaaatattaataatatatcctttanttttgatgggaggccaccaatgacctggaataccattttggccaaggacctccagaattggaccaccatgaatttggccagtcccattttatgaaattatatctccaataaaattgatttaaaatataattgataaaaagatatatgtatatatatacttgatatgtatatgtatttacgtgtgtctatatatttgattttccaatatttacgtgtgtctatatatttgattttc

SEQ ID NO: 723168 - DNA, 268 bp, Homo sapiens
ccacactttggagccagcgggtggatcacttagatcaggagtcaagatcagttggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactgga

SEQ ID NO: 723169 - DNA, 462 bp, Homo sapiens
gtacacataaatcattcattactcattacctgaaagtagaagtaaaatagtaaacagagagataataaccataacttctagagctagtattccgaatgatctctatatacattagattttactgtaccaagataacctatagatttatccaccttgtcaagcatatttagaagaaccaggactaccttctgaaaagcagtcaagtcacatgatgaaaggggctacatcagtataaagaagaatacgtggtggcatgcccttctggaacttatatgatctaatcaaggttgtaggaaagaggactgcagctaaatgatccacagccagtacccaacttccctcaaaatgcgcttctgctttacaataatactcatatctgtcttcaaaacttaagatattatctgccaaggttgacgtgtgtgcagcccataagtacttcaacagatcatcaaacttcctaaa

SEQ ID NO: 723170 - DNA, 81 bp, Homo sapiens
tttgaccatctcgggaagtgaggagagcccccattggaccagtgtttgcttagtgtcttcactgtattttctttaaaaaaa

SEQ ID NO: 723171 - DNA, 339 bp, Homo sapiens
atgggtcacaataaggaagggtccccaggttggggagagccccaagttgagaacaataatgaacaattagtgtatgaacaacttgttagaaacagcgtaatcacaaacaacctgcgggcacaatgacctcattccacacgtagcacccttcagacaggaccctataaaactttcctccagcccttgcctctttgcaggtagccccttctctgctgagctgcccactgcaacatattttcacaatggcatctagtaatgtatgcccttcgtttgactacaaatatcttggtgaatggctttaccacctgcaaaactgaccctaggttgtcgctacccaca

SEQ ID NO: 723172 - DNA, 449 bp, Homo sapiens
ggtaccggactatcttggtgtgttgctccattcctagcttgggagcttccgcttagaggtccttgtcgcctcgtgctacagctgccacgggctctcctgggcttattgtccggtcacaacctcagtgtgactccacagtggcccctgtagcccgggcaacgacagagagcatgtctctctgcagtctgttctctagaggaactcaacgttgggttgccacgaaaaatgtgcttcattccccccgtgcgtttaatttctagcacgaccgctatgaagacatttccaaaatcctgtgatggctagacaaatgatccttaaagaaggtgtggtgtctttcgcaagctgagcgatttctgaccggttcacacgttcaatattgaatgtttcataagcatgtgacggttcccagcacaccgtggaaggtccggcgtgtcctcctcaggatgccg

SEQ ID NO: 723173 - DNA, 163 bp, Homo sapiens
gttctggcagagaggcgacaatgtggcgcgacagacttgtcgtaacggactggtgagggctctcggtgtgttgggccagttggcaccaaacgtgggtgcctctcagcgttcccgcttgcgtgggccacgcctggactgacagcgaagggagcaggtactagcc

SEQ ID NO: 723174 - DNA, 490 bp, Homo sapiens
  misc_feature (490)..(490): n is a, c, g, or t
caacagagcgaggctctgtcttccaaacaaagcggagattatctgcgagaatgactgcattggcccctggggtgggagggcttctccagggcaaggagaggggatgcccactgctgggagtgctgcctggaaaggagtcaattccagtggcgggggccctgggttttggctgaggactgcgtgttggcagctgatctgccttttacagaccttcccaactgcacacgttgtgagcgtcagtgtgcaatcacaggcctgcctcctttgggccactttgtgaccatgttttttgcttgtggggcagggtaatttcaggatctaaattggtgcagttggatgttttcacccccgagaggcagcttttcccgttgtaggcttttttgttttgttttgtagaaatggagtcctacgatggtggcccaggctggtctcattacccggcattgagccactggggcccggctggatttttctggccttttttttggcn

SEQ ID NO: 723175 - DNA, 106 bp, Homo sapiens
atagccctgagcacgccaggatgggtaggcgatagtccatagtggcgatggcacgctgcacctggcgtggacctgagccgcattctgaacgagatgcgtgaccacg

SEQ ID NO: 723176 - DNA, 484 bp, Homo sapiens
  misc_feature (23)..(23): n is a, c, g, or t
tttattttcttttgcccttttanaaaccaggggggtgttctcttggccccctatttggaatctattaagaagggttttttttttcccccaaaggggatgggtcctgttccaaaaggaatgcccccccagtgttcccatggcaaaactggaagagtttccaatttttccccccctcctgttggccttgttgtaaccaaaccagttaagggcaagatttttccccaaaaaattaatgggggttttgggccccttaagccctttaaaacccgagatagcttccttaaacgtgtgaaggaaaatgttccgaaaaaaaaaaaaccccaaaaaaaaggtccctgggtttaattaaagcgcccccctgctccccccaaaaaagccccctttttgaaacccaatgggaaggggcctgagctgctggacccttttccctttgatttcttggcttattgggtgtttaaaaaaaaaataaaggccctttgggcta

SEQ ID NO: 723177 - DNA, 218 bp, Homo sapiens
  misc_feature (81)..(81): n is a, c, g, or t
tcagctgctactaagattatgagcattagcgttcactgacaaagaactccagcagaaagtctgcacatgtgaccgtgtctnggggcccccaaaagcgaggctgtgcttgggacacacaaattacagatcatcacggggaattctgctgctgttattaccccattcaagttgacaactgaggccacgcagactccagtctccaataagaaacagtgttg

SEQ ID NO: 723178 - DNA, 285 bp, Homo sapiens
tctgcatgtcatctctaaagatccccgtcttactactcactcttattaactaactgtatataatctcccaatttcatgttttactttttgctttaatcaactaaaagttaaattgctgtataaatatttacttttactcatattttgattttataatactgtttaccaagtccgtgatgtaaacaacccttggggcaagaaaggcatgctctctacaggtctcattgctatattgagaggggcggctaatgtcataggtgtgggtagattcattggagatgtgat

SEQ ID NO: 723179 - DNA, 118 bp, Homo sapiens
ctcctatcaacagcatcattaatgtataatatacactgatactttaaaacttgtgtggaacaaactaacttataattgaggtatcacgacacacctggaatatgtagtatctgttcct

SEQ ID NO: 723180 - DNA, 723 bp, Homo sapiens
aggaccgacctaatcccagcaatggtgtggagtgcagcacatacacttgtaaccgagccaccattctggctccaaggctgcattctctccactggatctaagcgagagggttgtcacgcgttttgctcctgggctctgccttccggctgcattattttgaactcctagctctgcgatggacctattcctctggctgctgtcgcttctcttctttcctggttactggggactctggaccacgtgtaattgactatagtctttgtcgcatgctagccaagctgtcttggctctgatttttgctcacttttcagtctttattcattgctatactctcacgcatatctcactatatcttatgtgagcttctgtcaccgctgttgttcattgctagcgctatcctatctcatccattctttgatttttatacttttgcaactctctgcgttaactctttctgtcctctgcctctgttataggcctattcgcctcatctaatacatcatgacaaattttatatatgttgtaatgtctacacaccacttatcttacatcatcatcgatctcttccgcatttgttcttttgcacatctgctgcagagtctttcatcatctgccaccgacatacatcttcttgcgacgttcatgcgctatttccacttttcagctctacacgacacactccttttctctctctccttattctttattctttcattttcatga

SEQ ID NO: 723181 - DNA, 162 bp, Homo sapiens
aataatggagtaatgcattgcttttgtcgaagatgagttttgttttgttttgccttttgccttttctagggccgttcccgcagcatatggaggttcccaggccaggggtcgaatcggagctatagccgccggcctatgccagagccatagcaacgcgggatc

SEQ ID NO: 723182 - DNA, 493 bp, Homo sapiens
gctggggcagagtacacaaggaaataacaaatttggaaaagtatgcgcccctcccccaccctgcccccaaagctgattgcatatcttggaggaagtctccatttggtagtaaagatgtttgctgagttgctgcaggtcagggtgatgtggggcaaacaagcccccagactggggcttaacccaggagggttcttggctttgccaggaaagaatttaagggtgagccagtagtgagagaaagaaacttttattgaaccagtgctgcttcttgctgagcagggctaacccataggcagtgtgcccagaatcggtgtctgtgagctgctagctagatgtttatatctgttattaattacatgctaattaagaggcaggttatttagaactttctggaaaaggggctggaagtttctgggaatcagataaggtaacttctaggctgttgccatggcatttgtaaactgccatggcactggtaggagtgtctttatgc

SEQ ID NO: 723183 - DNA, 232 bp, Homo sapiens
attttcgggcacgtctcgagagttgaacacatctgctctcccagacttctctggtggagatctggaagaacacccagtccgcacgcaggcaaggcactcaccaggtcaggtacctatgtggacaaggcaacagcatcaacaccccagaaggatccttcccacgagggcagcccaggcaggccgctcagcaacagacgtgcagacctaacgccaggtatgtagcgggatgccg

SEQ ID NO: 723184 - DNA, 338 bp, Homo sapiens
aggggaaccacacacactagggcctgttgaaggccggtgtgaggagagggagagcatcaggaggaataactaatgtacgctgttcttagtacataggtgatgggatgatctgtgcagcaagccattgtgacataagtttacctacataacaaatgtgcacatcgtgtacatgtacctctgaacttaaaaggtaaaataaaattaatatgctaaaaagtaaataactaaattcatgtgttatatactctgttaaaaaaagttatgtatgctcatagaaagatgaaagagtataaacagtataaagattcatttgttcatatatagtcagaacgtagact

SEQ ID NO: 723185 - DNA, 191 bp, Homo sapiens
  misc_feature (9)..(9): n is a, c, g, or t
  misc_feature (12)..(12): n is a, c, g, or t
  misc_feature (49)..(49): n is a, c, g, or t
caggtgcgncancctccgcccatccccaggggccgcctcccccggggcnacacacggctgctgacgacctataaaggccgccaggttttctcaatgaagccgggacgcactccggagcgcactgcgtggtcgcaccctacccgggctgccttggaagtcgtccccgccgcccctccgcaccggcatgaagc

SEQ ID NO: 723186 - DNA, 376 bp, Homo sapiens
gtgataaatgacagttaaatatcttggtggtgaggattcacaggtagcacacttattcgtgcactcatgggggtgtgtacattaaacatgcacagctttttatatattaatcatacctcaataaagtggtttaaattttttttttttttggagacagagtctcactctgtcgcccaggttgaagggcagtggcgtgatctcggctcactgcagactctgcctcccaagttcatgccattctcctgcctcacgctcccgagtagctgggactacaggcacccgccaccacgcccggttaatttttggtctctcctcaggtcacaatggcatcttcttgtgtgtccttagagcttcacagcttaagtgtggggcgggt

SEQ ID NO: 723187 - DNA, 835 bp, Homo sapiens
ggggagcgaaaaccatcgtgttcggtgacatgatcctcagcgccgactgagcctctaaagcgacttcagctctgccccaccaacaccagccgcgctgcccggtgaacagccggctccgtggaagaacacctgaggggactgcggggggcacgacgtggacacgctgacggtgacgcggacggaccgcgacgagacacacacgcgcagagcagcgctgacgggccgcggggttgccacggacgacgggcgccctgcggacccagcatacgctgggcacggacacgtgtcccgggagaccccagggcgccgggacctggaacgggaccgacactcccgaggactcggcgcttcggccagcactcacagacccgaccgacacgcgggacgtcctcctcgacactaccctccgcgacacgacggacgcgccgacagccgatacggggacccagcacacgcccaccacgactcccgcacccgacacgtcggacacacccgatacgccgcacaccccaggcggcgccacccgcgcccacaacaaaacgacgatggaccagacagcgccgacctggatacgaacaaccacgcaacaaaccggcaagcacacgcaccactccacacacataagcggaccctcacacacccgcgcccaacaaacgggccccggaacagcacaaaccgctaggcgtggaaggcacacagacggacgaacaaccgccagcagcgcacccgaccgacacaaacaggggcacaagcaacggaaagcagcacggccacgagaagacaacgccgcgcaccacgagcaggggcaccaagcacacgcaaaccagaccacaaa

SEQ ID NO: 723188 - DNA, 656 bp, Homo sapiens
tttcttatgtcgtttaaggcacggttaccccaagcctatgttgcccaacatgtgactaccaaccctagccgcctttatgccaatcgagccctcaggcctgcatttatgtggtagaacgcgcttgacacattgattgaagctctgcttccaggtaagcaaacttattcagtggtgtgtgcaaacacccttcacctgccatgaccaagagtgccccctctgttacgggtgcgaggcgcagtcattggagagttcaaagacctaagccttggtgactttaagacataatctctggtgctttccttctatcctgtccattccacctatgtgtgccctacattcaccgcctgtcggactgccaccgctaccgattctcacgacgccaaacggagaacctctgacaatgccaaatatcttgccacttttgtgtagacctcatccttcccaccaccaagtttggatcgctggccgcgggcccccagatcccccgctttcttcgagagtcctatcccacccgcaaaacctcgagccaccttgccactctttgaaagttgttgtctttctcacctcccccgccccactccgcgctccttccacttcccccacccgttcccttgttctcccccccaagcttctcttccggcgccaccacataaaaa

SEQ ID NO: 723189 - DNA, 304 bp, Homo sapiens
  misc_feature (73)..(73): n is a, c, g, or t
ttccccaggaagccccgggccccccaaaagggagacagttttttttaaaaatttaaattggcccccccccttnccgggccggtttttcccctccggaacgtttttaaaaaggaaaaagcccgggttttcccttgggaaaaaaaaaattttaaaccctttctttttttccgtttggcccgggcccacccccggttttttggcattcgggccaaaaaaacccaggaaccccccaacccggtttttttaaaaaaaaaataaaccccccctgggggcttggaatccgtcggccgtccttttgggtcca

SEQ ID NO: 723190 - DNA, 117 bp, Homo sapiens
tggtccgctacgtgttctgttcggcgctgggcatcgagctgcgcgcgtctcgcgcgaaatggcccatgacgacaacgccgaactgatcaacgaccgtaccgcgctggccgccggcga

SEQ ID NO: 723191 - DNA, 490 bp, Homo sapiens
ctccatcagattttgacccttaccacttaaatactgtcaaaaagaaatgttccaaacaaaactttttttagtccccacacccctcacctcctgtgttgcttttacagtcatgatgaaaaaaaaatgaaaagcttatttgccgttctgagttaataatgtacgagttagcctatagattctctcttaaccttcgcgggactttttacgagagttttgtttgcatggacggcagaccccagcgtgtttgtcctcttgtgtgcatgatccataaagtaaaactgctctctctgttcatctgagcattgtggcagtgcttgagagctccactgtacacatgagaacaaatccgaagtctgttttcatctctctctttttttttgttgcttattttttgtaacctaagttgtgtttgacattgttggaccctgcagaaatgtctgactttgaagaaagtcacattaaattgaaagaaaaatgtctcaaaaaaaaa

SEQ ID NO: 723192 - DNA, 211 bp, Homo sapiens
tgatctacggatccttggtgagcagctgacagaaagacaaaagaattactatttaacagaaaatgagtaacaacaatggtaatagtaaatactttcctgtaacaattactttaaatgtgaatggattaagttcaccaattaaaagatataaagctgattaaatggatttttaaaaaatcatcacccaattatatgctgccagctagctcag

SEQ ID NO: 723193 - DNA, 982 bp, Homo sapiens
agcgggtgttgagaagcgttccagcacgccgatgatgcccgggggtatcctcggatactagtggtacacccttcccctccgctctcatccggagagccgatgtgcatccagcctgaggctacggatcttgctgaacacgggatttacacatatccaggtccccgtgggccttagcagtccatgttcatggaaactaggatggctattgtggtaggttggctagcgtcaaatcaaccggaagagcgagaccattgagacgcatgctcggggcccaaattgtgatccataagggagcccttgcagaaccgaaggattgagatgcagtcacctagtgggccgacctgtggcatccccatcctccgcgtaatctgccataacatggcattagtctcttccagaaatacatgcgggagaggggattgcgcaaaaggcctagaggaatcaagggctcgtcgaatgatatcatactttgagacgagttctgtggcccaagatatagtaacaacgtatatatggattgtgcccccggtgttgtgtccaagaaccaaggtggatgaagagttctccacagacaggactgtgatataaactttactgttgatagcccggtcggggcgtcggggtggccttaagccatgataggtccccagacatcttttgtggaggggcccgaaggaccggggcgcaacctcgacatagggtcattgaagtttcgaacggcaggcttggtgcgctagtgggttgatggccccggctcgtgctagagggcttcagcaagttggccgcgggttggcggcgtgctgcgtgtggggccccagctgctctgggagggcttggggcggggccaagggttggggctccgggggggggcccgcccttcgtgggcccccacggggctgtgccctccaaccctgggaggctcgggcccagcgcgggtcgttctggggcgggcatttagtttgggttaccttttggccgccga

SEQ ID NO: 723194 - DNA, 214 bp, Homo sapiens
acagaacctgccgacctgctactaagcatgcaatcaggttccaagtgatcaaacaagttcctagtgaccagagtcctcccatgctgacacattcccacccaataacagttttgttgagagtggagtccaagctggaccctgtgaagtatgttgtcccctacctgtttgttggctcccagaggggtgtgtaagcttggccatggacagttaccgg

SEQ ID NO: 723195 - DNA, 932 bp, Homo sapiens
tataaatgggtcccatagtggtgtttatagaagactgtgagagatggtcaccgcaacatgttcccccggcggggccctagtgtaatattatctccacggcaatataaagcctccggtgagcaccctgtttccggccccccaccggcctggggattagagccccaagggggtgagaagcaaaccaagacctgggtctgttgtcccgcgaaaaagcgcttgtttttaaactgcagaaatggccaaagacccggtgacaccaccccggggcacacatcacccgcgttcaaaagtgcgcaaacccaacgtgggttaacccaagagagggttgttggcccttttgtgctctgaaaaaaagggtgtccccaaaaattttgtggcccccgcgccctactccagacgctgttagaaaatatttctcggtgctccgtcgcgcccttgtcgcggtctcaaaacaccttgtcgttcaattcaaaagcgattaatactggttgtccgccccgcaggtagatcccagcatcattttctttgtacacacgcaccagacacactaagtttctttttaagaagggaaaaaaaataccccgcgttttaaacccactaccagttcctactgacccccattgttaaattgaaccttcagagagccgcactaatccccgcttggtaacatcatcttcaagattaccatattattagcgtggttttcttccctctcaatttttcttaataaagcctcatcataacattcctaaataaccttaacaaaaccaccacttcgggaaaactatcaagtcccactcgctggtctttataaaaaaaccacacaacatgttcctctcttacttttgcatcgaccacattcctctcttttaccaaccctcaaataatataatctcccccaagcccctttcgggccaaacccacaaaaaaac

SEQ ID NO: 723196 - DNA, 524 bp, Homo sapiens
tcactttataaatctcgttctgtcaacactgtacattaccttttacctactttactacagtatatatacatactcatatctgtactcctattaagaatacaaataaacaaatttacccactttaaaattctactgtagactaaccttgcctttccccaaaaatcagatataaaacatcaatttcttaagataatgaggtctatataggaagaaagcccctttaagatttagtcctggatatcctaaggattggggtgtactgaattaggccctaggtctaaagttagctatgcctggcaaatagaaggcgtatgaaaaagtatttttggttattcaaaaccatacattctcaaagtccatggaatatcttgctagtgattcctctttgcatatgtgatttacattttaaatattcaattattattcccagaattccttataccaacagctaaatttttttagatacttttttttcaattttctgtactcctcagatcacagtaagttgctagcatacatttcca

SEQ ID NO: 723197 - DNA, 147 bp, Homo sapiens
cagggttttaaaactctctgaagtttttatttacccagcgctctggctcccacttctgttttaaaagattataagtaaatactctgctctttcaagtgaaccaaacctatcaaacctgtttagaaaataaaccaggtatgtttcaaa

SEQ ID NO: 723198 - DNA, 109 bp, Homo sapiens
ttgagatacagctagctcccgggaaggttcaactatgagagctttcggagcattggggagaaactttgttagtgtcacctgatgcattacctgatgtgcgtcgtgattt

SEQ ID NO: 723199 - DNA, 669 bp, Homo sapiens
  misc_feature (5)..(5): n is a, c, g, or t
  misc_feature (99)..(101): n is a, c, g, or t
  misc_feature (103)..(103): n is a, c, g, or t
  misc_feature (106)..(106): n is a, c, g, or t
  misc_feature (108)..(109): n is a, c, g, or t
  misc_feature (113)..(113): n is a, c, g, or t
  misc_feature (115)..(115): n is a, c, g, or t
  misc_feature (117)..(117): n is a, c, g, or t
  misc_feature (119)..(120): n is a, c, g, or t
  misc_feature (122)..(122): n is a, c, g, or t
  misc_feature (129)..(129): n is a, c, g, or t
  misc_feature (132)..(132): n is a, c, g, or t
  misc_feature (137)..(137): n is a, c, g, or t
  misc_feature (147)..(147): n is a, c, g, or t
  misc_feature (289)..(289): n is a, c, g, or t
  misc_feature (329)..(329): n is a, c, g, or t
  misc_feature (340)..(341): n is a, c, g, or t
  misc_feature (511)..(511): n is a, c, g, or t
  misc_feature (524)..(524): n is a, c, g, or t
  misc_feature (538)..(538): n is a, c, g, or t
  misc_feature (541)..(541): n is a, c, g, or t
  misc_feature (552)..(552): n is a, c, g, or t
  misc_feature (558)..(558): n is a, c, g, or t
  misc_feature (575)..(575): n is a, c, g, or t
  misc_feature (584)..(584): n is a, c, g, or t
  misc_feature (665)..(665): n is a, c, g, or t
gtgangtaagataatgtcccccaccctccttttaggtctgactcctttttaagtggcttcccctcaataaatgataagcatcaaccctttcccacccannntnccnanngtanangnannancgagttnatnaagtnctctgaaaangatagtgcagcggctctagccaccgtgcgtgctctgccctggctctgaagggcctgaccctgggctgcacccccttgctggggatggaagaccattcagtactcagccctacaccagggcatctacccaggaagataggagnacagagtgtgagaggggctgtgtcaccctgtcaggtcacnaacaggaggtnncaatggatgcggtgacacaccagtgggagctgctggctgcgcgccttgcagcccactccgccaaactgggctacccaggcatcgcaggcattctggccctggagctcagggaggcagccctgagagtcggagcagggaaccacaggcgctacgctggcgcgcttcgcagngtttatagcgcanaagcacgcgcttanacntgcgcgcaacngggcanagcggcacgcgcaagtnctcctgtgncatggcagctcaatgtttacttgtgtgtggcatgtgctgtgttagaggggtaaggctgcagggggggcactgctgtgccancgca

SEQ ID NO: 723200 - DNA, 120 bp, Homo sapiens
acacggcgtcgaactgccactacagggaagccccgtggctgaccgcgcttttaacgcctttgtcgtcttcgtaaggagcataccctggtttatctctagcaggctcatgcaaccactctg

SEQ ID NO: 723201 - DNA, 333 bp, Homo sapiens
atgatgcactctatgaatgccccttctagtatggcccaggctcctttgtccacatgggtccattgtgcagctgttagctattgttttcttcaagattcaaatttaagtgtcccgatcttctgagtctttaagataagtcaagggaccattagctcactgaaaataattgacaacaccttttgggacagtgcagctgggaatgccagcatgggatatcaatcatgctggtcgtgatataacagggcagagattattcctctaccttataacattctctaagaaatttagagaaagcaattccacctctgataatctgagtcatagtctttgaga

SEQ ID NO: 723202 - DNA, 958 bp, Homo sapiens
tgcttctatcacactccagtgctttaagcaggttttccccccatattttacctaggagggtatagctgttacctgtggaaaggttggttcagtgggggctattctgccattaccaaaagttgggtcctgttctctactttttaattggccggaaaagaggcataaactcggagaacccaagaccccggcctggcgtgcagccccagcagccggaccagccttgggcaacagcgtgcgacgttcagctgtctgtgtctccagtgctcccattccatcgcacctgaatgagggatttgggaggtaaaacagggctgagcgtgcgttcgagcttctcctgcatcatgaccaggatgctctgggacaccttgtccacgtctgtgtccaccagtcctgctcagaatctccccaggggcttttccacgatgcccatccaggcgtcaccctcactctaggccaggaggagaaggcatgccctgaggattcagcctcttcttcttcatccctcccagcacccagtgtgttgggtgcacacattatggttccaaaccagagtttccctaggaaataaacacggaggggctgaaaggacctggggccatcgggggtggatggccatatcctggggccttgatgccagtgccgactgttccctgcaacgcttccacgtccacgccaacattgcaaggctatgtcacggactggaacagctacagtgatgacacacctgaggtgaacacaaactccagcagcatcctggctctcatgggggcaagtgcatgtgggaatctaaaaaaccttccacaagttgaagccctgcaagggtggctcatgggcttgccagaaagttgtttcctggatcccagtgggtaggcaaggcatttcaagcaaccttgtgaaccttcaccagaagcagctcagggatatcctgctgcctcctaagagccggtgtccggcccca

SEQ ID NO: 723203 - DNA, 117 bp, Homo sapiens
attacatgctgttagcagaacatgaatgagcctacagcatgcataggcatgtatcatgtggtgtatgcatcggggtagtccgagtcacgtcggtggcattccggagtaggccgcaga

SEQ ID NO: 723204 - DNA, 863 bp, Homo sapiens
tgctaagaaagaaaaggcaatcaacagaaacaatgaagaagtcacagatctaaagaggcaagcagttgaagagatgatggatagaattaaccaagggagttcatcttagagccgttaatcagacagcagaccgaagaccaaagccagaatcttcgaaaggctgcgaaagtgcacgtggatgaactacaaaggaataactgggacacttaacaaatccacctagttcaagaagcttaaaatcccttgaccctgaaaacagtgaaactgagttagaccacggattcgcgtcgcacgacacggtgccagcagaagcagatagcagtagtccaactgggatattagccacctcagagtccacatccatgccagtgtgggttctgtatccagtgtcaacaaaaacagccttgaacaagaacaatctggaggcagaattcaaagccgtcccccccaacactgagccaggtgcacgggcccgtaaatgtgaaggatgcacaagttcccaaggttacgtttcagcctcccagtacgcattggctgcaggaaacaacttcctttgaggtgaacaaaccacagccgaaccagtgtagtttagatcctgtttctacaatgaaccccacacaaagaccaggttgttaaaagatcatcactcaagagctgacgcgaattcaccgaaaacaatgaacagttgcaacgtgaacagccgaaggccactgtgtcctaacacaactgcttgtggagcccttctaacacgtaggtgtatggcaggggcaactgctgtcgttcaaaggactcggctgagacccactactcggccacactcgtgttgctaaacagccactatgtctatgactagccgaccacag

SEQ ID NO: 723205 - DNA, 347 bp, Homo sapiens
  misc_feature (105)..(105): n is a, c, g, or t
  misc_feature (110)..(110): n is a, c, g, or t
  misc_feature (127)..(127): n is a, c, g, or t
  misc_feature (129)..(129): n is a, c, g, or t
  misc_feature (162)..(162): n is a, c, g, or t
  misc_feature (176)..(176): n is a, c, g, or t
  misc_feature (179)..(179): n is a, c, g, or t
  misc_feature (236)..(236): n is a, c, g, or t
  misc_feature (247)..(247): n is a, c, g, or t
  misc_feature (253)..(253): n is a, c, g, or t
  misc_feature (275)..(275): n is a, c, g, or t
  misc_feature (277)..(279): n is a, c, g, or t
  misc_feature (282)..(283): n is a, c, g, or t
  misc_feature (285)..(285): n is a, c, g, or t
  misc_feature (290)..(290): n is a, c, g, or t
  misc_feature (299)..(299): n is a, c, g, or t
agcctgccctgcctgggaaagtcggccgagggcccaaaacttttgaggggtttgaggctggtgcccccccccaagttagtgcgttttttgcccctccctgcccgngtttnagggcctcggtccatananaaccccccccccatggccaggtggaagggtttnttagtccctgccancanctgtcctccctggggcaggtggcctggccagccccctggattggggacgggccaggntgggccaggtngggggntcagtttgggaggtaataaaancnnnccnncncccanatgttgctngggaagcaaatgttgatgcaaaaataaatcaccccctgtttccgggga

SEQ ID NO: 723206 - DNA, 1733 bp, Homo sapiens
atcggatctgagcgaacggaacgggtgcgggtgttcaagatgtccattctcaagatcatccatgcccgtgatatctttgaatcccgtgggaatccaactgttgaggtagacctttacactaacaagggtggtctgttcggaagagctgctgttcctagcggtgcctcaactggaatttatgaagctctgctggaacttcgggacaatgacaagacacgctacatgggggggaagggtgtctcaaaagctgttgagcacattatcaataaaacaattgcacccgcactgattagcaagaatgtcaatgtagtggagcaagacaagatcgataacctgatgctggacatggatggatcagagaacaaatctaaatttggtgccaacgccatcttgggtgtatctctggctgtatgctcgaatgctggtgctactgctgagaagggtgtccccttgtaccgtcacattgctgaccttgctgggaataacccagaagtcatcctgcctgttcccgcttttaacgtgatcaacggtggctcccatgctggcaataagctggctatgcaggagttcatgatccctccctgtggtgctgacaggtttaacgacgcaatccgcattggtgcagaggtttatcacaatctaaagaatgtcatcaaggagaagtatggaaaggatgcaaccaacgtgggtgatgagggtggcttcgcccccaacatccttgagaataaagaagccctggagctgctgaagactgccatcggtaaggctggctactctgacaaggttgtcattggcatggatgtggctgcctcagagttctaccgcgatggaaagtatgacctggacttcaattcccccgatgatcccagcagatacatttctcctgaccagctggctgacctgtacaagggctttgtcctggggcatgcagtgaagaactacccagtgggcgtctccatcgaggaccccccatttgaccaggatgactggggtgcctggaagaagctgtttactggcagcctggttggcatccaagtggttggagacgatctgaccgtgactaagcccgaagcgcgtattgccaaggctgtggaggaggttaaagcctgcaactgcctcctcctcctcaaggtcaaccagattggatctgtgacggagtccctacaagcttgcaagcttgcccagtccaacggctggggcgtgatgcccgtgagtcaccgcctctccggagaaacagaagataccttcatggctgacctcgtggtcgggctctgcactggtcagatcaaaactggtcccacttgccgatctgagcgtctagccaagtacaaccagctgctgaggattgaagaggctgaggctggcagcaaggcccgctttgctggaagaaacttcaggaacccccgtatcaactaagctgcgtggatcgacacccgttctggttatgtaagcactagtcacctacttagactcacaattacttgtattagaagatgaggggcaggctgaagaaaagaccagtttgcaggtcctctcccctcctagatgactctccttcacctacagtgtttccaccagctctgatctgttacttgtaacgatcgtgctttgtagaacaatcccagtctttgatgtttgggaggctgtttgacttgcaggacagcaagacggtacctacaaaacagctagtagtgtttttacatgtgataaataaaaagcatcaaacaaaaaaa

SEQ ID NO: 723207 - DNA, 880 bp, Homo sapiens
acagaaaaaagaaataaatataaacagaatatccacaacagaacagattatttatttggccgacagtctctaatctgcccaaagtgtgccaacgtacatttcccacgacggcaaaaaccaagtgaccactacaaagttctgtctgttatctccctttaccgcacagtaccacaacgcttttaacatctataagactgcctcttggccttacttgtggtctacaacgcgtcacagaccttcagcaactctccgctaccctcgcaataaggacctatctccccacgaaacatcagaactgcacttaaactcaatcccggtccaacagggggtatagaccccaaggaaaccctaactagccccgttctccagacccactgtaaacaaaggcacatatacgccccgcccatattggactcatggtataaatttccccagaaactaaatacctgttcagaacaacttccgcctctacttctctgatatcgacctatgagcgtctatttatactactttctggagaaccacttaccctccattggggcaaaaacaacctgaaaccctttttgtcagaggcccattccagcatcccaaggggacaaaagccggggtatagcccgacatcatgtgggtggacgacgacatgcggtatgatctcccctgagaacacacatctattattttaaaaccaccgctacagtcctccttgaggagaaccaagagaggtctcgcagccatctaggtgggcatacataactcatgtcaatcttctcccactaatgggttatggcaagagtgggtcgagggcccgatttttgcccaaagagaatccccgaacatctaaaggtctctcaattaaacaatttttccccaaaacataaca

SEQ ID NO: 723208 - DNA, 183 bp, Homo sapiens
tccctcctagcctgccagtgggagaggggctgtttcatgccaccacccaaaaaaacaccacaatggtgtcatgtccatatgcccaccctgacatgcttccctatcccaatgcggggtgtttcgtgggaacagtgcaccatgtgcagggccacttggctgaggctagtgactgggtacctgatg

SEQ ID NO: 723209 - DNA, 2517 bp, Homo sapiens
gcaaaatacctagactggactaggtagaagagatagaacacagctgttggtcttacagaattattattattattctgtaagaccaacagctgtgttctatcagaataataataataattctccttatttacttatttatttattttgagacaaagtcttgctctgatgcccaggctggagagcaatggcgtgatctcagctcactgcaacctgcgcctcccaggttcaagtgatctcctgcctcagcctcccaagtagttgggactacaggaatgcaccaccatgcccggctgatttttgtatttttagtagagaccaggtttcaccatgttggccaggctggtcttgaattcctgacctcaagtgatccagcctcagcctcccaaagtgctgggattacaggtgtgagccaccacacctggcctaataataataattctctaaggctaagagaacaggagacaataatactataacattctgtaaattggaaagctgagagagtgaagagttgcatttcttagcaaacccaagaaagccagttatatgtagaatgaaccagaggctcaggaattgctagcactagggatctctggaaaccttagctggggtcttttctaattcggctatcacaggacacagcgagtcacctctgccatgtttcacctgctgcttacacggcacacagtccagaattagaaggtgaggtttgaaaattcacctgttttcgttctgctacctacagaagttccacagtagaaaggaaggagacctggatcaaaggataggctttaattatgccactaacagtatgaacttcatcaagtcctttactctctctagacgttagttaccactgatgtaaaatgaagggctagactagactacccttaaaggtgccatccttgctgtcaaacctcatgatgttagaacaaaaaagtatttcaggacaagactctgaggttgacctggttacttttcagaagtgtgtgcacacacatatgcacacacataataaatttagaacagaacaatattgtattctgatattattcatgaggataattaatagtatctaagaattattgaatatccaccatgttccaggtacttgcactatcttacttaatctcatttgatataataatagtgttttatgagagaaattctgttatcttcagtctacagattaagaaactaaggctctaagagtttaagttacttacagactttagaaacattaagtggcagagtctagcttttaaagatctggccaccttcagagccctggttctctagacctcaccatgcacctcttttctgaacactggtgcttctccagaaaggtcatcacattcattccagttcctatgattgctttcagtttgtagtatgactttattaccttcaactggaaaattatttggggtgtccccctgtaaagtggattggcattggaattataaacaagccaagtaccatatttctctcacgaagtcagtttcctctgaattctcaaagtccacaggcatgtaaaaggccctgcatgtgtgaaattacacattattaaagtcctgcatattaaacctttacaggatctgtagttttccattgtgaccaaacttatacagatcactgttgttcaatagattacatggccaattgtccttgggactgcagactatttataaatctacaagtaaatattttaaccaatctgtgtatgtaaattttctgtttaatgttgatttttgagtataaaaataaggagaggacatttaatggatggaatgaaagagataatatattaaaaggggaggggaagcttaggggaggatgggggtgagaacttccaacttttgttgtacgttgtttaaaattgtggattagggttatgaatgcttttgaggaaggtctcaaaagaagatcccccagcaaagtagggaagggtacttcccgataggagtcgaggtgcccaggccagctgctatactggcactgggaggagccccacgttctgccgtacctgcccccaggttggctgcatgtgccagggagtagtagaagtgccctgctcaacaggaaatgactctttccccgccacagtaaactgggccatctgctgcccttttggtttgctgcctcgattttgcaggttggagacattaaggcatgaagaaaccaagtgacacgcttcaattcagagcctaaagaagagtagtgacacatgtcggacagctgccgtgttcagcacagtccagagcgcgccatatatatgaacttgttgttctcacctcaaccctgagaggtggatttcagtgtgtctttggatggcaagcattaagagaagagtcctaacacacagcctcaggtgcttcctctctatggtgggtttcttctccaaaccaagactgcttccctggtgtgccataaaaccaccaggttggtcacagctcttttggggcatagtatgtaagggaaatttcacccatgtggtagccaagaagtgtcaaaaaa

SEQ ID NO: 723210 - DNA, 486 bp, Homo sapiens
tgccattgttggtatggttcctggcaagcccatgtgtgttgagaggttttcagactatccccccttgggtcgctttgggtgttgggaaatagaacagacaggttgggtgggggttatcaaaacagtggacaaaaaggctgctggagttggcaaggtccccaagtttgcccagaaaggtcagaagggtaaatgaatattatccctaataccggcccccccccttttaatcagggggggaagaagggtttcaaaactgtttgtttcaattggccctttaagtttaggaggaaaagacggggtaatgataaccagggtttgttaaaccttccgaaggaaaggggaatgttttggggccccctttggtttttttttttgggggggggggttttaaggtattagtttttaaaatcaggattttttaaggggaacaacttggccaaaaatttgttccagaattttgaggcccctttaaaaagttaaatggga

SEQ ID NO: 723211 - DNA, 156 bp, Homo sapiens
atcgagctcgccccatttgcacacgtggcagtggggacacggcaaggcatgccagtgaggcttcccgttcagctcatgggataccttgcccacagtcttggcagctgccagtagaggcagtgatgatgttctggagagaccccgcgtcatctaggc

SEQ ID NO: 723212 - DNA, 579 bp, Homo sapiens
tgtggcaaacggagttatttattcgctattcccagttggaagctactatcaggggcgttaaaagttatacaattgacacttacaaaaaataaaaaaccaaaacacccagagtgagatgcttgtggggggacgggggagaggctgggcacggcagtggggtgccccggggtgttcaccccaggggtctcccggagggggcgacgccgggtttcttccaccggggaggcccaggagcaccaatcacagcaaggggctctggcccagtgtgtcggcagcccatggcccagggttggtggctggacgggaaggacggaacagagggggctcgagattgcacccccccggggtggagtggtcgcgtgaagatggcccccgcaggaacaagactcacctgcgtcatattaccagcgcaagcaaataggcacaggggaaggccctccaacgacaacgaaaattatgtgtcatattgtcaaacaaaaagataccaggatatggcggacatgactggagtatcacagagaaagcgaaaaagaggtgaagagggaaaagaagaccacgcgaggcaaagccgggacgacc

SEQ ID NO: 723213 - DNA, 565 bp, Homo sapiens
gggcgcacgcagctgaagtcccgtagtcgagtgtgcacgctgagtcaacgcaccctgtagaccaaacgtgggagtcccggcgtacgcaagcgctgcccttaccattgctgaacatctcccccttatcctcctcgggctggtccatccaggcagggtgcttccgaaccagactggcagcactctagcaagcccctgcaaagtgcttgactattgacagaggaaactctgcattctcagctatcatggagggctgtccgcaatgatgtgcacagtgtctagtctgcagattggctatccgcaacctgatctgcatcagtaccccattatatcatcaacgggttacataacgagtccaggccttgtactgtggagacggatttacaccttcccacttgctgaaaaggtcaaggcctttcttggctgatccatctgcgttattgtggactgcatgccccctgtggctgctgccaccacagctgtctcctgctgacttcgtgcagccccagctaaggtcgaagcaaaggaagagtcggaggacgtcggagaggatacgggctttggtcta

SEQ ID NO: 723214 - DNA, 366 bp, Homo sapiens
ctgtaggctgagggtacctgtgcagacccagtgtattgtgcgtgcaccagacccagatggagcaaccctgcttctggtttaggcacacgtgacgggtgcgtgagacccgtgcacgggagacccgtgccgccttcaggcgcgctctcccgagattctggggcacacggaagatgtgggccctgggtgggagcagcccacttctgcagcactgtcactggctttggccacctgaggtgacccccaggccttccagggcttgtacagtgtacctatgtgtgtctgtacagcctcgcttctgtcaccccacccttgcgatctgcattagggacttccctgggagcacttgctctgaggtcccagggtgct

SEQ ID NO: 723215 - DNA, 178 bp, Homo sapiens
gccgactccttaactgacggaccgtcactgacaacttcaactttacttaacacttagttacgacggccgggtgcggtggctcatgcctgttatcccagcactttgcggaggctaaggcaagagaatcacatgaggtcaggagtttgcgaccagcctgggcaacatggtcaaactctgt

SEQ ID NO: 723216 - DNA, 351 bp, Homo sapiens
cggcacgaggtttaacagcaaagatgcttttctgttaaaaagaactgattacaatattgccatacccaacaaaatgatatcccttgatactgtctaataccagattatacctgtctcgaaactgtctttcattagcttaccttctaaattccccctttatcgttaacagtgagacatgcctagacaaaattaaagccacacagaagagtatgcagtgaagaaagcatctccccctcatctggcagccctaatcttactccccagaggttcctgaagtctcttaataaagacacttctatatattcctctagacacttcctgtgcatgtataatcacacatagacacacaca

SEQ ID NO: 723217 - DNA, 395 bp, Homo sapiens
  misc_feature (80)..(80): n is a, c, g, or t
  misc_feature (98)..(98): n is a, c, g, or t
  misc_feature (140)..(140): n is a, c, g, or t
  misc_feature (145)..(145): n is a, c, g, or t
  misc_feature (155)..(155): n is a, c, g, or t
  misc_feature (239)..(239): n is a, c, g, or t
  misc_feature (277)..(277): n is a, c, g, or t
  misc_feature (285)..(285): n is a, c, g, or t
  misc_feature (304)..(304): n is a, c, g, or t
  misc_feature (319)..(319): n is a, c, g, or t
  misc_feature (368)..(368): n is a, c, g, or t
ggtctcaccatgtgggtcagggcgggtctcgaatcctgactcatgatccacccacatgggctcccaagggggtggggatnatagacatgagccaccanaccgggctgttttaaaatcactacccacagctctgtaatttnctttnagctggtatnacctgctaccataccacagactctaatgtgagctctatggggacaaggccttctgtctgtttggatggtttctatgtcctcagngcttagatcaggactgggtccatagtaggtgctcagtnaatatggngtaaggtaaatgaataaanacccgtaatcaaaantctgagctcgtcacttataaacccagtgaggtagatcccagtaaaattnacttggtatagatgacagagctgagac

SEQ ID NO: 723218 - DNA, 106 bp, Homo sapiens
tggaaagggagtctcgctcggtcactcaggctaaagggcaggggcacgatctgggctcactggaaactccacctccggggtccaagggattctccgggctcagcca

SEQ ID NO: 723219 - DNA, 270 bp, Homo sapiens
ggatggggtgcagtggcgcgatcttggactcatctgcaagactccgcctcccaggttcacgccattctcctgcctcaggctcccgagtagctgtgactacaggcacccgccaccacgcccagctaatgtttttgtattttagtaaagacgggttcacagtgttagccaggatggtcttgatctctgacctcggacaccgctgctccagagtctggatacaggtagcacagctgctattgattagcgccgaataatagcatcgacgagcta

SEQ ID NO: 723220 - DNA, 112 bp, Homo sapiens
caagtatgagacggaatgtgggagagggatattaaaatgctctaataccctcttctgatgttcgccgcacggcaagaccagattcttgggcagatccagacgattaggggca

SEQ ID NO: 723221 - DNA, 551 bp, Homo sapiens
  misc_feature (242)..(242): n is a, c, g, or t
  misc_feature (405)..(405): n is a, c, g, or t
gaaccatccccttgtagacgaattttggagactggggattagagccctttggaggtcaaagccaaatttaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttttccgaaggggcccaaggttggaangtgggtgctggtttcggctttaaagtcatcatctcaacccagagtgtctggtctccctgctctttctgcatggttgtgtccctagtcctaagctttggttctttagggtgactgtggtaagaaggatatttaatcatgacatgcacggacacgtacatatttnactgaagtcgtcgtggccaaacaggatttacgctcgatgtgcgtcgtgcattcagatatttccgcgccattctatcgtggtctacgttcacctaacagaataccctcgggatgttgatcaagaataaagatgatgagctaccaaaa

SEQ ID NO: 723222 - DNA, 311 bp, Homo sapiens
cgataccatctatacataataggtccaaactctattaagtgcatgtctggattattcgtaacaaaagtacattatatgcttccctgactgggcctcaagatcaatattcctaaggcacctttctgatcatggcctacactcctctaaaaaagtccaatcgaacctactatgtatcgtcaatctgacaacccatgcctccctccccaactcaatctcctatagtttcacctcccaactcaaagccaaatgagaactttctaccgtccactgcattttccttcctctttagttgtgctatgacatacccttca

SEQ ID NO: 723223 - DNA, 192 bp, Homo sapiens
cctgcgctcgcggtgtctctgcgtgtccacaatgaacggtccatatagccggggcgacgccatttaaatcaagaacaagcgagggcatgacgtccgtgacgctcacagctttcacgcataatatcgtagataaaatcgtcaagttattggtcaacaaaccaggcccccctacccttcataatggattggtcc

SEQ ID NO: 723224 - DNA, 219 bp, Homo sapiens
cgtctatgaattttatttttcatcaaaaaacaaggaattaagcttgaatagtgactatatggatgacaacagtctatgtgaataacttcgaatatatgcctatccctacaggtgtgtgcttgtgggagacagactttaaacagcctccatacaatgcgtgtgtatagcaaactatcatgatgtataaagagctcacaattctattgtgaaaaataaaac

SEQ ID NO: 723225 - DNA, 753 bp, Homo sapiens
  misc_feature (36)..(36): n is a, c, g, or t
  misc_feature (86)..(86): n is a, c, g, or t
  misc_feature (114)..(114): n is a, c, g, or t
  misc_feature (118)..(118): n is a, c, g, or t
  misc_feature (125)..(126): n is a, c, g, or t
  misc_feature (168)..(168): n is a, c, g, or t
  misc_feature (201)..(201): n is a, c, g, or t
  misc_feature (203)..(203): n is a, c, g, or t
  misc_feature (208)..(208): n is a, c, g, or t
  misc_feature (215)..(215): n is a, c, g, or t
  misc_feature (234)..(234): n is a, c, g, or t
  misc_feature (237)..(237): n is a, c, g, or t
  misc_feature (355)..(355): n is a, c, g, or t
  misc_feature (358)..(358): n is a, c, g, or t
  misc_feature (417)..(417): n is a, c, g, or t
  misc_feature (426)..(426): n is a, c, g, or t
  misc_feature (438)..(438): n is a, c, g, or t
  misc_feature (444)..(444): n is a, c, g, or t
  misc_feature (455)..(455): n is a, c, g, or t
  misc_feature (476)..(476): n is a, c, g, or t
  misc_feature (478)..(478): n is a, c, g, or t
  misc_feature (482)..(482): n is a, c, g, or t
  misc_feature (500)..(500): n is a, c, g, or t
  misc_feature (502)..(502): n is a, c, g, or t
  misc_feature (515)..(516): n is a, c, g, or t
  misc_feature (536)..(536): n is a, c, g, or t
  misc_feature (540)..(540): n is a, c, g, or t
  misc_feature (548)..(548): n is a, c, g, or t
  misc_feature (561)..(561): n is a, c, g, or t
  misc_feature (570)..(570): n is a, c, g, or t
  misc_feature (584)..(584): n is a, c, g, or t
  misc_feature (608)..(608): n is a, c, g, or t
  misc_feature (720)..(720): n is a, c, g, or t
gggtgccaaaccagaagtggccagtggggttggggngggggggggggggggggtgagatggggggggccccgttcttggtcggtgntggggggttggggagacggaggcgcgcntgtntgctgcnntcctctgggctccaggtaggagagcagatgaaatctcaggcntgtggcttctccacaccactgccccccaggttngnggggngctaagngatgagagaaggggacagnggnaagagaagatgttgatcaagaaagatgagaaccaggggtgagggctgagggagaatcaaagataaaataccagtttaaaaaaaaaaaaaaggggggggggggggtgggggagagtggnggnggggaacaaaaccaaaatccaccccaaatccgaaccagcctggaaaaaaatgaaagttntcgagtttnacagagacattntttggngcggcaagctntgcggcaggagcgctcaggcntnagtncagccctggaggcaggcntntttacagctcgtnnttggcctggccggggacatnttcntcctcatnttcctccttgtcntcctcatcntcctcatcctcatntttgttttcatcatcctctttgtnctctgcttcctcttctctctttgcgtttcttgtcttcttcctcctccttaagcctctgctcctcgtcctgtttgtccttcatttgtttctctgctgcctttgttacgccccncgtctcgttgccaaactcctcagcgtatgcctc

SEQ ID NO: 723226 - DNA, 374 bp, Homo sapiens
  misc_feature (102)..(102): n is a, c, g, or t
  misc_feature (228)..(228): n is a, c, g, or t
  misc_feature (338)..(338): n is a, c, g, or t
  misc_feature (349)..(349): n is a, c, g, or t
  misc_feature (356)..(356): n is a, c, g, or t
tttcctttatttaacttccattgggggcttttgggaagggtttaccccctttattaattttccaggggttaattatttgttggaatttatttttttttgccnctttgtgtttttggttttaaaaaatatttgggccccccccattttttaggagttttccccttttctttaattgagatttggttttcctttaaattagggtttaaaggtagaaatttttaattaatnattggaaggcttgttgtttttaaggtaatttttttttttcccaaggttgtttggaagggagttccctcccttgggggagttttcccttttttcccgacccaaaatttaanaaaagggcctnggttttntggagatttttctttgta

SEQ ID NO: 723227 - DNA, 338 bp, Homo sapiens
tcttatctcaggtggttcagataaagagctgtacggtacccgtacctcctctgtaaattcaggatcgttttttaaaaaaattaatggaggatatgtactactactgtgattagaaaaactaaacaccctaaggccgggcgcggtggctcacgcctgtaatcccagcactttgggaggccgaggcaggtggatcacaaggtcaggagttcaagaccagcctgaccaatatggtgaaaccgtctctactaaaaatacaaaaattagcctggcatggtggtgcacacctgtaatcccagctcctcgggaggctgaggcaggagaatcgcttgaacccggga

SEQ ID NO: 723228 - DNA, 130 bp, Homo sapiens
ttagatcctttaactgcaaagtggtttctcactcctcttcccaaagcccttgagtatatttctttcagctccctcatgcttttaaaaatcctgtaatactccttttattcttcctgtgttacgtctaggt

SEQ ID NO: 723229 - DNA, 320 bp, Homo sapiens
  misc_feature (264)..(264): n is a, c, g, or t
tatgtgtaagttggaaatgaaattggaaaaggaggttggtgctgtaaacattgggcagagtagctaggaagaagactgtggttaatggatgcgctatggcctttgttccagtgcaggtgcttagtggagggtgcagtgctgttgcaacatagaaggacccattttgaaggaggtgatgggttagctgttgggaacgggaggagaggaagggcttgtggacccaacctctgttgaattgcctggctttttgagagaccactgaanctctcccctccccactccaccccccatctgtgctagcggaagtctatctagaaaga

SEQ ID NO: 723230 - DNA, 129 bp, Homo sapiens
gcagaaggaggtctggtattcatgcaggaatgaatactatctggtcctattgggatataggcttcttcacactccgtggtaggtgtcaagtggccatgcattgagagcacgcaggtggtggatccatct

SEQ ID NO: 723231 - DNA, 119 bp, Homo sapiens
gactctagaggagtccctactaaatggctgtcgatgatgatagtcgggacacagcagggtgttggttggacacctagatacagtctcacctgtggctctctgcatggatggattagttg

SEQ ID NO: 723232 - DNA, 211 bp, Homo sapiens
atttacttttattttttcttgtagagacagggttttaccatgttgccaaggctggtcttgtactcctggcctcaagcgatcctcctgccttggcctcccaaagtgctgggattataggtgtgagtcaccacgcccagccaggaatctcttatgtttgctgtttaactcaagagaagaacatccacctgcttgtatttgcagtaggtaatag

SEQ ID NO: 723233 - DNA, 158 bp, Homo sapiens
tgaacattcgttccctgtggtactggtaatacaccaggttctgctgcatgaccttgtcattctgatcaaagagcagatagctgacggcacagggtggctgcggctgtcatctgccaggagagggaggtgctttggatctacagggacacgaatgttca

SEQ ID NO: 723234 - DNA, 244 bp, Homo sapiens
tccccacacatgtgcctcttcatatatctacaacatatgatatcaaatacaagctgattattattaaacaaccacatattaacattatataggagatgacatttctgattattcagacaattaacataaaatccagaagcaagataccgtaagctgagaactctggacagttgatcagctttacctatggtgcttcgcctttaactagagtgtgtgatggtagatatagaagagtgcacttatg

SEQ ID NO: 723235 - DNA, 274 bp, Homo sapiens
ctttcccccccaattttttgggggcacccttttttttttccccccccccccccccccctcccccccccccttttttgccggttttttggcaaatccccaattcaaaggggggggtttttcccttttttttcccaatttaaaaaacggccccaaaagggggggggggcccccgaaaatttttttttttttttcccggccccacccttttaggccccccattttttccccgttttaaaaccaaattggggaaaaattttaccccttttctttttta

SEQ ID NO: 723236 - DNA, 321 bp, Homo sapiens
agatcctttgcctaacaaaataaaacgcccgaacagccctcaaacgccgaactatatacctggacgaacgtgtcacaaataaccattttagggcaagtcaaccaaaggcaaacaacaaactaagaagtattatgggccagacacagtggctcacatctgtaatcagcacttgggggggttgaggtgggtggatcacctgaggtcaagtttgagaccagccgtggccaacatggtgaaacccgtgtccctactaaaaatacaaacattagccggccatggtggcatgcacctgtaatcccagcaactcgaaagccccaagcg

SEQ ID NO: 723237 - DNA, 441 bp, Homo sapiens
ttatctctggggctcctcctgctctgactgccacctcgtgctcacacagagcttctgcagtgagttggattgcattattagacacttcaaactattatatgtttaagagtagggcgatgaagaggggaatgcctatatatttttcttccatttacaaatatgtgtatactagcatcaaatatagaggctgtaactagaaggctaagccccatatgcaagttcactgccattccctaagctgtcggcaatcaggacatgtggaaggtggggccagccgaacctcactttcctgggcaggaagggaaagtcacggggcccaagcgaccaggtagggcagtttctcttagcggagagacaaagggcggcaggacgaggaggcaaacagcaagcacaaaggaacccaggggccaactggcagccctgtcgactcgtagcctaaga

SEQ ID NO: 723238 - DNA, 126 bp, Homo sapiens
agcacccagctcgtcagcatcaccggctgtacgcccgccgcaagcccgccagccagggctcgatggcggcaatgcagtcgctggcctgcgcgatggcgatcggcaggtcacgacactgcgcggcgc

SEQ ID NO: 723239 - DNA, 1010 bp, Homo sapiens
  misc_feature (1010)..(1010): n is a, c, g, or t
gcgcacccagagtggagcgatagggtccccaagatgcgccttgaatgtacagagccgtggctgaacccgggggttcccgtacgaatgggtaccacactgctgtaccaagcatcacctaccaggcgggcgagatctgctgcgcttgcttctgtctatggacggcgttgacgcttatcggacgaggtcaccatcacctgtgtgcccggggcacgcaccctcccccagtggaccagtcagccgtcctactctggcatcatgggactccagatgcacagatcacatctacaggcgatgcgtggtaaggggggaatcttgtgcctctggtgccatcctggatgcctcgtaggcttgtgtcgatggtactcgtgcgagtggcgtttacatctacgtactatccatagcttcagggtaaatgtccgcgttttctggcttcgtctgggcttgtcgcacgtcctacatggcccgaatcactcgtggaggtctggacttcagacaatccgactgtatgaaagactggggatacgcgggagtatgaacgttttcgcatctgaaccccgagagctacagctgcaggagcaggaggcccctcccctcctcattcgggcagagggaaatacgggacccggtctctggctccctggtgggctcctccctggctgtgtaaatagtctgcctatcccacgaggggggtttgattggcctggagatcccgacagtaaataagcaaggattctgacggccagagcagctcttctcagttgccgaatggaggggcttgtccccggctaacagggttggatctgggcgggggagccttggttcccttggaattttggaggccttctgtgcgggacccttaagggtggcgccgagaggttaagtccttggggaaagagggtcgctcagatggttgggcttatgttgtccccggtgtggtgcaaactggtctctgcatgcgcgagtgccctgagcaaccagagtccctgctgggtatgtagaaacctatctan

SEQ ID NO: 723240 - DNA, 536 bp, Homo sapiens
  misc_feature (156)..(156): n is a, c, g, or t
  misc_feature (171)..(171): n is a, c, g, or t
  misc_feature (184)..(185): n is a, c, g, or t
  misc_feature (192)..(192): n is a, c, g, or t
  misc_feature (195)..(195): n is a, c, g, or t
  misc_feature (201)..(201): n is a, c, g, or t
  misc_feature (227)..(227): n is a, c, g, or t
  misc_feature (230)..(232): n is a, c, g, or t
  misc_feature (234)..(234): n is a, c, g, or t
  misc_feature (240)..(240): n is a, c, g, or t
  misc_feature (255)..(255): n is a, c, g, or t
  misc_feature (259)..(259): n is a, c, g, or t
  misc_feature (264)..(264): n is a, c, g, or t
  misc_feature (268)..(268): n is a, c, g, or t
  misc_feature (270)..(270): n is a, c, g, or t
  misc_feature (272)..(273): n is a, c, g, or t
  misc_feature (277)..(277): n is a, c, g, or t
  misc_feature (280)..(280): n is a, c, g, or t
  misc_feature (285)..(285): n is a, c, g, or t
  misc_feature (292)..(292): n is a, c, g, or t
  misc_feature (304)..(304): n is a, c, g, or t
  misc_feature (306)..(306): n is a, c, g, or t
  misc_feature (308)..(308): n is a, c, g, or t
  misc_feature (330)..(330): n is a, c, g, or t
  misc_feature (343)..(343): n is a, c, g, or t
  misc_feature (354)..(354): n is a, c, g, or t
  misc_feature (357)..(357): n is a, c, g, or t
  misc_feature (365)..(365): n is a, c, g, or t
  misc_feature (370)..(370): n is a, c, g, or t
  misc_feature (372)..(372): n is a, c, g, or t
  misc_feature (382)..(382): n is a, c, g, or t
  misc_feature (384)..(384): n is a, c, g, or t
  misc_feature (399)..(399): n is a, c, g, or t
  misc_feature (412)..(412): n is a, c, g, or t
  misc_feature (425)..(425): n is a, c, g, or t
  misc_feature (455)..(455): n is a, c, g, or t
  misc_feature (498)..(499): n is a, c, g, or t
  misc_feature (520)..(520): n is a, c, g, or t
  misc_feature (532)..(532): n is a, c, g, or t
gcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtagntgactctgtcaaccncagcctgctcttnngtggctnccngccacncctgtctgtaagtgagaaccccatantcnnnantatcanagccggagacgctgntcgnctccnttgngntnntctnatnttaanatgcatncctgggtccctncntntggtcccacccattcttcctcntactcttcatgtncttccagcggntanttacatgnctctncngctgaagcgntngcttcacgggtctgnccagctcctggtnggcacccgtgggntgtcctcataggtccatggatccccgcggnacgctcttcaaactcttccaattccacttcttcaccctgctgnngctcgtcctgaacaccgccgngaccggggtatntttg

SEQ ID NO: 723241 - DNA, 264 bp, Homo sapiens
ggtgaggaaatggtttttattataacttgggtcagacggggcacagccgggcgggggctctgagggtgcgggcaaagctatccagcccccaatcccccctccccgcggggcgccaccccggagggagccgagggcatgtcatctcaagcgcaggaagcaaacccgagcgccgcgacctctccccaggctggggtgggctgccaggcggaggtgggcagtaaacagtccctatggtacaaatatatagcgcgggcagggagcagg

SEQ ID NO: 723242 - DNA, 122 bp, Homo sapiens
taatcagctgtccgggttaggtcagctgaagatatgaggatgacgatgtcgatcaagaagcagaagaccgacgaggatactagacagcaaaaaaggaaaagttaactaaaaaaaaaaggccg

SEQ ID NO: 723243 - DNA, 1282 bp, Homo sapiens
tttttttcttatttcaaaaacagggatatctgcattaaattgcattcagtcaaatcaattccagttaacttaccatctcttaaacaattgggagaacaggaaacgataggacgtgaaaagttaaagatagcgtgacatacgggagagtaataagacatacgtggaaagtagctaagatgcacagggtggccaataaaagggatgtggtaatattacgatgttaacacaagaaaaaagaagtaaaatatacgtgtacttatatgggcgtggtctctattggctatttccccatgaaataggctaataagtaactaccacaggggaggccaccaagaggtggccaaacattacaggggtgtaaaaaacctttgttgggccaccatataatatcactatcttgggaacattgtgccaactttaataataaaaggggggggtgatttgtaaaagcaaacaagcgcaaaacaaagctgaggacgaacgttcaccaaaaacacgggtttggtccttggagcgtgagactatcctggaagaaggcttcaaaaacacaaaggggaatcacggcgcgggtaataaagagcggctgcgaaaaacacaaaacacaaaacaccgtgatccaaagttcaaaaccaaacgtcagcgagcaccccttgggggcaacaaaacctactaaatcacccaacaaacaggcgccctaacagaggcggaaggcgaaaatctccccacgggggggtgaaaaaaaccccatctaaaggatacaccaaaagattaggccaggaagtctccaacggcggaaaaaaccccaacaaaagagggaaagcacatataccgacacacaaaaaccccgggggatcaaaacacagggcaacaaaagagaggagacggcattggggactcgcggacactaagacatcacgggcagaacaaccacgacaaaagaataataccaaaaaaggctataccacagaagaaaaagaaggataagcgacgacggcatacgccgccaacaaccaagggggacctgataagaaaaacaaaattgacaacaacaagatacgcctaaacagagggaacacagggattacacacgaaccaaggtgagatgacaccacggtaatgaaaacgcaaaaaaatagggagcaagagcaaccccagagccaaaccaacgactcctatataccacccgcgacaaaaaaaaatgtttgcagaaaccaccccacgaggtgggaaaacgccgagcagctgctgaaaccacaaacaccacgggacgaacaccaaaaac

SEQ ID NO: 723244 - DNA, 413 bp, Homo sapiens
ggggtgtctagaggatccgttcgatatataaatatcatataacatataaacaaaagcaaacaatacacagcaatcctgaaagcaacaatcatatagctgggaatttggggacctggggcatgggaatgcacaggtttagattagtgtttagcgggcaaaaaggcagattcatgtaaacattttagagtggttttccttaggctgtttgagaatgagcaaatctttctaatgtaaaaccatcacttcagcaatgctacaagcattctgccctctcaattcttgttcatcttcttcaactgcagcaaacatacatattgcatcagcaaagttcacttcacaactcctcaattcatgccttcttaacatcacacatcccatcatttgtgcctcaacatcatgcaccattcatactc

SEQ ID NO: 723245 - DNA, 1007 bp, Homo sapiens
cctatggtagtgctgggtgtgtaaatctggccgattgggagatgatgaactagtctccccttcgcctgcatccactctcccgtgcctggcctgccttgccctgcctgcctcctccttgtgctgccctgccagcctcgccctgctgcctgtcaccatgagccatggcctactctgtccagccacgcctgctgtgtcctcctacctgcctgcaccttctgtgctgtgtggcccctgtgtgcattccctgctctgtgctcccctgcttgatgctctgccctgtgttccctgctgtgtgctgtggtttctgtgctctaatgtggctcctccatgctctgagttgactgtccctgctgttgtaccatgtgttgtcagctgcactgtcagtgagctgtgtgtgcctgtgtggtgccttgtgtgtgtctgcttgcagtgagccatgcctgtgcttgtgtgagaccaaccctgacaactgccctacctcctaactgtgactgcaggtgctgatgcttgcttgagacttactcacttgtgacctgactgcaggtgaaccatggatgttatcttgaccaccgctgcaccaaactgatgaatgttgtggtgaagcttgcatgtgaagctcaaatgacctggattactgcacaagctacaatctgaagaaagtgttgctgctatccttgtgaagcaagcagacactgcagtgccgctctgccttggcctgaaatattggagaccctggggcttcaatgtgtgccaggcagatgacctcgactggctgatgttgtgccctgaatgacctcctactgaagtgaagtgaagcctagcggtggaagccttgctgtggactgccaggttggagatatgatgctcaactaaacacagacaacagcagcggctgatcaccgtcatgaaggcggctgacaagcccttggcatcgactgacccttagatggtggggctccaagtggccaaggctagaaaggacaggacagacttccattatagaagga

SEQ ID NO: 723246 - DNA, 890 bp, Homo sapiens
  misc_feature (328)..(328): n is a, c, g, or t
agttctcccctttcgtgtgattatcgacctaaacaaggcgtcgcgtgcttgtgcaagcaaactgcgtgtgttccacacccttgtggcgacgccctcacatggacccatgggtgtcggccgaacagctggagaaacatcattttgttgtgcggccgccctacaaaccggggctcccccgcccgcatctccgtgggggtccctcactacagatacctctccgccctccatcgattgatcgagcttgtttacgccgcgattgctccctctctctttttcacagtgtgcgctttcatgttgctcgcacatttacaccgaatggttagctatntctaagaggccgtccgccccaaaggagttgatcactgagatgtctatcggctcagaggggtggatgccactccttgtggtagacaatccctcttggtgtgtatatatgctggtggactgagcgagtgggggactagacactctcgtagggcgaagagattatgtgggtgaggtagttccctcccctccccgacggtgtggccgcgcccgcctgtgtggtatctctctctgcgagcgtgcgatttttctacaggtggataaaagatgtctcgcctcccaagtcgtcacaaacgtcttatgtctcaccacctagagagtctccaacacactccatggttttattgatcacggggcaaaaccacctcctctgctattttttgtccccccggtagaaatggattgaccgccgccacacactcctgctacaaaagagtatcccgcaagtagtcatgtgcgtcccgaccacaggaccacctctgcggttgcaaattgggttccctgggggcacacaagcaagtggtcctgtcggtgaaggaacaaaaaaaattgcggccaacataaca

SEQ ID NO: 723247 - DNA, 529 bp, Homo sapiens
accaagaccgacctcgtgtccgccgaggacctcgggcggctcgagggcgtcatcgcgaccttcaatccgcaggcgcggatcgttcgcgcggcgcggggcgctgtcgcgctggacgacgtgttggataccggtttgttcgatcccgttcgcgccgagggcgcggcgggctggcagaaggcgttgatgggccagatgctgcccgaaaccgaggaatatgggatcagccatttcgtctatcgcgccgcgaagccttttcatcccgagaagcttaaggcgtgtctgaatagcaaatggcccggcgttatccggtccaagggcttcctctgcctggccactcgccatgaccgtgtcggcggctggagtcaggccggcgccgtcacacagtttggtccgcagggccgttggtgggcctcggccccgcgcgagcgctggccgtatgatccgacctggcgcgccgcgatcgagaaggtgtggcggccgatacatggcgatcggcgtcaggagatcgtgctgatcggtcagaatatgg

SEQ ID NO: 723248 - DNA, 295 bp, Homo sapiens
ggacttctctgtgtaatcggacttcctgctctacaagtcagtgagtgtaccaacaggtcacctgtgagagatgatgggtgtgcatgccatcctgatactgggactgatgagtggagaatggcacaccctagtggctggttgccaactcctgtaacaatgactggagtgacaatggctatcttcaaaatactcagaggacaggatcactgtggaatcgaatcagaagtggtggctggaattccacgcaccgatcagtactgggaaaagatctagtctgccgagtggctttgtactg

SEQ ID NO: 723249 - DNA, 418 bp, Homo sapiens
ataggagtcacgtctttgcaagcatgatcctccactaatggaggcagcgttcctagttgtcatcacacagctgaagacatcgctacatacgtgtgaaatcgatgacaaaggacaaacagagacacacggcattgttcatgggaggcatcgtcaccctcctgggtgttctgtgggaggttcctgtgtgaggaaaacgtaggcacagggttgtgctgtacccacccttccccggcgagataggcctcggactgtgccgctgcttacaccctcgccactccatggcagcttttggtctgtttccggctctggcctctgccctgaactctcatccggcttgtacctggctggtggaaccctccacctggaggccaggccatgtctcaggcccagccctagcctcttctcctcaaattctaag

SEQ ID NO: 723250 - DNA, 852 bp, Homo sapiens
ggggtgtggtgtgcttatgcccaaatccaaatggatgaatgtagaccatcccattcattctaggagatgaacagcacagccagtactccaaggttgctgctggcctctaaggagcaggtgctgcaccgggtagttctggaggagaaggtagcacatagaggcgagcagcgtggcagaggagagcacactcccgagtccgctatattgagggcagctatccaggagctcaagactcgggaagaggctctgtcgggattggccggaagcagaagggaggtcactggtgttgtggctgctctggaacaactggtgctagatggctcccttggcgaaggagtctgtttattcaacccaggaagggtgtgctggagatatctgtctgccttcgatgaagaaaccacggaagtaggttctctggacactccgttctagacctcttgctctcccgtctggtagaacgaggaggaagcagtgtctgaaccagagcctgaggggttgccagaggcctgtgatgacttggagttagcagatgacaatcttaaagaggggaccatttgcactgagtccagccagcaggaacccatcacaaagtcaggcttcacacgcctcagcaggtctccttgtgactacttttaaccaagcggaagatggacagcatatgttcctgggaccttgtgaattgtgcgctggcctcgtgcggggagtcgggcagcctggctgatgttgccccggacggatctcagcgacctgtgtttggccattggcggggtaatccatgtttgcgggtttttcgcaccgcgttcccggatattctgtccacatgtgcgcttccccttgtggtgtccacactta

SEQ ID NO: 723251 - DNA, 340 bp, Homo sapiens
gtgatccaaatggtgggggaagagcagcaggaacggggagtggcactactaacgtagccacagggaagaccttgtgtgccaaagggtacctgggcagacatggggcgcaacccaggcaggtgtcgggggaacagggtccaagtgccaggcaccacacatgcaaaggccctgaggctggtgtgtcccaggagcacaacgtgtcatgccagggaggtcgggtagagccccgcctgagtcagcattgaagatgccagggcggttcaaggcagagcagtggccaatatgttatatgcagatggctctgatgtaatttgctaaagagactctaggatgacaaaga

SEQ ID NO: 723252 - DNA, 461 bp, Homo sapiens
tacatgagcgtttggagcagcactgcttacaggagccacgatgtgaaaacctcgcacgtccgtcagctcgagaggacaaacagtgtggcctctccacgcaagggaagtccctcagccacagaaaggagtgaatcacctgacacgcagcacagcgcggacgaacctgggacacgtaatgccagtgaaatgagccagacgcaacaggccaaatgctgcgcaattccgcttctgtgaagtagcaggaacaggcagttgcacagagacaggaagtcgattcggggctgtcgggggctggggcgggtgtcgggggacagctgctgaatggcacagggtctgcaaaggtcctggatctggatggaggtggtggttgcacagcacggtgaatgtgtcgacgtggctgaattgtgtactttaatacagttgattgttaactttaagttatgtgacttttacctcaatta

SEQ ID NO: 723253 - DNA, 123 bp, Homo sapiens
ctgcgccatggacggcgacggagcccgtcaggcggtccagggcctgtctgttagagctcccaggcaaacacaagggctccctgaagccccacgattaccccaagtgggaggggggcgtaaaca

SEQ ID NO: 723254 - DNA, 222 bp, Homo sapiens
ctaattggttcttcgatgacgtgagcttctgcaccattagggagacacagtcaaatagtggaagtcacaccaggctgcttaattctactggtaaatgcagcaggtgcagttgcttgcatcaccgtgaaatgttcaaggaacgtggttcttctctcgttgcccaggatgacagaacaccgtaagcggtcacgtgtggccccgcgtcatcgaagaaccaattag

SEQ ID NO: 723255 - DNA, 284 bp, Homo sapiens
gagtgtcacttgtatggcatatccggtgccagcagcgcttgtcgttccttgctggcatccacatttgttcctcctatgtgactcctcattagctcatttatggttaccgcgttcactcctcacagagtccaccaagcagtcctgctatcgttgtacttcctcatctacctcccccgttcgtgcctggaaaacccttgccgctgctgccttccttggatgtggtagccgtctctcaggctccctctccggaatcgaaccctgattccccgtcacccgtggtcacc

SEQ ID NO: 723256 - DNA, 194 bp, Homo sapiens
caattatctctcactgccccttcggacaggggacagcgtatcaagcgtatcacagggagctgttgtctcaagagaagcagaatctagagccagggttcacatcgatgggctattacataggattggttggtagagctatcctggatttcagcaacatagagactcatttcaaatggccaaaatgaccatcccag

SEQ ID NO: 723257 - DNA, 434 bp, Homo sapiens
actacaggacttatggcgatcactgtactatatgcctgtttttcaatctactgagcaattgtggtatttttttaatctacttttttttttaaaagaggtgagggtcttgctatattgctcaggctgacatcaaactcctggactcaagcactctttctgcctcagcctcctcagtagctgggtattatggtatgtgtacatatatacttttagagacagggtctcgttctgttgtccaggctggactacagtggtataatcatggctcactgcagcctccaacacctgggctcaagcaatcctcccacctcagcctcctgagtagctagggactacaggcgtgtgccaccatgcctaatcttttttttttttttttttggaaagggagtctcgctctgtaacccaggcgggagttcagtgatcgacaaaggggt

SEQ ID NO: 723258 - DNA, 459 bp, Homo sapiens
aggatcccggattggagatgtctgaggagaacaaagctgactcggaaggcggtctccatcaggatggggataagaaaggcagctgtgagagagatgctcactctgccccaggctatgacaaagtcaatggacatctcatgaggtggtcaccccttcgtgttccttgtgtactgggagtgagtgacgtcctctatgcttgaccccaattacttgcagagtgtgattctgggcggcccctttgatagttcacaacgcgaagtcgttacattcaggtgggtgtactcagctggggagtcgtggatgtctgcaaaaaccagaagcggcaaatgcaggtacctgctcacgcccgagactttcacatcaacctctatcaagtgctgccctggctgaaggagcccctccaagatgcggatgggggtaaactataaggggttccctggcgggaacagggggggtacc

SEQ ID NO: 723259 - DNA, 436 bp, Homo sapiens
attaagtatttggtagctgaataaggggtcagaacttctgaaaccaaagatctgtaatcatctctattggcctggggggcctgtgctataaatgagtttcttcacatgaaaaacccagccagcccaagatgacttatctggggttaggattccataggattccccaaccggctttttcaaatgggcaatttcatcaaatctcccaactcttaaaggatgctttcggaaaaccccctgtatacctagatgatgactaaatgcaaaatccttgggctttggtttttttctagtaaggattttaaataactgccgacttcaaaagtgttcttaaaacgaaaaataatgttaaaaaaaatttgaaagctttggaaaacccaatttgtaaaatccttgtattttttattaaaagttttgtaataaattttttaatttccca

SEQ ID NO: 723260 - DNA, 682 bp, Homo sapiens
gtcgccgattcctcctccttgggtcgccgtgtccttgggtggcgtccgaaaaatggctactaacttcctagcacatgagaagatctggttcgacaagttcagatatgacgacagctagaagaggagattctagcgagcagatgaaccgggccgtgtggcaggtgcctcccgtcgcagagctcaggccccggggtcctccagacgggcaccagcggagaccacggtgagctcgctcgtccgtgattgccagtctggaagtgtgaggaaccagagtctgcgtggcgtggtacaggagctgcagctaggccatctccaagtctggaggcccggctgaaacgtgctggatgaagagctcgcctggccaccgggccactggccccacagaccctagcacgtatctcccattgcgccaagttggaggcccccagtccaagaagccagtcacaccagcagaggatgacgacggatgatgacattgaccttgtatggcagtgacaatgaggaggaggacacaggaggcggcacaagctgcgggaggagcggcatacagtgcagtacgctggagcaatgaaggccagtgaagcctgcactggtggccaagtcctccatcctgctggatgtcaagccttgggatgcatgagacggcacatggcccagctggaggcctgtgtgcgctctatca

SEQ ID NO: 723261 - DNA, 94 bp, Homo sapiens
gcaggctgtacggaccgagggtaagatgtcggtgctaacctccctcacgcggcggtggctgccgggaccctagcaggtttcagctggagcggcg

SEQ ID NO: 723262 - DNA, 191 bp, Homo sapiens
cgcacatggtacttccagccgtgaatccaggatttgaacactgggtgagtaaggggtggagcccatgcttgctgctccgcaggttgttcacagccagtgaggtcgccagactagcagagaaggggtaggtcacgcatgctcacgtgcaatccccactcacgaacgttggtatagcgccgtgctgccacatg

SEQ ID NO: 723263 - DNA, 725 bp, Homo sapiens
ggcgaaggggcatttactggcgcgatatggtcgagctaaaagaagagaagtgtgacctagacaaccgggacaaagtggaagtagggaagagcactttgataagagaaatgtcattgacagtaaatacgtggataaatgagtagtctaaaacagttgtgaagagtatcacggggtaacgagggactacgctaaacggcatttggcatattcagtagtgtgtaggtcgtttgaaggactaaacacatgcgcagggggtcttgatgtgcgggttataatagtgtatgtttacaggacgtaaatgaaaacgaccccatcatgtggtatcttttatagataaaaccgtttccaataggtcgatttgatgggtgatatcggcgaatgggagtgttagagtgcgctataggctagtagaggcttaaccagagtgagattattcggcgactgacaagacgggcgagaatagaaacggtggtctcatcggtaattggaatgctgcagagcggggaatacattgaaagagggcgcttaccgcgtgcagttaaatcattaaggctccattcttcaatgattcgaggatatagtaacgtggtcttccacacagctaatagatgttaaaggttggcggctgacgtcttgtcatagatacgattggattatagcggctatgactcacgtcatatgtatccgggagttagttagacagtgatacataggtccctgcgcct

SEQ ID NO: 723264 - DNA, 417 bp, Homo sapiens
cctaacatgcttcgagccatctgtaagagagtgctcttctagtaaccctgaagactgcaggtctcgttagggccggtagagggatctgtcgtgactgaaaagactctcatgaggctcaaggtggttgggtttaatactttgaacctgaacacaggaatagatcactttttaaaattgttttcagcacctaaaattatggccatggacagctccatgcaagggtcccctgactacaaggacctgccccgtgatgtggttgtgttacccagaccctgcctgtccagctgtggaagccaggctgtcaatccgaaaatgtcagcgccttgctcagatcactccagtgtgtgaggatcataatttagataagaacccagatttcttggtttaaaattggtattttctactttatctcatact

SEQ ID NO: 723265 - DNA, 443 bp, Homo sapiens
ccaggctcaaattagtaccagacgacaagaacatctccattttgatggctgaataaaggtcatggccctcatcccagacagtagttcacagacagactcactcggactcttctttgctggctcccggcctggacaaaccaacagcacagaaccttcagcctggccagtgagtggctgtgcctttgtacccatggcaagcacgacacccatcgtgggaggaaacaagtgatgtagcttagcacgggcactgtgtcttctcaggacgcctcagcagctctctcccatgtcagcccttcagcagggaagacccaaacctgtcaggaggagactgtcccagacctgggctcccacgcgatgtccacaactactcaaagatgcaggacgcagcctccttgaacctgccatttccacaggggccagaggaggggggtatacacaaaagc

SEQ ID NO: 723266 - DNA, 302 bp, Homo sapiens
tctctccacacgtggacggaaaccctacgagatgtgctattgtcagagaagcttcaggaatcagagtagactggctgtcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggagagag

SEQ ID NO: 723267 - DNA, 103 bp, Homo sapiens
caccatgcgcgcaagcccatctccactccaaaagtttagacaaaatgccagggatgttcttctctgctaacccaaagggattgagagggaccactcattcact

SEQ ID NO: 723268 - DNA, 754 bp, Homo sapiens
gtaatgtgtactagcatccacggatataacttccacatgatgatgtgagaattttatcaattctgtaaccgttacccataagggtgaaagtgctgtggagcaagtacgaccgtttccagttccgagcttcttctccagttgaagagctgcttactatgcgaatgatgaaggaaattctgacatgttagtggtgaccactagaaagcaggccttcttgtagttgaaaaagttgagaaaagtcatgaaagaagctagaagaagcgtgttaaagttaattgccgttctggagaagaagataacagcacaacttcgagaacaagtgggagaatggaaagagaacttaggcatgagaaagaaagatgtgaccaactgcatagcagaataaaaagggtcttactgaagtaacactaaagcttacaaatggaaaagtgaagagttgtaagaagaggttcagtgatgctacatccaaagcccatcagcttgaggaagatatagtgtcagtaacaccataagagcaattgaaagaagagaaaccgaattagacagtttaacatggacaaactcgaagaatggcacaagatgaaagagaacaatgttgaatgtcagttgaagaagagaaggtatgaaaaggaactttataaggtacatctgaagaatacagaagatagaaaataccaagcttatgtcagaggtccagactttaaaaatctagatgggaacaagaaagcgtgattactcatgttcgaagaagaga

SEQ ID NO: 723269 - DNA, 210 bp, Homo sapiens
gctcgacggtttagctactatttcttctaaagttgtttaacttcatatggcagaaaacagccaatgttgatttttttggcaggaaaatgacatgatctagttaagaatttctctatcagaagtatcaaggatggattcctaggaaagagaaaatacgacatttcccagttgaaatgctatcatctcccactcccggggggaggtcgacgc

SEQ ID NO: 723270 - DNA, 948 bp, Homo sapiens
agcgtgtggttatttctcttagttcttctttatgccaagtaatttagatgtatattttatattttcttttatttttaaagatagggcctgactctgtcacccaggctgggatgcagtggtgtgatcatagctcactgcagactcgacctcctgggctcaagcaatccttctgcctcagcctcctgcttagctggaactacaggtatgcaccaacaacccagctaattttaaagaaaattgttctgtagaggtggtgtctcactatgtagtgacaggctggcactcaaactcctggcctcaagtgatcctccatgctatggactcccaaagcgatgagattacaggcatgagctaccagcattcggctattaggctgtgtatttataacggtttctaccatgtatacttcagggcggaggggaggtagtagataagtagcactaggatcgatgacctacgactcctcatgaacatggacacacagccgatggcgattggacaccaagacgaaactgctcgtctagcacacagcgcaggaaccaaacaaggactatagttctggcatataaggcacaggtacccctagtgggcgacctcagataccggacagcaacgagtgaaacgtggagtaaagaggagtacaagacacatactaactactcgtatagccaccagacgggatggaaaggggtgaagagtagcggcacagggtcgtcactagaaagagccagggtgagaacaataggcctggcccgggccgcgcaacgcgaacccataaccccgtgaagacacagggaaaagatacaacacacaagacaaaaaaggaagggtatcaaagtgaaacgcaacgacaaagaagcaacagtgaccaagaacaccacggcccacaccaaagacagcaacggaaccgcacaaggcagaacagggggaaaatataagacacgagac

SEQ ID NO: 723271 - DNA, 549 bp, Homo sapiens
tcatggctgttctagagtatccctatactcggaaatcggattgtccaatgtaatagtgtaatacattactcatatgtttgtggtgatgctggtttatataaacgtcctgcagtgccagtcctataaaagtatagcacatgcaattacgcacagtacataatagttgatagtgaaaataaatgactatgttactggtttgtgtatttacgatactatactttttattgttatttgagagtggactctttctacctataagaaattaactgtaggccgggcgcagtggctcatgcctgtaatcccagcactttgggaggccaaggcgggcagatcacgaggtcaggagatcgagaccatcctggccaacatggtgaaacccatctccaccaaaaatacaaaaattagctgggcatagtggcacgtgcctgtaatctcagctcttcgggtggctgaggcagaagaatcacttgaaccagggagtcggaggttgcagtgagctgagattgtgccactgcactccagcctggtgacagagcgagactccgtctc

SEQ ID NO: 723272 - DNA, 368 bp, Homo sapiens
ccgcgcccggccatatctgggatattttaatatcattgaaatgtatgtaaattctagatgcatatgttactatgctgagggtcattcaaagcagtgtaagttgatgtcgtcctcaggaggccttgcaattacagtctgtgtcagagacttgtgctcatttttctttttctttttcctttttttttttttttgagacaaggtcttgctcttttacccagcctggagtgcagtggcactaatcatagctcactgcagcctcaaactcctgggctcaagttatccttgcatctcagcatctccagtagctgggactacatgcatgcaccaccttgcccagctaattttttaaaaattttcttccctagaga

SEQ ID NO: 723273 - DNA, 291 bp, Homo sapiens
  misc_feature (12)..(12): n is a, c, g, or t
  misc_feature (51)..(51): n is a, c, g, or t
  misc_feature (98)..(98): n is a, c, g, or t
  misc_feature (101)..(103): n is a, c, g, or t
  misc_feature (106)..(106): n is a, c, g, or t
  misc_feature (149)..(150): n is a, c, g, or t
cttaagtatgtnatccattttgcactttgtttacctctttaatatggatgnaacttattaaaaatgcttggcctgggctatttcaacagggtatatantannnccnaaaaactagtgtgccaaatggtataggaacaactgtacttttnntgatcagttggcatgaagccatagaattaaattttggctttagaatacagatgtgttcattacattccccaagggtcaaattggagcttttaaagaattaaagcttctatgagtatatggtttaagacttaacttattaga

SEQ ID NO: 723274 - DNA, 178 bp, Homo sapiens
tctaatcacgtgcattgtggacactggagaattttcttgcacacacgtctgcgtggacaccggagaatcttctcgccatacacactctgccgtggacactggagaatccttctcaccacacacgtccgccgtgactctggagaatccttctactcacacacacgtcgcgccgtggaca

SEQ ID NO: 723275 - DNA, 158 bp, Homo sapiens
tcagtctgtggctcatgcctgtgatcccagcactttgctaggctgagatggggggattgctttaggctaggagttcaagaccagcctggtcaacatagcaagactccatctctattttatttaaaaacatttttttaaatctttataaaaaaagaatg

SEQ ID NO: 723276 - DNA, 419 bp, Homo sapiens
  misc_feature (143)..(143): n is a, c, g, or t
  misc_feature (232)..(232): n is a, c, g, or t
  misc_feature (291)..(291): n is a, c, g, or t
  misc_feature (322)..(322): n is a, c, g, or t
  misc_feature (342)..(342): n is a, c, g, or t
  misc_feature (344)..(344): n is a, c, g, or t
  misc_feature (351)..(351): n is a, c, g, or t
  misc_feature (410)..(411): n is a, c, g, or t
agatgcttgttctgaaagtaagatcagtgaactgcttttcagtctcaatctttgagaattgtaaattcatcaaataattgcttacatagtaaaaatttaaggtattagaaaacctgcagaacaaataggattatatattaaanattttgatatgtaaagctctacacaaagctaaatatagtgtaataatgtttacactaataagcaaatatgttaatcttctcattttttnaactgtcaaataatcttagtgatatgcctattaatagttttaaatccaccaaaaggctnatctggctttttaaaaaaatatgaaattctnacagatgttgattaggtaancnacaaatnaatttcaattttaaaatgatgagataaaaataaatataagatttttcttgtgaatgtanncaattaat

SEQ ID NO: 723277 - DNA, 310 bp, Homo sapiens
cgtcgacctttttttcaacttgaaattataatattgattttattcatggtctgaaacatgtataccaagatgcactatagagtttctgtgtaatgaagacacttggctttgaccccctgggctcctctgctggctgttgagtcaatctattattttccaagtgtcctttctggctctctgaatccagaactgggtagactcattacaagaccaattctctggtaacacctgagcctgggtgttaacgtttttccctgcagacagaagtgatcagggttcccttgtgactacagaactttttcgtcgacgc

SEQ ID NO: 723278 - DNA, 224 bp, Homo sapiens
tccatcccaagatatggaccgaggatggaatgataattttcaaaaatatttgtaaggaggtttaggtgtcaaattgtgacttgaatttgatgaccttctaagcccttcctgatgttatgattctgttttaatttatatattgtcaaagactattcaaataaaaaacaccttctatgccaggtgctggaaacaaaaagataaacataacacagtctagtatttta

SEQ ID NO: 723279 - DNA, 504 bp, Homo sapiens
  misc_feature (55)..(55): n is a, c, g, or t
gtcacatgaggtccctcagccgtgtgtgggtcacactttcagaatgctggtactntggtgctgtaaaggaaatagcacttgaacataaatttaattttctcagcaaggtcatttttactttctgcagaaagggtacactcaccagcagtttggccaggagagtacaccgaacaaaggagacagggtcatttataacctgacgcgttcaccttactgctgtatctggtttccactggccagaacaggacctcgctttctgtatttgtcctgattggctagcaacttagaactttttaaaagagcaaaggtagaggagaacaaagggaggaggaagtaacttgtggaatgctgagaaaggtgaaaacacctccaaataaggaagaggaataggctatgacctaacgcccgcttggactagtataagcatgccagggcaaatatttaggcgaaattgcgggacctaagaacataaagtacgttgatttttcttttcttttttttttt

SEQ ID NO: 723280 - DNA, 800 bp, Homo sapiens
  misc_feature (99)..(99): n is a, c, g, or t
  misc_feature (368)..(368): n is a, c, g, or t
  misc_feature (528)..(528): n is a, c, g, or t
gatcagctgccgaatgataggcctgtaaggctctgcgaactcgaaccccgaccgaatccgttgctcccagcgcaggattgctgaagactgcacgacganagattttattacgcgtgagaggagcgccgaggggatgcctgtgagtgagaagtcctctgcagggaacacgaggacataacctcgggagatgagtaatgaggctgtgacatacatagggagacgccttgactatgcaatcgacagtcggtccctaaggcgtgtcaggaatagtcctagtaggacggacacgtacatgtgaggagctgaggcgcttgtgagcaaataggccaggagaacagagagcccctacgatcaggctcaactctggnaagacgtgtgtggcgataggaccttcagtcgtgatcactgacccacgtgctgatgagcctgctgccgtctgtttggtgcaagtgcgtcctcgtatgtatattgaggtcagtgactgagacgatcgagtccaggaaagttggtggcacgaataggataacntagctttttcttcaagtgaatggacttgatcactagaagcttccgcgttctgacaagaaggcgcgtagttgaaagatggctccatggaattgctcgaagaactcgagaatgagctagatgatttcgaatgacggggggttatgaaggctgggtaagctgtagaagattactagcgcagagtgactgggagaatatgaaaatacgtgggaattagaccttgtacgattgtgaaatttaattcagatgatttagtagggttaatgagaacgtgt

SEQ ID NO: 723281 - DNA, 890 bp, Homo sapiens
  misc_feature (69)..(69): n is a, c, g, or t
  misc_feature (73)..(74): n is a, c, g, or t
  misc_feature (81)..(81): n is a, c, g, or t
  misc_feature (88)..(88): n is a, c, g, or t
  misc_feature (90)..(90): n is a, c, g, or t
  misc_feature (96)..(96): n is a, c, g, or t
  misc_feature (117)..(117): n is a, c, g, or t
  misc_feature (123)..(123): n is a, c, g, or t
  misc_feature (134)..(135): n is a, c, g, or t
  misc_feature (147)..(147): n is a, c, g, or t
  misc_feature (154)..(154): n is a, c, g, or t
  misc_feature (156)..(156): n is a, c, g, or t
  misc_feature (160)..(160): n is a, c, g, or t
  misc_feature (163)..(163): n is a, c, g, or t
  misc_feature (173)..(173): n is a, c, g, or t
  misc_feature (177)..(178): n is a, c, g, or t
  misc_feature (196)..(196): n is a, c, g, or t
  misc_feature (198)..(198): n is a, c, g, or t
  misc_feature (205)..(205): n is a, c, g, or t
  misc_feature (210)..(210): n is a, c, g, or t
  misc_feature (226)..(226): n is a, c, g, or t
  misc_feature (228)..(229): n is a, c, g, or t
  misc_feature (246)..(246): n is a, c, g, or t
  misc_feature (249)..(249): n is a, c, g, or t
  misc_feature (253)..(253): n is a, c, g, or t
  misc_feature (287)..(287): n is a, c, g, or t
  misc_feature (294)..(294): n is a, c, g, or t
  misc_feature (298)..(298): n is a, c, g, or t
  misc_feature (315)..(315): n is a, c, g, or t
  misc_feature (885)..(885): n is a, c, g, or t
aaggacagcggatcttcaacacacacctatatggccatgcgagccacctacttggtggggtaacagggnaganncaaaccnggaggcngntttgantgagctgattcagcagaaaanaagganaggaacacagnnccacaggctgcnctgcgcnangggnganagggcagggngagnncccgggatggacctgggnanggggganatagngggggggggaggcggngnngggggcgggggcatggnagngggnggggcttgggtgggcgcctgcgggtcatagcgtnggcgggngtcnggcggcgagggagcggngagggaagtggggggcgaagattcagggggcctcggggggcgggggtgctcagccaccgggacagatgatgaaccacctcttcccggtgtgcaggactgaagggcagaacagaaacagcacgctgagtgagtgagcgcctttccaggccagtgtgacccccatcacctgcaccagacttgccacagtgggtctgtgaactcctttacacctatgggattttctccaggaagggtgtgggcagagaacactgttcccagtcattaatccccaacgcttccctccacgaagcaggtggttccccaggctccttggtaaagaggccctggtgatgggcttctgcctgctcttccctcacaccagagggcaaggggtgcacagcagaacctggggtgcctcactggcagcccccgaagctcccgagaggacccctcgcgtaggcttggttcctgggatgcccaaggcaccatccatgaaggccgtgatgccggttgcaggtgacagctcctcggacagggcagctgtccccagactggggcccctggtcaccacatgcttccataatccccccnaagca

SEQ ID NO: 723282 - DNA, 390 bp, Homo sapiens
aacatgacagtgctgaaggaagccatacctctgggcagagtaacgggcgagaccaccaagcactggccaaggcggtccaggttcaccaagacactctgcgcaccatgtactttgcttgacatgttttaatgtttaacgattgtgtaccgagtgggattctcgagaccagctacactcagacccacaaatgggcagcccttccggtgcaagcagccttggacattaagcggcctttgttttaattaaattcccggttttccaaaatcccttccgtcccagatttcaaacttggattttgaactgcagcccggattagaacccaatgtcataggaaaaatggtttgctaaaatttataagctggttattaaaacagagtaccgtgcgtccta

SEQ ID NO: 723283 - DNA, 836 bp, Homo sapiens
  misc_feature (2)..(2): n is a, c, g, or t
  misc_feature (72)..(72): n is a, c, g, or t
  misc_feature (84)..(84): n is a, c, g, or t
  misc_feature (86)..(86): n is a, c, g, or t
  misc_feature (109)..(109): n is a, c, g, or t
  misc_feature (113)..(113): n is a, c, g, or t
  misc_feature (115)..(115): n is a, c, g, or t
  misc_feature (211)..(211): n is a, c, g, or t
  misc_feature (244)..(245): n is a, c, g, or t
  misc_feature (248)..(248): n is a, c, g, or t
  misc_feature (455)..(455): n is a, c, g, or t
  misc_feature (539)..(539): n is a, c, g, or t
  misc_feature (588)..(588): n is a, c, g, or t
  misc_feature (616)..(616): n is a, c, g, or t
  misc_feature (671)..(671): n is a, c, g, or t
  misc_feature (674)..(674): n is a, c, g, or t
  misc_feature (769)..(769): n is a, c, g, or t
  misc_feature (795)..(795): n is a, c, g, or t
cnttgccgccgtctgcatttcctggaatattgctctttgaacacggccacattcaggtttgtcaaatatatnctcttccgcttntngagtcagttggatgtcatctctnactngngacaggggtttcttacaaggaggaagcttttcagaatcttttttaaatccaaagtttttccagagctcattgagtttgatctgttaccccggcttnttcttggcatttttttttttttttttttggttnnttnctggctttttgctcagcccactggctctggcaggtcctagaggtttgatcttggttgttgaaagagagtttgctgaactggacttatatagctcaggaaccttgttccttagaggtgtgtctttttttgagagatgagagaaacatagcttggaggtctggtcactttgactgttaagttacttaatattgcaattagattgctctnaattagagttcttactagagctctgagaaagctttgatgcatttgaactctgcagtgagatttctccactttcctgggactgtnaagaacatgccccttctcgtaagggatgagaattatcgtcactggactnctcgctctttaactgcgacaaatcaganatattattctcaggcaaagaggtgggggaatcgctctttcttcggaactcctgcnatnctgttcttggagaggggctcggcgttcttgaaaaatctccaagaactccagaacaactaaaaaaacttcttagtgttcccaaagtgggtggtganatggtccttgttaatttgctgctctnaaaagagtaggactcttcatctgttaacactgttgccttgt

SEQ ID NO: 723284 - DNA, 286 bp, Homo sapiens
atgatacatccacaaacagcgtgggcgtacacatcatgcatcgtccttagaagacggatcatcgatgcaactgtgagctgcgttctctacttgagttgctagcagaatagtaatcgaggatgtaagcccgtgggcgatctatcagaatgactgcgccggtcaagcttcacgcggtttggatgacaatggctgttactacgagggctatgtggttgattgaagagtatgcaatgagcgattttaggtctgtttgtgtaggtagcactctgtttgtggaggtagcact

SEQ ID NO: 723285 - DNA, 1497 bp, Homo sapiens
  misc_feature (863)..(863): n is a, c, g, or t
cgcacctgcgcgacctgcgacgccacccgcacacgcgcccgcctccacctccgcacgcagcctacacccctgcgccacacctgcacgcacctctgctctgcacccacgccccctctctgcacctgcacccacctgcacacccccctccctccgccgcacgccctccccccctctcccttccccgcctgcgccccacctcccttacccgccccccctacctgcgcctctctcctgcacgcacaccgcccccgcctcccctgccccccactccccacgcccgcaccgccccgcacggcccccacctcctcctaacccccgctctgcccctacttccacaccgcgccgcctctcacctgcaccttgcctcgcacctctcgcccctccacacgaccccctcccaccactcctctgcgccgcacccctcgcgccgcacacaccacccgcgccccccacccaccttctcctgccccccaccgtcaacctccgcactctctcccttgcccacagcccacgcacctctggcgacacctctcacgcacctcctctatcaccaacacgcgcccctaacctccacaccgccgcccccctcttgcgctctccctcttatgctctaacccccccaacccccttccgccacgccaaaacctttgcgcccctcctacgcccagcaacttaacaccgcacacgcgctggcgctccactggccaccctacgcgcacgcaccctacccactgcgcgcccgcccgctcccctgcctcacccgccccctggcctactccgcgcgcgcgccacccatacccgctgcccgctgccctgacggcgctgccacgcacacaccctggcacgacactgcgcacacgcantccccccaccactccactccgctgcgcgcctacccccccctgcgccccagcttgctgctatctgcatctaacctgcctctaaccccgcgcacgcaataccctggcttcgccccccaaacaactaacacttcaaacgaactgcctccctggcgtacctgggcatctgcaaacgccgtgacccgacacaactgctctaaacgccccgctgggcactctcacacgtgccacccacgcactcctactgcacccctactttcccaaaaacaggcctcaaactaggccaaccacccccagagcttaccgttcttctggccttgcttccaagcccgaccaaactggcccttttcctgcaatggctggcctctggcaagccgctgaaccaccaccaaagcttcccttgcacgggaaccccccaccttccggcgacttcccccttggctcccaccgacacgggcgaccgaggcttttgagcccccttgggacgcgggggctactcccgccccacggcttcctccccacttcccccggctgtgctacgccgccccaccgccggcccccgccccctttcgccccccccccccctcccgtgcccccccccccctccacccccctgtccccctcccccccgccctgt

SEQ ID NO: 723286 - DNA, 900 bp, Homo sapiens
tgtgtctctgctgaagaacctgaagtcacgccaatattgtgaccctgcatgacctcatccacacaggatcggatccctcaccctggtgttttgatgtacctgtgcacacgtgacctgaatgacagtaatcttggaccagctgtgggaacctcatgatcatgctacaaaccggtccatgattttctatgttccagtcttgcttctctgtgggacctcgctcctactgtcacctacacgccaagtatcctgctaaccaggtgacctgaagcccccaagaaccctgctcatcaacagagaggggggagctgaagctggatcgactatggactggccagtcgcgccaagagtcatgattgcgccacagacagagcttagctctccaattgcaagcgtcggttgtcgctcgttgtcgcgctacatggcctccccctgacttgttgctcgctttggcgatccatcgagagatgctacgtcctcctcctcgagttgagtttgggttgcgtggctgtgggcctcgggtctcaacatactgactagttggccgcccagggacgcccccgtcttctcgcggggctcctaggtggccagttgagctgacgcttggagctcgatctgttgcgggctcgctcggggacgccccacaccgacatacgactgttggcccctggtcggttggacggcgtccgttctcttgggagcttcacgtcatctggcagcctttcctccgtggctaccttgccgcgtcagccgctccatcctaccaatgcggcccaccgttgggatccccgatggcattcggcctcactgagcctccggtcgtgaatggtaccacaccgcactttgtagcaaccgcttgcttagctctctgacttcggcctggggagcggtgcccctgacacg

SEQ ID NO: 723287 - DNA, 760 bp, Homo sapiens
aaactgttactacagcgattctgtctggcacgcgcggcctaataggtagtattaacatggtacatacctgtttcctcatgagatcctgctcgatgagttacgttagtttgctgtactcctcactgatctgcctggcctcgaagtcgctccacacgagtggttgcgtggatatcacagtgccggatgatgcgcagttgctgcacgcgtgcactttacttgttatcctattcataacgagagagtgcgcagattgggcgactacgtatatcttatatttacagacttccggcttgttgaaattaatagtgttttcttttgggaaatttttaatttttgtttattttgctttgttttctttttcatggaagccttaatggtgaagcaaggcaatgacacgaggacaacaaatcatagcaacttggttgaacttgcaaaatgtacctaggtcacacccccttctttacttcaagcagaaactaaacccaaactggaaacctattttgacctgagctgaaagctttggccatttcttatgcccactatttaccctctaggaagaagcatggaaaacttctctagcttttaccagtacacctttctaaataccatttcccactggagaaatggctgatttctgggtcaggagaacacatgtacctaggcaaatgaggtatatcttgtcattccagataaacaaaaaagacgtacaagattgcactgccaaaggactcaggagccaaaagaactgagaatatgccat

SEQ ID NO: 723288 - DNA, 651 bp, Homo sapiens
tgtttcacccgtacctgggaaaacatcgcgtgaccaaaccagggcttctaatcacacgaaacgtggggctcacctatggagaactggaacgcacgcctgtttccaagcgccgcccaatgggggttgtgcacacacagctaaatcgggccacgtgggagcaaatcgcttttaacgcctcctaaaccctaaattctctctttcctactaaggcggttatctggaactctttgctgcctatgaacggttgataaggccctcgtgtttaggataacaccttccagcatcttcctggtgggaaatccaagtacgggtattaggccccctcctgactgtgggaatagacccaacggctggtcaatatatgcgcttagttatgcttatagagagttcgcaaataggtcatactctaaataacgcgtgctctgctaacagaggcctgtacggactgttattggattcagggacagtccctgactcggtgcagtccgcctatctaagaggttcgtttgttcaagcgatgtaaagtgcctacgtgatctgagtctcagaccggagtaatccaggtcggtttctatcatacattcaaattccttcctgtacgaaaggacaagagaaataaggcctactcacaagtacctccccgaaatggac

SEQ ID NO: 723289 - DNA, 277 bp, Homo sapiens
ccccgcgtgtacgagataagcaggatgtactaggggaatgtaaaaggcaaacttaaacacctgcatcttcttgaagcatcagttttacgttaccaaagtggtttagcagtcataagatgacctatttttatataaaagttatattatagaataaaatgttcatacgcatcgacggttaaggcatcaaacatcaggatctggcacaggtaattcttatttgccacagtgggttatgtgttcactctcctctcacctttcatggtctttgggtgttcca

SEQ ID NO: 723290 - DNA, 897 bp, Homo sapiens
  misc_feature (63)..(63): n is a, c, g, or t
  misc_feature (377)..(377): n is a, c, g, or t
  misc_feature (498)..(498): n is a, c, g, or t
  misc_feature (553)..(554): n is a, c, g, or t
  misc_feature (557)..(557): n is a, c, g, or t
  misc_feature (559)..(559): n is a, c, g, or t
  misc_feature (562)..(562): n is a, c, g, or t
  misc_feature (565)..(565): n is a, c, g, or t
  misc_feature (715)..(716): n is a, c, g, or t
  misc_feature (732)..(732): n is a, c, g, or t
  misc_feature (736)..(736): n is a, c, g, or t
  misc_feature (739)..(740): n is a, c, g, or t
agaaggaaaaacaggacaaaatctacttcatggctgggtcaagcagaaaggaggcggaatctnctccattgttgagagacttctgaagaagggctatgaagtcatttatctcacagagcctgtggatgaatactgcattcaggctcttcccgagttgatgggaagaggtttcagaatgttgccaaagaaggggtgaagttgatgagagtgagaaaactaaagaaagtcgggaagcaacagagaaggagttgaacctctgctcaactggatgaaagataaggccctcaaggacaagatagaaaaggctgtggtgtcgcagcgcctcacagagtctccctgtgctcttgtggccagtcagtatggatggtctggcaacntggagaggatcatgaaggcacaagcataccagacgggcaaggacatctctacaaattactatgccagtcaaaagaaaacgttcgaaatcaatcctagacacccactgatcagagacatgtngcggcggattaaggaagatgaagatgacaagacagtcatggatcttgctgtagtnngtngnaanggnaacacttcggtcaggatatcttctaccagacaccaaggcgtatggagatagaatagaaagaatgcttcggctcagtttaaacaatgaccctgaagcacaggtggaggaagaaccagaagaagagcctgaagacacctcagaagaggcagnngactcagagcggatgngggnganngagatggtgccggcacgaagaggaaggcggggaacgcaagggatctcgagaaggtgactgaatttacctcggaggaccgggggaggagggagttgaaggccttggagaacgggggggtccaccctctccgcggaaagggtgggccggggaggcaggg

SEQ ID NO: 723291 - DNA, 138 bp, Homo sapiens
gccgccgatgtgcatggctgctgaatggttcaagagtgtgaattccagtgacagatggaagctgcatcaccttttatgacctagctttggaagttacacagcttcatctctgctgcattcttttttttctttcttaaa

SEQ ID NO: 723292 - DNA, 101 bp, Homo sapiens
ctagaggatctctgggatgaggacgtactgattctacagtaaagggaaaaaaggggagtagtttccgaaattgaagatgaggagaaatttcttctatgggt

SEQ ID NO: 723293 - DNA, 124 bp, Homo sapiens
ggcgttctagaggatatctaacggcggtgcagcaggactgcgtaacacgtacggcagttatagagtgccaatgccgcagtggcttcgtcctccatgacaacaagcacagcaccagcacgaatat

SEQ ID NO: 723294 - DNA, 533 bp, Homo sapiens
acgggcggcaactaggacaccagcaagaaagagaacaagcccacagaatggggaaaaaaaaaagcgaatcatatatccaggatcatatatctttaataaaatagagtaaaaaaactcttacaatgcaataataaaaataactcaattaaaaaatgagcaaaggacccaaatagacatttcttcaaagaagatatacaaatggccaatgaaacatgtgaaaagatgctgaatatcatcagggatatcacagttattagggaaatgcaaacccaaacaacgagctgccactccacacctgctaggaagggtatcatgaaaaaggtagtatcaagagttggcaaggatgtgaagaaactggagccctcataaactactggtggcagtcgaaaatggtatggccactttggaagaagtctgggagttcctcaataggttaaatatagattaccatataacccagcagttccactcctaggtattaaccaagagaaatgaaacatatgaccaactgggtaagtacgaggggatcccta

SEQ ID NO: 723295 - DNA, 579 bp, Homo sapiens
ctcggcgggggagcggaaggcttgaattattccgacctgtgagcggcccctgtgcaccaaaaaaacaaaaaaaaaaaataaaaaaaaataaaaaatagaggccaaaaaaagtggaatgtttcacctggtcacatccgcaataaattcctgaaaaaccaaatgggtttaaagacgaacgacattacccaggaacccacttagtaccagcagagtgacgcgagaccttcgagcggacgtacataccagcatgggggcggggaaatacgagagaatgcgaaggagaaacaccccggagcatgaggagcacccgccaaagacggataatgggcgaacatagcgacataaagggagtacgccgccatagaaaacaatcaccagaggacaacacaatagaaatacaagcccacagcgagagggtgcacaacaccgaaattcccttgggaccgggactatatactgaaaccacaggcaaaacaataacggcccgaggggaaacaatgtgacaggcaccaccacccacaaaaaggcgaacaaacacacacaaaaaagagggaagagcaaaaaaactccacaacaaat

SEQ ID NO: 723296 - DNA, 480 bp, Homo sapiens
atcaacgatcagtcaggaaacacaatattgacacaagcttagtactaccaccaagatcgttcctcttgccttggccatactaaaaaactttacttatgtcactaacagtcatggtgactacagattctgcctctctcatgtaagcagctatataagctagggttctaccagccttagctgacaggaaaaacttggctggaagccctgtaacaatcacttcattcacaatctgacgaatgaaagacaactttggctgtcaatacactacctgtcagtacaaggaagtccacctgtaaaaaaatctgcacatcactgtacaagtgtgatcggacgggcctgaaaattaacgcaacataggaattaactgcataatttagcaagcactctctaccccatgactgtaatcatgtatgcagagcagagatcagacactgagaggagatggcttctgataagcaagggggaagggagtgagtgtca

SEQ ID NO: 723297 - DNA, 295 bp, Homo sapiens
  misc_feature (14)..(16): n is a, c, g, or t
  misc_feature (146)..(146): n is a, c, g, or t
  misc_feature (148)..(148): n is a, c, g, or t
  misc_feature (152)..(152): n is a, c, g, or t
  misc_feature (190)..(193): n is a, c, g, or t
  misc_feature (199)..(200): n is a, c, g, or t
  misc_feature (203)..(203): n is a, c, g, or t
  misc_feature (212)..(212): n is a, c, g, or t
  misc_feature (250)..(250): n is a, c, g, or t
  misc_feature (271)..(271): n is a, c, g, or t
  misc_feature (275)..(275): n is a, c, g, or t
  misc_feature (278)..(278): n is a, c, g, or t
aggaggtgtgctannntctatcacaggctttctcaattaggtttgcaggagaaaaagccctaagtccctgtgtcatctagaatggtactaattatgtacagtccctaggagaatggagaaaatcataactcaaatcatcgactcantntctnttctcttcagatgagctcagagagcacataggagtccnnnnaataannggnatgtaatgnttgagataaaggattgagcttacataaacatctcgggnacaaatgcagcatagaaaacntctntgntagttaccctgagggga

SEQ ID NO: 723298 - DNA, 516 bp, Homo sapiens
  misc_feature (142)..(142): n is a, c, g, or t
  misc_feature (149)..(149): n is a, c, g, or t
tttttcagaatcgtactggagtccaaatcacttctaccacatgtaatttaaaaacatagtgaaagatgttaaacggatcataagatgcacactgaaaacacagttattgaaaaatcttgttcctagattggagttaaccatntccgctnacatatcaaaccaaatcattgtcatgatgctaagctagtgtatagacagagatatgagactcacatttttctaactgcaaagcaccctgattaagcaaatatttttgtagatgcttgagtcagaaaattggcgttttgggcattcttaaactgaattagaaacttctgaagaaaaacaaaggtagttatgattttaaaggcattagcgtaaggcaccaaagtctcaggattctttgatctagctactgtattttcttaacttcgttgcaacttgtcaaagagaatattaatattaaaggcatttgcaaaaaatctgaaatatgcttgtatctcctttccgtctcaaatttttaatcattactttaca

SEQ ID NO: 723299 - DNA, 145 bp, Homo sapiens
cccggcccactgtgctggctctttttctgtgggtttctcccaggctggcggctcctggctgcatgcccccagtcttgcaccatccatctccatggcctcccacattcacagccagcacgctgtcccacccacccccggggtcccg

SEQ ID NO: 723300 - DNA, 344 bp, Homo sapiens
tcttcagccacttctccagctcctacaggttctggtctaagtagtcagtgacccgtctctccttcatctcaccaggtctcccttcacaccgtctagccagaatatcttgaaaagttttttcagaaggtgcttaagatatctggctttctacaaagtgcctagacccaaccttgtaatatttttctaggtaatcccaagggttaaaatggcttagataggtgtccttgaagttaacgcctgattccattatgtctcacttctgtacctctgagagcactgccctccttctctttcctacaaaacacagagagtgaccctgcaaaaggtgtcttcctgagtctcag

SEQ ID NO: 723301 - DNA, 141 bp, Homo sapiens
  misc_feature (117)..(117): n is a, c, g, or t
tggtccgcgttcgcttagctgaaagagtttctaactgggagaccaataattcagctctccactgtgcaaagcatctgtcatttctataataaaagtcttcccatgttcagtccactntggctctggaacctggatgagtca

SEQ ID NO: 723302 - DNA, 190 bp, Homo sapiens
cggaatcagcggggaacgatctaatctgccgtgggcctgtcgtgccagtcctgggagcgagatcggagtcagaaatagagttcaattactacacgagcattcaatcaaattcattagaataattataagtatccgtccaggcagtgacagacaggattgcatttagtagataaaacgtgtaaaacttgaa

SEQ ID NO: 723303 - DNA, 1054 bp, Homo sapiens
  misc_feature (313)..(313): n is a, c, g, or t
ggtccagcaaagttcgtcagcttgaactggccaagaaccgcctctatcaggccattcatgagagctgatgacatcttggcacctgaagttctgcatggagtggagttcaggactgcttgtgaggagtgaagattactgagacatggctgcgtgcacatattcatcggtacttgtgcctggacaagtcgggtcattgagctcagccgacagggcaaagcaggggagcactgattgatcgccaacctgaaacttgctgcaggcaagctgagcaacgtctcagagccattgtggctaggagaagtttgccagttanacaccaaggaaggtgatttgccccaggtggagcgcttcttcaagatcttcccactgctgggtttgcatgaggagggattaacgaacagttctcggagtacctttgcaagcaggtggccagtaaagctgaggagaatctgctcatggtgctggggacagacatgagtgatcggagcagctgcagtcatctttgcagatcacacttactcttctgctttgacagggattgcccgcatctgctggagacccaccaaccactagtggagacctaattatgggccagggagactctataccctgatcacatatctgcaggtggacatgtgcacagacacggttggacacacgtcggtagcacaacttcacgccagccaaagaggactacccagcccgacagttgccgggcactgctgcgagatccgcccctgcttcagaacataccgcaccaccacgaacacagatgtgaacccctgatgaccctgtgaccccagtccatgcactgaagggacccgcacctgcaatttgaagtgacccgccttcggcagcgtacacagctcagagccggctacccctcctacgaaacagcagggcatacgcgtcacttaatctctcgagggttgggaagcacatctccagtggtcctgaagaggcgcaagtagcgacgacgcgcaacccccgcacagggcacgctgcacaaacccacttcacataaccggtacttcacgaagcggcgagcagcggc

SEQ ID NO: 723304 - DNA, 105 bp, Homo sapiens
gtaccactttttttagagatagggtctaactgttgcccggctgccgtgagctgtgatcgcacccctgcactcccagcctgggccaccgagtggaccccgtctgta

SEQ ID NO: 723305 - DNA, 608 bp, Homo sapiens
gagttagagcaccaatctatgttagatggtcctagtatcaatgcctctttagaggtatggtctccacagggagagatggatgctggatttgtagccatttatatacaccgggtccagacagaataaagtaaaaaaaaaaaaaaaatggccaaaatcagcagatggtgacaaaagtgatccctggctgccctcattgttcattagcataagacacttccaccagccccatggcagtttataagtgctatggcaacaaccttgaagtcaccactcctttccatggcaatgacctggaagttactgccccttttctagaaagttctaattaacctgcctgtcaattcacatcagcctgccccttaatttgcatataattgaaagtggatatacatgagtataaatacagttgccaacagcccatacttagctgactttgggtgcacagcctatgagttagcctgctctgcaaggagcagtaccgttcaagcaaatgttgctatctaacaccactaacttaaccttaagttctttcctagccaaagccaagaacttctgctaagccccagttttggggctcacttgtcctgcattactaggaggaaagttat

SEQ ID NO: 723306 - DNA, 728 bp, Homo sapiens
  misc_feature (235)..(235): n is a, c, g, or t
tttccccaggggttgtttttttttgacgctcatccgtcccattccccatagcgttttttttctgaggttttgcaagagttaacttacctcgggcgggttatggtttcccaaagtgtgtgtgtataccggcggtgggtgttcccaacccagcacatctttgtgggcgtgtccgttggaaagctaaggggcaagttccagtcttgttcacgggttattgtggcccacttgggccagntggaaggggtttggcattcgcttcctctctggggacccccaagagctgcttggggaaaagcagattatggtgtggttgcccccgtggtcttcttgcgcaaacagaccaagttgtttctctaagggggccccagccagggggagggtgagggccggggaacccctcccccctccttggcagggggcaaagcacggagcttcagctttaagttggacagcgaggagtgaggcccaccccagcctggccttgggttttttattgacccaccccagggggccaagggggttgggtttgggaggttggggacccaaatttttggccccagggttggcccccccagcccccccccttatttttcggtgtgctcctgggtgttatttcccttttattttaggggacccagccccggggggagggaggagggggtgggcatgggcccaaaggtttttccagtgtgtttaaatccttgaaaataaaccccccctgcccccca

SEQ ID NO: 723307 - DNA, 961 bp, Homo sapiens
  misc_feature (817)..(817): n is a, c, g, or t
  misc_feature (831)..(831): n is a, c, g, or t
  misc_feature (845)..(845): n is a, c, g, or t
  misc_feature (896)..(896): n is a, c, g, or t
  misc_feature (931)..(931): n is a, c, g, or t
  misc_feature (941)..(941): n is a, c, g, or t
gcaggctggtactggtccccaagtcgttacatagagttcttccagaatgtctccatggtgtctgctgcccccccaggtccccgagtgccgccagggcccaactcatcacccctacggcactaatcggtgcatgcaggagcagagacgctggcagctgggctgcactggggatggacaacgcacacgagaattcacacacatctggcattgtcctttggtgcgatctgtgcccggagtggaccagttgggctggtcaactctggcaggacagctgtgtggtgaatccggtcagacttggccgtgtgaggctggagctccctatgcttgagctgattggctgcaggggagcttcgtcttgggcaaggaagggaccgatcggtaccgcatggtagtacgggggtgcccaggcaggggacgcagtgcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcacggggcacttcccccagcaggccgtcatgctgcatactctgtaggtcgggagatggcacctgcgggggcaccttgggcccgtgccgcctggtagcccagcttgaacacagagggatgtgggcagcctgggccctggctatgagggccgacacattgccatggagaaggtggcatccagaacataccggctacggctagaggctgncaggcctggtgatncgggcacctaccgntccctcgccaaagcctatgttcgagggtctgggacccggctttcgtgaagnagccagtgcccgttcccggcctctccctgttacangttgcgggangaaggtgagagggggcttgg

SEQ ID NO: 723308 - DNA, 767 bp, Homo sapiens
  misc_feature (599)..(599): n is a, c, g, or t
  misc_feature (665)..(665): n is a, c, g, or t
  misc_feature (676)..(676): n is a, c, g, or t
  misc_feature (697)..(697): n is a, c, g, or t
  misc_feature (719)..(719): n is a, c, g, or t
  misc_feature (734)..(734): n is a, c, g, or t
  misc_feature (761)..(761): n is a, c, g, or t
gcaggctggtactggtccccaagtcgttacatagagttcttccagaatgtctccatggtgtctgctgcccccccaggtccccgagtgccgccagggcccaactcatcacccctacggcactaatcggtgcatgcaggagcagagacgctggcagctgggctgcactggggatggacaacgcacacgagaattcacacacatctggcattgtcctttggtgcgatctgtgcccggagtggaccagttgggctggtcaactctggcaggacagctgtgtggtgaatccggtcagacttggccgtgtgaggctggagctccctatgcttgagctgattggctgcaggggagcttcgtcttgggcaaggaagggaccgatcggtaccgcatggtagtacgggggtgcccaggcaggggacgcagtgcacctaccactgcactgccgctgagtggattcaggatcctgatggcagctgggcccagattgcagagaaaagggccgtcctggcccacgtggatgtgcagacgcctgtgtaagtgcccacttatacatcccactgtgggagctgggaagggaacagtatcctggtgggcactgtggnccacagggggtacccagatagcccatcatactgactccaaggaactcatcttcccacagaagttgnagcagccttgnctagcatttctctcccccggncccttgaatgggttttctctgnctcagaaattgggtnatagagataggcaggccccatgcctgnaggggt

SEQ ID NO: 723309 - DNA, 296 bp, Homo sapiens
cacaacgtataagtgcatcaagcgaatgtggcatagacacacaatggaatggtatgcagccatgaaaaaggaaatcctaccatttgcagcaacatgggtgggactgaaagatacaatgtgaagtgaaatgaaccaggcacagagagacaaatatcgtatcatctcataggtagaatctaaaaaagctgaacgcataaacgcagagagtgcaatggtggttgccagggcaagactgcttcatgaacgtgtttggcaaagaacataacatttcagttggaggccaggatcgctgtctc

SEQ ID NO: 723310 - DNA, 783 bp, Homo sapiens
  misc_feature (639)..(639): n is a, c, g, or t
  misc_feature (653)..(653): n is a, c, g, or t
  misc_feature (667)..(667): n is a, c, g, or t
  misc_feature (718)..(718): n is a, c, g, or t
  misc_feature (753)..(753): n is a, c, g, or t
  misc_feature (763)..(763): n is a, c, g, or t
gcaggctggtactggtccccaagtcgttacatagagttcttccagaatgtctccatggtgtctgctgcccccccaggtccccgagtgccgccagggcccaactcatcacccctacggcactaatcggtgcatgcaggagcagagacgctggcagctgggctgcactggggatggacaacgcacacgagaattcacacacatctggcattgtcctttggtgcgatctgtgcccggagtggaccagttgggctggtcaactctggcaggacagctgtgtggtgaatccggtcagacttggccgtgtgaggctggagctccctatgcttgagctgattggctgcaggggagcttcgtcttgggcaaggaagggaccgatcggtaccgcatggtagtacgggggtgcccaggcaggggacgcagtgcacctaccactgcactgccgctgagtggattcaggatcctgatggcagctgggcccagattgcagagaaaagggccgtcctggcccacgtggatgtgcagacgctgtccagccagctggcagtgacagtggggcagcctgggccctggctatgagggccgacacattgccatggagaaggtggcatccagaacataccggctacggctagaggctgncaggcctggtgatncgggcacctaccgntccctcgccaaagcctatgttcgagggtctgggacccggctttcgtgaagnagccagtgcccgttcccggcctctccctgttacangttgcgggangaaggtgagagggggcttgg

SEQ ID NO: 723311 - DNA, 408 bp, Homo sapiens
tgcacatcacaaggtcgggagatggataccatcctggctaacacggtgaaaccccgtctctactaaagatacaaaaaatcagctgggcgaggtggcgggcgcctgtggtcccagctactcgggaggctgaggcaggagaatggtgtggacctgggaggcggagcttgcggtgagccgagatcgcgccactgcactccagcctgggtgacacagcgggactctgtttcaaaaaaaaaaagagtatctaggcttccctctgggatgtggggaaactgaggctcagagagaagaagtggggtgattggccttcaggcagtaggtttagtttggcccccagccccagcacatcctcgggcgaccttgtgtgctccatgcctgaggtcccgggacagaacagtggacgggtca

SEQ ID NO: 723312 - DNA, 144 bp, Homo sapiens
tactctgagatcccgatggtgcgatgtgcagatgagtcctggtgagctgtcactgaggagaatgcatgtggtgtgcatcagaagtacaacacggatctgtctgttggaaactcgttctaaatgtcttcccttctgtcgtcttct

SEQ ID NO: 723313 - DNA, 645 bp, Homo sapiens
ggggtctcgctctctcacccaggctggagtgcagaagcatgatctcgtgctcactgcagccttgaacctcccggcctcgtggtcgattctcctgcctcagacctcccaagtacgctgggcccacggtcatgtgccatccacacctggctaattttgtatattttgttgtacagactgagagtttcatgtgctgcccaggatgagccactgtgcccggccaaatgagactatttatgatgatcataaggactcaagataagggtaaggatgcgagagattgaagtgtactaattacgtagtgtggtcaccgggggtggtggtctcgacaccttgaagtcactagcactttggcgtaggctgaggcatggtagtattgcttgaggtcagagttcaagaccagcctgggcgattagcaagaccctggtctctacacaatatttgaacatttgctgggcatggtggcgatatgcctgtggtcccagctactcatggagtgcggacggtgtggacggatccccttgggcccgggtagtttcaaggctgcattgagctatgtatatcagcaatgtcgctccagcctgggtgacagagctccgaccttgtctcttgatacaaggggaaaccagaacatgctgtatttaccat

SEQ ID NO: 723314 - DNA, 182 bp, Homo sapiens
caatgctcgaagttcgcgccgcagatcacgccggaggctacatcatcctcgacgtggagcagtcaacaaggacagccgtgggcgagaccacgcgctgcgggcatcgcgaccaaacaccaagcacgtgaagacccaggtactggtcgagaacggcggcccggtggtaatcggcggcatcttcg

SEQ ID NO: 723315 - DNA, 274 bp, Homo sapiens
tcggacgaggtaaggacaaggagatgggtgtctttctaaaacatatttatataaaaacacatacccacttagtagtgtggaatacacaggttggtaacaagaaaacagtctctcccattctctagtacggctcccctacccagcagtcacttccagttcattcagctattttaaaaaggtgcttatatgactctggctggatatatcaatcttagacattacctgtggactccctgtggtcatacatgaggctttagctctctttggtcagcaa

SEQ ID NO: 723316 - DNA, 134 bp, Homo sapiens
  misc_feature (18)..(18): n is a, c, g, or t
  misc_feature (86)..(86): n is a, c, g, or t
  misc_feature (105)..(105): n is a, c, g, or t
ttgcgcttgctttgcgantcagacgaaccgaggacggatgcgggatcgccttgcgcgacacttgaccttgatcgcgccgtcttggngagcttgagaatgcgctgntcggcgtcgaacgagaagccgcgctcggt

SEQ ID NO: 723317 - DNA, 302 bp, Homo sapiens
gtgttgggacagtgttccctctgtggcccaggctggatcacaaactcctggccttaagtgaccctcctgccttgcactctcaaagtgctgggataacagatgtgagccactgagcccagccataggaaacagcctcttaagccaagtgcactgactacttgaactccccagagcctctgtgcattgctacctcgaattcagcttcacagatgtatgcaactgtgggatcaggttaggggcactcacttaccggcaggtcccaaaagctctggagagtctgtgctgagggaatggtccatgtt

SEQ ID NO: 723318 - DNA, 1014 bp, Homo sapiens
gtggagaccctgactccaccctctcgtgtgcagtctctcttatcacattaggtgaccttacctggtacagggagaggccgtctctaatgggtctccctgggatgtctcatgatgcacatggaagattggtgcaatatgatgatgggtgcagtggcgatgacacatgttaggcagatgacagcagaatgatctgtgtgctagagttggtgtgttctctggatagatggtagtgccctagtagtcagcattttgcagcgtgtaaaactttcagggaaacaaacagatgtgagggtaaagcactacataaaggggtgagatcatccattgagaaggaatccggaaaacaaaacggcacaaaggctcaaaagtccacatcaaagagtcagtggggcgagcagagaacagacgctggagggtgaattggggcataacccttgcataatgcgccaatggccatctttcagataaacacggacagctcccttcaccaaaaggatcccaggcaggcggcagaacacacaagggccagcaccgataatgaaaggaataacaatacatgccagcatgcaagcattcgtggattcgataaacaaggcaatctggaagcatcacattggtggacaataaactaaggccgacgcaacaatctatcgacactcccctcatcacaacctccaagagactgactaaagggtcgagaagcacaactcgcatggccatcagacacagggggggacacacaccgcgtatgcaaagctcgagcctacagcaacaaggcccgaaggccccgacaagcagagacaggaagcacacagctaaccgaacaacacgcatgagagcaaaagacgacagagcacgccaaacagcccaaaagcagagcacaagggcaaccaaaagacaagcccgccagcacaagaaagcgacaacaggaacaacacgcagacaagcgggatcggcaccgacaccacgcgggctagcaaagcgacagagcagaaaggagacagacataaccaa

SEQ ID NO: 723319 - DNA, 288 bp, Homo sapiens
aatgaaattcaacaaaggaatcccaacctgggcccccttcaacccagcaacccagataaccaagcagaagtggaaggcagaaccagtttacgcgcagcgggccaaggcttatctgaaggaggggcgccctagcactctgtagaaatatctgaaatacagcaaaaatatcccgaaccagcaagctccttcctatgcagcagaaaccaaccaccaggcctcaggagcaaagaagaaactacagtgctaacttgcgacttatatccagaacaaactgacgtacactggact

SEQ ID NO: 723320 - DNA, 150 bp, Homo sapiens
atgcatgcatgagacctcagtctggccctatgtcagggctccatgttaaaccattccatggtccaacatcataccttgtggccgcccttatatcctgtcacccaggtcaactcaagacgatggttgggtaagtgtggttcatccatcgtc

SEQ ID NO: 723321 - DNA, 333 bp, Homo sapiens
ccattgtgggaaaaacggtaccgggagggtccccctaaagaaaattgaaaaatagaacctaccccacataacccccagtaatccccctctccctgtgtttgtaccccaaaggaaacgaaatcacccatccctataaaaatatgcattcctatgtttattgcagcattattcacaatagccaagatatggaagcaacttaagtgtccatccactaatgaatggataaaggatttgtggcatagaatactatttagcttaaaaatggaggtcctaccatttttgacagcatggatgaacctaggggacattatgctacatgaagtaagccagaca

SEQ ID NO: 723322 - DNA, 279 bp, Homo sapiens
actgacttcactatttccttggttctccattattctttcctttaacctctctccttcttgacaatctcactctaattcgcaccggttatgatttcaccatgtgcctgtaactagtttcaaattcattactgtaaactgcaaggaacgggaaattcccaggtatggtttgatcgaggtcaggattcaaaggcacctgcttttaacctgtgggaccttgcttaattgaacaacatacttccttactatattggtggcaaactttcaagaagcaggacctga

SEQ ID NO: 723323 - DNA, 264 bp, Homo sapiens
tgggccagtaaactgacaacctacaaaaaaaaacccccatgttcttaaaaatgcttttgaaaaacatcaagccctgtggtaatttctactgttttaaaataagggcaactgcttaaaagaaaatggccaaattaggctttttccctctctggcagggccaaccatgtgctttagctgcaggttgattttactttagatttacttagtctcccctttcactttacagacccgtgcccagtttttggcctcctcttattttcctta

SEQ ID NO: 723324 - DNA, 667 bp, Homo sapiens
cacaagcgttatgtgcttatgataaaaaaagcccttgccgtaggaaaagcagcctagatcacattatggatgtggcagtaataccaaccagtgtacctctgaccttcttattaaaagagctggggcgctttgaagataatccctacccctctcccccaaaagcaggtgaagcattttacagaggtttgccattacgggattcattcagataatgatttcctactaagagaaacaaactttaaacactttttataatcttgaaaataattaaaacaaaggtaaagggcccgggaaatattatatttttctttactaaccattatggatttatggctttgtgatattgtgcgggaacatacttatgtcctgaagagaactgctctcagtgaaataaaagataatagtgcgaggcttacatatctcaattgaggataagattgtgggggatatgtggctcctgaggcattttgacttgtccttataaaagactttatatatttcttttaagactgatttcaatcttattggcgccaccccgatttcagtatgacctgtgtaaggactgggagtacttggtcggcagcaccaaatctggtgtgggtggataccatgcgtcttcggcagggtgccttcatttacacccgggtgggagggttcttttggttgc

SEQ ID NO: 723325 - DNA, 123 bp, Homo sapiens
gctttttcctttctcttttttcttgttccaatcgttcctcttctttacgcttggcttctaattcttcaagccgttttatacgttcttcctcttctcccttctgtcgtcttctcaaaccgtcca

SEQ ID NO: 723326 - DNA, 778 bp, Homo sapiens
tgtctgaggcagccgccctcgctgcatgtgcaagttacttggtcttatcgtatgcttctggtccaggctaataatagttatcaccttaatgcgtttaattttggttcttctagttttaacgggagaaattaactccccggggccgccgggttgactgcgctgcctgggccggaggtcttctccggccagggagcgctgtgggaaggggctcgagcggccagggccaggcgaggccggggggtgcggggggttaggggaccgcggggctactcttgggagcgcccctgtccggctggctgcgcgccggtttcaatagcatacttcggacttgtcttcgcggccaccagtccccgagctcggacgctgacctgggctcctgcaagcctctccctaagtcttctccaaacgaacacctcacggattccttatggatcgcagctccaaagaggaggcaggtgaagccttaggaccagcttctctgctggaagctctcgattatgatagttcagatgacagtgatatccacagaggagatgcatcaggactcgctgattcttgagaagagtcaaaactggagctctcaaaaactggcccatattctgattagctgtgtatgtctgggagatactagtgagtgacgctgactgaaataaattcagatggtgacaatgtggcattacaggtccatgacggctgtcatgaacgttgatggagacagtgactctatcatgagtcagatgcttgaaaaatcagatgaacatggtgagtgcagccgaga

SEQ ID NO: 723327 - DNA, 107 bp, Homo sapiens
actctttcgacccctttcctgatgcaagtaagggtaatgacctcttcccgctggcacttagggttttatccccttataggttaacacagaaaccgcacagaggcccc

SEQ ID NO: 723328 - DNA, 433 bp, Homo sapiens
  misc_feature (41)..(41): n is a, c, g, or t
  misc_feature (304)..(304): n is a, c, g, or t
  misc_feature (370)..(370): n is a, c, g, or t
  misc_feature (400)..(400): n is a, c, g, or t
  misc_feature (411)..(411): n is a, c, g, or t
caaggctgggtgaccaagtgagaccctctctcaccaaaaantgaaaaaaaagcttgagtccaggagttcaggatccattgggggaacatggtgaaacccatctctacacaaaatacaaaaaattagccgggtgtgatggcacacacctatagttccagctacttgggaggctgaggtaggaggatcacctgagactgggaggcagatgttgcagtgagccatgactgcgcactgcactccagcctgggtgacagaacaagaccccttagaaaaaaaaatacgaacatttgggttttttattaanaaaggtcttatgttgggccaggcacagtgtcctcacaccctgtaatccattggggtggatggcttnagccccaggactttttgagacccagccttngggcaacgtgngcaaaaccttgttttctacaaa

SEQ ID NO: 723329 - DNA, 477 bp, Homo sapiens
gaacagtaggtctagacgcttcactattgtggcctttctaaatttgatactcataggggttttctccccctatctttcactcttatattggtgagttcccaaatttgagtgcactggccgtcatcgcacagccttctatctcatctacggcgtgggtggggctggaggatgtgcatgtcttaagcgttcccaggtagatgctggtgctgctgccgctccagggagcacactttgataaccattgctccatttgatattaaatacattcggggaactccttttccaaacgcagcttttcccagaagagctgactggggccagcagatggtaagcagcttaagacaaggtggtgagtatgaaagtgtgtgtctggcgagctcccttacatcatcagggcttttggttgtctacaacgggcttccagagagagtcttataatttggaatgtggctagctgcaaaggtaggatcccaagga

SEQ ID NO: 723330 - DNA, 589 bp, Homo sapiens
  misc_feature (589)..(589): n is a, c, g, or t
aacctcaaacatatgatacgatgcggggactaaaggacgaacctgatctcttatactagtatccttaatcgtttctattgccacatctaacctcctcggactcctgcctcactcatttacaccaaccacccaactatctataaacctagccatggccatccccttatgtgcggggggggtgcctatagggtgccgctctaagattaaggatgccctaggccacttcttaccacacggcacacctacactccttatccccatactagttattatcgaaaccatcaggctactgattcaaccaatagccctggggcgacgcctaaccgctaacattactgtgaggcacctactcatgcacctaaatggaagcgccaccctagcaatatcaaccatcaaccttccctctacattgatgatcttgacagttttaatactactcgctatcctagaaatcggtggcgtctaaatcaaagcctacggtttcacactcttcgggcgccttttcctgcacgctctcacaacttcggcctcgcccggtttctgttctcttcgctttttccgggctactttctcaattgcccctatacgn

SEQ ID NO: 723331 - DNA, 408 bp, Homo sapiens
  misc_feature (394)..(394): n is a, c, g, or t
accactggggttccgttcgtgtccctaaacagctcccgggtcatgaggttgccgccagccgcggcaacgggccaaaatccccactcggtgaggttccggccccccacttgagctttctccaaactcatatacacgcttgatgtcgtacaccccggggctgatgtaaatcgcttggtttgactccccgctcggcaccgcgttgctccgggcgacttcgctaaccagcccagtttgggtgggactgggagctgtactgcccgtgcccactacagcgtactgggacggccccaacaagcccataggacggaatgagggcatcgtagaactggattgaggattaggttgtgttgctccccttcggcgctccggaacccaaacccgtccccttccccanggccaacccgggcg

SEQ ID NO: 723332 - DNA, 455 bp, Homo sapiens
ccagagatgttttagaaatgtgagaaaaacatccttttgcaccatttcaaataagaaagacacacactaaacaatacaaccatgaaattgatcccccggattgccaatctaattgggaacccagttgagcaaccagctcggactgttcgcacctgtcgccctactttttatatgcactttataaagtattccagcaaaagaggatgtagcctctgggaaaacacaaccatgttacagtgcctcttgtagattctcgttctatatctcatcacagcgccagccctgtttttagccggaaaggattcaggataaacattattatgcattctgaattggatgcatattcctaactactgtatttgttaccaaaagtggttctacaaatgctactgaaacaaatctggaaattcctaatgtcctgagtattaataataaagtttaaaaaagcctttata

SEQ ID NO: 723333 - DNA, 368 bp, Homo sapiens
  misc_feature (5)..(5): n is a, c, g, or t
cgctncggggagaaggtggctgcggctgctggggccgctgcgccggcggcggttcccgatgtggaggtccgtcttgggtggggaggcacccaggtcgctggttcgatgcagaggaagaaaccacacctagcacgtaaagccctgaaaaaatagaggtgtacagtagagttttccagaggctacatgacatgcagtatcacaacggaagcaaatataagaacccacctgtctcctgttaaaatgcaaaatgtaaaacaataccactttgctaactgtttttgtttggggaaatatagttcataaaaatatttatgttaacatgtaatttaggttaaaataaattaataaatatttgtaaaaaaaaaaaa

SEQ ID NO: 723334 - DNA, 560 bp, Homo sapiens
tgaaaatctggaaggctttgtaagtaaaaaggatcactgatagtagaatattattctagtactatttcttagacatttctagaaaagaaatgtcagataatactatatataaaaataatttgagtgaaattatggtgcagttgtattttttcagctaataaggttcttttctaattaatactctattgctgaaagccacttaaatcccaacaaaatgaaatatataaagaaattatggtacttataccatgtcagaattaaaaatcaggttttggcctgggtgcggtagctcgtgtccgtaatcccagcattttaggaggccgaggaaggcagatcacttgaggccaggagttcgagaccggcctggccaacatggtgaaatccctcactactaaaaacacaaaaactatctgggcatggtggcacatgtctgtaatcccagatacttaggaggctgaggcatgagaatcacccgaacctgggaggcggaggctgcagtaagccaagattgtcccactgcactccagcctgggcgacaaagtgagactctgtttcaaaaa

SEQ ID NO: 723335 - DNA, 296 bp, Homo sapiens
cgcggctccgagtccgggtctggtggggcggtgcagagcgggattcccgaggcagggtcgtgggcactctatcgcgtgcgggcggttgaaggcgttacagtccttggaaaccgagctgctagccggttgctaggagcgtccagtgtctggagtgggaggaacaaaacgcctcacgtcacaaggcgcaggaatcgagcgccgagagagcgagtcggtgctactggcgccgggtcggtccgggtaggcgcagcgggactggacctgggtgccgagcggagccgctgccatgggcctgg

SEQ ID NO: 723336 - DNA, 546 bp, Homo sapiens
tgatgccaaaattagaggtcagtgaagatggtcataattaaggaagctagtattttttaattgatataacacgatcccccagtatacatttctagccatatctcctccacctcccccatgtgaatctttcacaactaccagattggtctgtttgctctctctgtaacatgccttataccctcctacctttaaaattatgccatccctctattttgcccttagtcttttttaatcagtggttctcagagtgcttctcgggggcccacaatgtcaatggtacgctcataataatactaagatgctatttgcctttttactctcattctgttacaggtgtacagtagagttttccagaggctacatgacatgcagtatcacaacggaagcaaatataagaacccacctgtctcctgttaaaatgcaaaatgtaaaacaataccactttgctaactgtttttgtttggggaaatatagttcataaaaatatttatgttaacatgtaatttaggttaaaataaattaataaatatttgtaaaaaaaaaaaa

SEQ ID NO: 723337 - DNA, 399 bp, Homo sapiens
tgaaaatctggaaggctttgtaagtaaaaaggatcactgatagtagaatattattctagtactatttcttagacatttctagaaaagaaatgtcagataatactatatataaaaataatttgagtgaaattatggtgcagttgtattttttcagctaataaggttcttttctaattaatactctattgctgaaagccacttaaatcccaacatggtgaaatccctcactactaaaaacacaaaaactatctgggcatggtggcacatgtctgtaatcccagatacttaggaggctgaggcatgagaatcacccgaacctgggaggcggaggctgcagtaagccaagattgtcccactgcactccagcctgggcgacaaagtgagactctgtttcaaaaa

SEQ ID NO: 723338 - DNA, 902 bp, Homo sapiens
  misc_feature (5)..(5): n is a, c, g, or t
cgctncggggagaaggtggctgcggctgctggggccgctgcgccggcggcggttcccgatgtggaggtccgtcttgggtggggaggcacccaggtcgctggttcgatgcagaggaagaaaccacacctagcacgtaaagccctgaaaaaatagagaatactaataaaaagacaagataaaaggtttgactgtttgtgagaagaatttctctcccgtgagttctctcttttagtggaaaaaggattgcacggcataagacttatataggccacggttaccaacaactaagattatttctccaaggaacattctttattacttttcacttacaggttttattgaacctacatttgtttccaaaattttattattgacatgactaggtacgtcactcattctgcaaagttagtttttttcccattacaacatttatgttgcttgagaattaattccatgcctgatacgttatacgtggctaaacgggtcattttaactactataatgggtggtcctattagtgttgaatatggcattatttatttacccatttctcatgtgctaggggacatttgatttttttctatagttttcctctatttacaaaccaattattttccgagaatttttccgtgcccagtgtatctctttctgcacgattgtgcttggaggtttctctaggtggcaatcactgagtttacaagggatagtatactcttaaatttcactgggctctaggccaaatatcgtggtaatttttacactattgcctattaatgaaatttgtgccccgggcacggacattgaacgtgtcaaatcaattttgtaccaggagcaatcatactttgctaatttctaagccttttctagaatttacaccggactacgaaaatctggccgaattc

SEQ ID NO: 723339 - DNA, 287 bp, Homo sapiens
gcaagcagttaatacagactcaccaagccacagacttgtcttccacaatgcacgttcttacctatagccacgatagtcccaaggccacaccggtactaaaagggttggacttcaacgatatgtccggggtataaaccaattcccagggggaccggttactttcaatacaggtgtcaaattcagcaacaggttctacaatccagtgctgatatcagatacaggcttcagggacaattcctttccggaggggctaatcccagttccgggaggctagcatgagttgttgt

SEQ ID NO: 723340 - DNA, 111 bp, Homo sapiens
gcgagaggctcatggccatccccacggtatccatagcgtttacggtgtcattcaatatattcattctgcggccgtcaccatgccacagcaatgacatatattgaattacac

SEQ ID NO: 723341 - DNA, 264 bp, Homo sapiens
ggaccaatttcccggcaggataaagaaatgccaggtgtatttatttttcgtattgtatttttagcaatttttttttttggtatagaatgagccaagggcatctagagcaaagaggtagttcccgtgccccgtctccatctccctgtctgcactgcctctcctgctccatctccccatctgcaccgtctctccctgccccgtctccatctccctgtctgcactgcctctccggctccatctccccatctgcaccgtctctccctg

SEQ ID NO: 723342 - DNA, 120 bp, Homo sapiens
  misc_feature (2)..(2): n is a, c, g, or t
  misc_feature (65)..(65): n is a, c, g, or t
cngctgtggtttaggaggtaaacaaagggccaacatagccctgtgatgcaacagcctctgggtgncttgggccgcatgtggctggggttctgttaaaagggcaggctcctccctcctagc

SEQ ID NO: 723343 - DNA, 219 bp, Homo sapiens
acaggcgctcgctcaatagcgacaaggtcatcatcggcggcggcatgtgctacaccttcctggccgcccaggacattaagcgtgcaacaatccctgctgcaagaagaacaaatcgacaagtgcaaggaattgctggaagaattcggcagcaaactcgtgctccccgtcgacctggtggcagcagccagcttcgccgccgacgccgacaacaagatcgtg

SEQ ID NO: 723344 - DNA, 169 bp, Homo sapiens
cgccctaggcaacttccaaagaaaagagatttagttggctcacaatttcacaggctgtacaggaaacatgatgctggccagctgcttggcctctggagaggcctcaggaaacttaggatcatggcagaaggcaaaggaggaatgaaggtctcacatgattggagcagga

SEQ ID NO: 723345 - DNA, 631 bp, Homo sapiens
atacgtacagattgacgctgtgcagcataaatagtaacaagctaggaacaggatgtggttctcttaactgggaaaggagctacagagtagaaaataaatatgtttgtcatgagtcaggggttgtgaaaattgtgcctttgggccatgtgttatttaggctacttggaaaaagaacaaaaaggacttggttcatcttcagaaaggggaagccaacccctcctgtgctgccagtcactgtaacccactagaactaataattaccaatcccctagatccccattggaaaaagggagaatgtgtaaccctggggatcgaagggacagggttaaacccccaagttgccattttagttcaaggggaggtccacaagcactctcccaaaccagtgtttcaaaccttttatgaggagttaaatctgccagcaccagaacttctgaaaaagataaaaaatttgtttctccaattagcagaaaatgtagctcattccctaatgttacttcttgttatatatgcgggggaaccactatcagagaccgatggccttgggaagcctgagagttggtgcccactgatccagctcctgatataatgggggctgtccaggatctcatcaggacggatggtctcgctg

SEQ ID NO: 723346 - DNA, 342 bp, Homo sapiens
gccacatctgcaactcactgattctcctctgtggtgaggttttatcttattccagagcctttctacctcctacagacaagtctttgtccacttccatccactttgagcactttttttttttttttggcttggaaacagagtctggcttgtgtggcccaggcgggggtgcggaaacacaatcatgtgtcattgcaactttgacctctggggcggaccgaatcctcccatctacagcctctcgagtagctggacccacaggctatgtaccacctatgctggctcatatgtgtattaaaagccgggtctccacctatgtggcctggggctcaagcaatcctctgc

SEQ ID NO: 723347 - DNA, 1082 bp, Homo sapiens
tggtttttctaccccaattacatactgggtttagtaccacatcactaaaggcccaacatcattgcacagatcacaaaaccgtacatgccaggctggttgtctggttagtccaatggctgatttgcttcaactgtctagtcatgtcatgtgcagcctgacaactggctcctttaacacaggcacacagccgggggctccagtccatcttgcacacccaaatgcacatagtcaacacagtcaacatcgcatcacattgttcttgcagcagaacggttaccatgttttatcaacaggtaaggcctttcaagctttcagactacaccacttcggtcaatatatagatcgacccctattacgtcaggtagcaccacacccatgggtacaccacttacagccttgaccacggggacactataaccccttaaccttggtatatacatattgggatcggggagggcaccggaacaacggcaaaaaacgcgcatggagtggttatggattgaccctttttctacttcccttacacttgggatctcatatacggggacacacggtgtttaacgagtgaccgaacaccgaaacacgcacacaaaaacacaccacgacgtggccacatgggcacttcgggctggcaaattacattctatgggctaaaggcacccaacaaggcatgtaaccgatatatcatcggcattgtccgtcgtttccctccgttattccaccgacaaaactgttttgaccacacgggacaactttataacgcccaattcaccccgtattagggggcggccattcgttcaggacaaggtggaaacaaggccattacaacaatatttggattgggcagggtaacacactttggacaggcaaattttgcccgagcgaaaatacaccattcagcgcaatagatcccccaattggggcctctgcttcgcaacacacacgtgtggtgccatcaacggtatgcacacacccttcccaaattcattcccccaggactggtctctcacccatcctaggtctgccgcgcattcacccccacacataccgcccttgtggcctctggccattggccccattag

SEQ ID NO: 723348 - DNA, 156 bp, Homo sapiens
gacagtgcataagacagaacatcttccaccaagttgttacagtggtgtgtgtgtgtgtgtgtgtgtgtgtgtgtgtgtgtgtgtgtgtgtgtgtgtgtgtggcgtgatatctctcgtgtgacactctgtagagaggtacatatcagacacaggtct

SEQ ID NO: 723349 - DNA, 1011 bp, Homo sapiens
gagtggggtgtgatgaggtttgtctcggcttctaggtgagattcgttcaacgctaatcactatgtcaacagacacaggtgtttcccttccttcatatgcaggaagatcagggatcaaaactcattcgaaaagctaaagaggcaccattcgtacccgttggaatatgcgggtttagcagcaatcgttgcatatggattatataaacctgatagagcagtgggaaatactacaatgtccattcatctgatccacatgcgtgtggcagcccaaggctttgtgtgtagggagcaatgactgtaggtcatgggctattccatgtatcgggaattctggggcaaaacctaagccttagaagaagagatgctgtctgggcctagtaggaggagcttgcttaagttcagatgtcttatgattaaagttacctattatcgtcggaaataaactaattggtatgggtacagatggtaacatggcatcttgaatattggcttcctttcttgcaggcttgatttgcttggtgaccgaattactagtgactagtttactaactaggtcattcaggacgtcacgttaacttaagacatgtcacctaaatgcacttgatggcgttcgagatgtccaccttcttaaatttcaacgatgacttagttctaaagacgataccggccaacctgaagttactcccgtttgctgcccaatggtccgaacttgggatgtggcataagagtccattggcccagttatacaactttggttgccgttggggcgggctgcccccttttaaaacactttcccacacaagggcgtggactctactcgtaaagttcccccactgacgcaatttactctctctttcaccccacacaacgcatcaacaaaccgccgcacactattattaaccaccgccgagacacaatagacgaactacatgccgacggaaactactatgcggcatcacacagtcatcgagaaaatataatccacacacatgacatggctgttccccacaca

SEQ ID NO: 723350 - DNA, 696 bp, Homo sapiens
gcgtcgaccaggccaaaatagttggcggccatcaacgcacccacccacaggctgtcgacgtgatctgccgccaagcgcaaggccaggtaagtactgagcaggccagagccgatcagcatcatcagggaagcaaaataaagggctcgaaaaggtttccagatctggcgcatcggcgttccgagcggctccttgcagtgggtgtcaggactaccggaatgatagtcccgggtcgtcgggtccggacagccaaaacacgcggttgccggggaatattttgctcatgccaattggctacgtgtcagacgctcgacagtgacctgcgaggtacacgatgcagacgaatacttgctccgccccacccatgcctcccgtgtgaacctcaaacgcgggcaaggttcggttggtgtttgaaaagactgccgcactcaaacgcccggccacaaaaaagccccgccagataaatctgatcggggcttgctgacgttccggccgcgggggcaggaacgattatgtggtgtcccagggccggttcgaacggccaaccttccccttaggagggggatgctctatccaattgagctactgggactaatgacagccaaccggcaaggagcacggcgacggacggcgtgcatgttaacggcgcaggtcaattttgtcatgtcgtccgtgggctttttgagtgtaggtcgacgc

SEQ ID NO: 723351 - DNA, 239 bp, Homo sapiens
gtgcgtaaagtggcacaaatgtcccttcaattctcttcctccacagttaaaccatatcgctcctcccttctccttgactgagcctgacaacttctcctttgttcttggtcatcatccagccggggagacacatcaggagtaagaaaataatactccatctacttcttccttctatcagtctctcaaaagcaagacacacacacagttctacaccagagacatgccagagtcttcggctg

SEQ ID NO: 723352 - DNA, 349 bp, Homo sapiens
ggcctgcgtacaggctgtaacacctagtccataaaactatgtcctttctggttccattgtaatgtaagtggactgcgcattatacattaccgtcaaggattacattggcctcaaaacccacaaggacagtttaaaaggttcgtcgatagaactaagctgacttggcagtgtgcatctttgagccaaacggttcacaaatgtcattaattgcctagatatcaccttctcagctagagcgttcttacaacttgtgaatgtgcactgcttacctgtacattagctaatgtaacatacgtacttgcggaaggagttagactgacatgatatttttagggtacaccgcttgtcg

SEQ ID NO: 723353 - DNA, 193 bp, Homo sapiens
cgagtctgggacttcatcattaactactcgctgccccagtcatgtgttcaaccatggcatccctcccccaagtgagttccctgtcatcctacgtcaacttctctgtaagtgcctggcaagcttgcccttgcttaagaactcaaaacatagctgtgctctatttttttgttgttgttgtcatcagacaatgtat

SEQ ID NO: 723354 - DNA, 127 bp, Homo sapiens
ccgaatccaagcgcggcggcagcgaccaggccaatggcggcgccggtgtagaggcgagttttatcggtcattgcactgcttctccggtgatggtgaggaactgcagacgggcgagattggcgcgggc

SEQ ID NO: 723355 - DNA, 422 bp, Homo sapiens
  misc_feature (88)..(88): n is a, c, g, or t
  misc_feature (347)..(347): n is a, c, g, or t
acctagaggatccccaccacctgagctttgaaattatgaagatttcacagttggaagtcctttttggggtttcccttcacaaagatgnatgacatagatatgattataatttggaagatttatccatcctctcccttcagtgaagtattaaaaggatgaaaaggccattaaaaaagagctactgtttgttatatctaaggaaattattcctagaaatcacttgaattgctctgaaaacgtacagtttttataattagtacacaaaagttcttgagaactgactttgcatttctattctctgagaagagctgtcctggacagtggtgaaagaagtgtctccgtggcanagggggaggtgctttgtgagaacaggacatcactgataatctgtatctctttcagtttggtgactcaggtggtgt

SEQ ID NO: 723356 - DNA, 136 bp, Homo sapiens
ctttgggttgaggtgatgatgaagtcgagatttggctgctgtgaacattgttttacggtcatatgcttttctagctcgtgttaggtctagcgataagtagggcgcaggttttggctcgctaagaaggcctagaatc

SEQ ID NO: 723357 - DNA, 363 bp, Homo sapiens
agtatatgcaggcagtctcatgtctgtccagatgggaccatataagcttctctcaagcgttcagcttgcacaggcgcgcctaagatgtcgggatgacaggcatgcttccagtgaacgggcaggtagttccaatgctaaagcagactgtgcacatacagtgtccctcgcagccgtccagagtgatcgcatgatagtggcagcaagtgatttggtcgcctcagcctacccagttcctcggatcatcttgggcacgggccacagcgtcaggtgctggtgtgcctgtcccagacacgtgtgtctcttagtcagcatgacacatacagccccctgtgatctctggagagcacagtgactaatgttagg

SEQ ID NO: 723358 - DNA, 106 bp, Homo sapiens
agtttgagtttgctaggcacgacatagtaatagatgtaagtccgtgggcgattatgagaatgactgcgccggtgaagcttcagtggggtttggacacgaatgttca

SEQ ID NO: 723359 - DNA, 264 bp, Homo sapiens
gcgtcgacttccactcgagatgattccattccattctattccattccattgcattccattccactcgtgtttattccagtccattccattccattccattccactctggttgattccattccattccattgcattcctttccactccattcaattcctttccattctactcgggttgattccattccattccattccattccattccattccattccattccattccattgcattccactcgggttgatttcactcgtcgacgc

SEQ ID NO: 723360 - DNA, 104 bp, Homo sapiens
gtttgcatcaaactatgaattgaatgctgtacttctctctggggattctactccgggctttagattccccagagagaagtacagcttctattctagttttgatg

SEQ ID NO: 723361 - DNA, 975 bp, Homo sapiens
atgataacaagaggcttctaactaatagttcacgtggccagatgacatagcctaccatagattgttgtgtattggtgtatgggatgataagaagtttagagaattggtcttgactagcctaagtacctctactaagtaatagctaagtataaaatctttagttcacagacaacggcttgtgagcaattcaagaatcctatttcacgattgtttcttgacagaatgggagaaaaaatatggcaagatacgaaaacatgtcaaataagggcaatgacgaagtgacgtctaactgccagtatagagatataattaacaagagatactttgtggtacctcgttatctctcaggatctcctccctaccctagcaaggcaaacaacttggagtacttccttttcgaaagaagttctagaaattaaattgaggtaggagacggattgacagtgcctaactaaagatgagtaacaacagacctctttaatgatagactcactattggacactgcttctactattgtaattaaaaatcaggaagtcttgatgtatgcgttgctgtaagaaactctgctcattgcaaatctatttgtgggcttaggtattattctgggcacagtactttggttgatgactttcaatgggcgtgcttatctgcctgacctttggagttactgttggtattgccattgctggctctaatgtatgcgtaaccatcgatagaccggttatatactggtaaaggcgaagccacttaggaagaagcttgtcaccaaaacaagtgagagtcatcgccgcaatgatgatagtttggccctatccatgtaagaggaacggccatttctagaacactcggtccgagcaatcggttgcccgaggcaacgcggaaccgaggtaaacagaacacgggagcaacaacgtcacggcaccaataatccggcacaagcggagacacacgaagaaactaaacaatgaaaggtc

SEQ ID NO: 723362 - DNA, 371 bp, Homo sapiens
  misc_feature (5)..(5): n is a, c, g, or t
tctcnttggggcctggaaacaggaagccctttctagcacaggcctttagatccaggaccctatgtaacttcccacctcaagcctgtgcctccagcatccagatgtggccatccagcaaggtgggctggcccacaagaccacaaggcacctaggagtgcacaacacattacccaaggcccaccccatcgtgcaggacaaatgttcagaaaccaagcagtgcctgtatcaggccatcatgaagaggagaaacttggtctcccagtctcaaggaagcctggctcacacagcaccagaggcagagcctgccgcccgcaccgtccgacggcctcagtcacaaatcactgctgtgtttggttctttttctataaatg

SEQ ID NO: 723363 - DNA, 189 bp, Homo sapiens
cctgggaggcatttattgccttattagggaatgttaattgaagccacccctatgctaatgggttttgtttgtttgtttgtttgtttgtttttgaaagagtctccctctgtcgcccaggctggagcttgcagtgagccgagattgcgccactgcactccagcctgggggacacagcaagactctgtctca

SEQ ID NO: 723364 - DNA, 192 bp, Homo sapiens
  misc_feature (5)..(5): n is a, c, g, or t
  misc_feature (79)..(79): n is a, c, g, or t
  misc_feature (108)..(108): n is a, c, g, or t
  misc_feature (125)..(125): n is a, c, g, or t
  misc_feature (147)..(147): n is a, c, g, or t
tcacngcaatcctgatgtggatgacaggttcgaagcatcagagtcttcctttattactggagacataaacagttcagcntcactcaacagagaggggcttctgaacantgccagggatacaagtntcatggatactctaccactgantggtaccatggcaatagttacagcattgccacgcgaatacctgag

SEQ ID NO: 723365 - DNA, 981 bp, Homo sapiens
atcacatgataaatacgagtcccccatctcaactcatagtatccatgattctctctcgctctactaatgcgtaatgtcgttgctcctcacatctctcaatcttatccatacatacccaggcactggaggtggattacagcatgggcctaggcgtaggactaaatcgtgagtcagtactcctgcgaatggtgacccacgatagggatggagataactagctagtttctacacgtaacgaagcgctagagaataagcctattcttacactttgaacattatttatatttatcgctaactacttagcgtcattcctagctactcaagcttaaagctctagtgagctgcgaaatctgcttactatctcgtcagctggaaaatagcttaacatggcactatatccacccttgatagttccatttcctaacaccggtcacttcgtctccctcagagaggtactggacgcgcgggtaagcgcggacttatttgtccacagagatggggccattgagtcgatgaattcagaataagccattagtctacaattattgccatcatcatagacagctattatcctctcttaaatctctagttctaccctaggcctaatcctagctctgtctcgatcacattaatctcacatattaacaagtaaccttatgtgtgacagttgtgaacctgacgaactgcattctcgttcatccgcggcctcagtcaatcgttatcatgctaatctactgtcttccctttttcttacattgttttgcatctcgctccgaaagttggcacctggcgccttaggcgttcatacgcctcgagggcgcgggccggaggttctgtgtgattgcccttgttcccagcttgtcgtgactcgttgttctccctgaagaccgggggcgaggtttattcccagggtggggcctgggcacccagagcggcgtcccccccggcgggggggtgcaagccgcggggtaccgggggaaa

SEQ ID NO: 723366 - DNA, 210 bp, Homo sapiens
agactagctggcgcacaggaatttgagaccaggctggacaacatggagagaccctcatctcttaaaaaaaataaaatagagggattcaggctggctgcagtggcttatgtctgtaaccccagcactttgggaagtcaaggcgggaggatcactcaagcctaggagtttaagaccagcctggacaacatagtgaaacctcacctccacttt

SEQ ID NO: 723367 - DNA, 155 bp, Homo sapiens
gttagatagtacctccacgggcacgtctcgaacgcccgtaatgacgagtacgaccaggcgaacttggtatcgttagccatcgcgcgctccacgaacgagctcagaaacttgttcgaagaattccggtttcgtaagactcatcgtgagcgcactag

SEQ ID NO: 723368 - DNA, 745 bp, Homo sapiens
  misc_feature (282)..(282): n is a, c, g, or t
cgcccccccccggaagagaagggttcacggaagagaaccagagccccagctgacggaaggaggagaaaaaggcgtctgccccgctcctgaggaggagatggatgaaagtgaccggcgctggctgctgagccccaggcccaggaccccgtcgcgtcacctgccccagagtgacccttgtgttggatgaaattaagcgccagtactcccactgaggaccaaccacctctctgtggccctgccactattttctgggagacacctttgataaggacggcgctggtnccctcgtggtactccacgagtatcggctttccctgaagaactcacctcacgaccttcactgagctgccattctcactacacactggaatgtttcccgcgactggacccagctgaggaagaatgccttcgcccgtgtcactcctcttttggagaccccacccatagcacgctcccttttctggagtctgggtcttccgaggccacggagcttgcctttcccctgagtcccgattggcacggtggaactacgagtcatacaccactggcggaaactggatcctggcagcgaggagaccccgacgcctggtttcgagagtacttttcctgggagggggccttccagcaagtgggccaagaccttcaatcagggccagatttttaagtgaacatcttttgccatcacctagctgcctgcacctgcccttcagggagatgggggtcattaaaggaaactgaaccttga

SEQ ID NO: 723369 - DNA, 176 bp, Homo sapiens
agactggcttccgttgcgtgccggagaggtggagaaaaccctggtgccagcatgagcgagaacacattctacggggcagctggggtgctgacagacccacagctgacccatatcctaccgggtgcttagttacgtatcctagaggtgcgcatgcgcacgggcactacgcgcccacc

SEQ ID NO: 723370 - DNA, 203 bp, Homo sapiens
agcatcaaatgccttgtcgtttccaggtcgctatggtagtgactcaggacgtccttaagtatgttctcgtgaacaccaggttatgtggatggcacctaatactatttcaaagctctttcaatctgaccctcataatgttctaggcatcgtagcttataccccttcctatgaaccgtcgaccgtttagcaccttcaaggaactt

SEQ ID NO: 723371 - DNA, 413 bp, Homo sapiens
ccagatgattggattaaaaagtggtacatacatacatcatggaatacaactcagccataaaaaagaatgcaatattgtcttttgcagcaacatggatagaactgggggccattatccttagtgaaatggcccagaaacagaaaatccaaaacttcactttcttacttatatgtaggtacccccagacatacagagggaactaatagacactggagactccaaatggtgggcaggtgggaggggtgagggatcacctcttgggttcattgtacactatttgggtaatgagcatactgaaagccccgatttcaccactgtgcaatatattcatgtaaaacaactgcatttgtacccctaaatccataaaaataaaacatttaataaaactaaaaaagactttgaaaaaaataaaa

SEQ ID NO: 723372 - DNA, 134 bp, Homo sapiens
gccccccccccttttttgggggggggggcccccccccctttccccccccggggccccggggggtttttttttcccctttttttgtttgggggggggggggggggggcccttttttttttttttcccccccccca

SEQ ID NO: 723373 - DNA, 419 bp, Homo sapiens
aagtgctttagtgaatagacgatgttcatatgcatgttgtgcatgatatacataggtcatttgttttaccattttttctatttgagaccgagtctcactctgtctcccaagcgggagttggatgtgcagtggcgcaatctcggttcactgcaacctccatctcccgggtttaagcagtgctcctgccttagtctctcgagtagctcagattacaggcatgcgccactggaaatttttcctttgcttaatcctaaacctctgctctgtatttccccttctcaggatcacaatatacgtagtggctctgctacatatttactgtttgaatagctgataaaaggtccttggtccttaaaccatcttcagataacaactttgatttccttccatgacatcttaatctggggcccaagcctgct

SEQ ID NO: 723374 - DNA, 489 bp, Homo sapiens
  misc_feature (441)..(441): n is a, c, g, or t
ctcttaagtacagactgtgcagagttatgtgctgtgtgagtcagtgactggatcatacttgatgcagaagatagaagcctgtgagtcagtgtctgggcagatagagtgggctagggctactgtgctcagtgtgccccggtgcgccgttgtgattggtttgtttggtcttagtctatatgcgcagccgtggcatatttctacagcaaactaccttctccttcactggcaactcctggtcatggtgatactttgggtttttgggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgtncagtatggaaaatcaagggattacgactgttaaatcagccatagtggg

SEQ ID NO: 723375 - DNA, 145 bp, Homo sapiens
acttactcaccaaggctggagtgcagtggtgtgctccgggttaactgaaacctctggcttcccaggtcaaagtgattctcccgcttccagcctcctgagtagctgggagtacaggtgcctgacagtgcactcagcaaattttgtc

SEQ ID NO: 723376 - DNA, 151 bp, Homo sapiens
aaaacgtacacaaaataaacacacttcccagtcacggtagatagatctataccagcagttctcaccaaaggcaattctatccctcacaggggatatataataggtaatagccaggaaggcattatttggtatgtcacacactgaggagtag

SEQ ID NO: 723377 - DNA, 277 bp, Homo sapiens
gagtatataaaattagccaggcgtgatggcgcatgccgtgtaatcccatgctactcgtggaggactgaggcaggcagaatcgcattgaacccggggagccgtgagggtgccagtgagccaatgatcacaccagtggcactccatgcctgggcagcaatgagcgaagaattcatcgtcaagaaaacaaagattagataggaccgtggtgatgatgcaccgtgtagtcccatgctactgtgggagacctgagccagtgagtgatctcttgacgcccaga

SEQ ID NO: 723378 - DNA, 273 bp, Homo sapiens
ttggggctccatccagggttggatgtggctgaacagcaaagtaggagacaggaaaggtaaagagaggaaggctgaagccagatggagactaaaaggttatgtcaaagagttgggactatatcaggaagtaccgaagagtttaaggggaaagacacattagtggtgtagcagaggggtctgagatggatggaccgatggagatagggtctggctcggtcacccaggctgcagtgcagtggcgctatcccagtggactgcagactcagactctta

SEQ ID NO: 723379 - DNA, 593 bp, Homo sapiens
gtcaaattaatctaaggatcattctaatgcctttaagtatagtaattgattcatagttcattactaatcccctccatctataatctgaatacctttcccatcaatcttgccttctccaaaactttcttattctcctttattctctttctctttttaaaatttttaaatttgctttctgttttaaatatatgtgggaacgtagtaggtgtatatttttatggggaacatgagatgtttgatacaggcatgaaatgtgaaataaggacatgttggagaatggggtatccatccacctcaaggatttattcttctgagttactacccttatctttctcttaatctaagtgtttcccttctgtactaccttctttatttaatattcttctaaccctgggaagcagaaggagaaataataagcacaaaaacaaaatcagaaatccctggacatattaatttatgtgtgaccatttcttcatttatgtattataatccttttaaaccaagggagtatctgtatctgttcattcattaaataatttatttaaaaagcttgtagtgataattatcttctggatgtgtaggaatattaataa

SEQ ID NO: 723380 - DNA, 363 bp, Homo sapiens
acgtcaaaatgtggccacaaccgtaaagtcaatgtgttctataagtaaatttggaggtactgggtttctgttactctccttaagaaatggtgtccatgcttttcttcttaacttcactctcttaagccaagagctatattggagataataggtgaatcctgaaaaaccaggatttcctcatttctctttagggaaaaggcttcagcacttcaaagcttgcctagtgacagactgctcatgaggaagacctaccttttagccccaggacaggctggagtgcagtggcgccatcttggctcactgcagcctccatctcccaggagaatggcatgaacccaggaggcggagcttgcagtgagcaga

SEQ ID NO: 723381 - DNA, 313 bp, Homo sapiens
  misc_feature (28)..(28): n is a, c, g, or t
gggccccccccccccccttttttaaaantgggggggggggaactttttccccaaaaggggggggtggggccccctaaaaaaaaaggggcccggggttttttccttttttttctttgcctttacccaaaacccctttggggggccccccccctttttttggggggtccccccccgggggggggcccgggggtgggggggggttaaacccccttttggggggccccggggcttggttttttttaggccaggggtggggcccgggccccttttttttttttttggcccccggccccaataaaaaattggggggtta

SEQ ID NO: 723382 - DNA, 577 bp, Homo sapiens
gccccatttcgtgcgccctcagggctaaccttgcactaacgtctttacgtgggtacttgcgcttactttgtagccttcatcagggttgctgacagatggcggtatataggctgcgcaagaggtggtgcggttgatcggggtttatcgattacagacaccaggctcctctcagagggcatatgcaagcaccgccaggtcctttgagttttaagctgtggctcgtcatgttctggcgcacagttttgttgcatttcacactgttgaggtttcagggctcacgcatcagtggggtcatctcaatcccagttagggtcttcagctattgtgtgtacagctatgttaaagccactttcgtagtctctttagtgtcaactggcagttttttaacaactcaggtgcagttttagctttcattggggagggggtgcatctcaaaaacccttaacgccggctttctatagactatgggttaatcgtgtgcacgcggtggaaggcacgcaaatagacaaccctggggttagtatagcttagttcaacatcgtgaaatagctaaaggtacatactgggggatcctcta

SEQ ID NO: 723383 - DNA, 291 bp, Homo sapiens
gcccgtgctgatacacgacgggcggcctatcctacccccatgctgtctatcaggctctctgggggacttttcaacctgctcattttctttggccccagtcaggaagcaccagctgtaatgtgagcttttgcctgacaggagtgtactcttcttgacgactattgaagcagcaaaaatgcagagtcactgtaggcaggcagcaagttaatagctgcatctgatttctagtatcatagttcaatataatataaaaaataaaacatcactccattaaaaaatcatcaaaatgaa

SEQ ID NO: 723384 - DNA, 148 bp, Homo sapiens
  misc_feature (42)..(42): n is a, c, g, or t
actctcacgccaacggtgacacacttggcccctggatttgcngcgtatccatcactccctaacgggacacatgggtgccgatttctccgcaccctcaccccaacgtgcacactattggccccgcatttctcctgcacagctcacccca

SEQ ID NO: 723385 - DNA, 367 bp, Homo sapiens
  misc_feature (15)..(15): n is a, c, g, or t
ctagaggataccggngcttatcgatgccaccacacacagctaacttttgtatttttagtagagacagggtttcaacatgttggttaggctggtctcgagctcctgacctcaggtgattcatctgcctcggcctcccaatgtgctgggattacaggcgtgagccactgtgtccggccaagatgtctttttaagattgccttctaaagcatttctgtttgtggacacaaggtgacgatcagttcgtgccgtcagagcctcatgccatctgttgagcaaatggatggtgcatgaccaccgtgttcttccagctaagcccccaaggcatacagagccgggtcagctctgctcccagtggcatcgataaaca

SEQ ID NO: 723386 - DNA, 275 bp, Homo sapiens
cacgaggtaaaaaatggagaatgttttcgtgctgatcatctattaaaagctcattttcataaattgatgtctgataacaagtgttctgtccaaaagaaatcacaaatgggaagtgttttggcccatcttgataactatggatagcaagaacttgcggatctttttgtgaactataatgttaaacctcccattactggaaattatctatcccccccagtgtcttttaacttaatgttcaaaactttcattgggcctggaggaaaaatgcctgggta

SEQ ID NO: 723387 - DNA, 179 bp, Homo sapiens
tccagcacttcagtcacctcctccacgtgctgctctcatagtgcgcccagatctctcgctgcatcaccatttcctttgtgaaatttttatctcaacgctgaagggctctccttcctgcaccaagcctgggatgtttcgggctcctctggggcattcaatgcctgcaatcaagcctggaa

SEQ ID NO: 723388 - DNA, 142 bp, Homo sapiens
cgttacgagcaggattaccatggcaacaacacatcatcagtagggtaaaactaacctgtcgttactatggtctactcgaagtctcactgttcccttattaatgggtgaacaatccaacgcttggtgaattctgcttcacaat

SEQ ID NO: 723389 - DNA, 126 bp, Homo sapiens
aaaaaatgtgtagcaggaataaatcatgcaaatagagaagtaaggctaaggcagcaggtgagaaattagcagcaggtatggaaacagaagataagagagctgaggcttaagtctgggctacctgag

SEQ ID NO: 723390 - DNA, 448 bp, Homo sapiens
tctagagatcccgccggtctgcaagagcggatgggcggatattaccgctcgatctcattatgtctttctatgagtataaaatccttctgtctgcgctctcatctggtgtcaggacattcatatggttaatagacaggtttgactatgtagtatagctgtcacagtaagcaggtcattgtataggaaaatgcctggagtcataatttgctattattagtcacgagcaatttattaacaggcagggcctatccttgcctgtagttctcaggcactggatgcacacaatcactgtgtaacattggctcacttggtgagcatagggttgactgatagaatgtttaattcccttgctagcttgtgagaagaatgatttgatcacatgctccataccagtggctagatggagtattaaggtggagcaaaagcgaagtgagaacatgttgattcc

SEQ ID NO: 723391 - DNA, 250 bp, Homo sapiens
tcaaccttcctctttctttctttctttctttctttccttctttctttcctctttcttctctctctctctctctctctctctctctctctgacagggtcttgctctgtcacccagagtgagtgcagtggcacaaacacggctcactgtagcttcaaattcccaggctcaagcaatcctcccacctcagccttctgagtagctgggactgtaggcatgcaccaccatgcctggctaactttttaaatttttc

SEQ ID NO: 723392 - DNA, 281 bp, Homo sapiens
ccagaaaaatagacattaaaaacaaaacaaaaaaaaagcaaaaaaaaacaaacgtaaataaaaaccacaacctgatgaaccagttgctgggttgtatggtagttgcatatatggttttcaaagaaatttccaaactgtgctggagtagttatcccatttatatagtcccatctgcaatgtatgagtgatcccgttatttggtatccaagccaggaattcggtgtaataaactgtatataattacagccattctgatcggtgtatagtggcatcgataaaca

SEQ ID NO: 723393 - DNA, 324 bp, Homo sapiens
tcgaccagacccacagctaacatcatactcaatggtgaaagactgaaagctttccctttaagattaagaacaagacaaggatgtctgttcttgccacttctattcatcattgtccaggatgtactagccagggcagttaggcaagaaaaagaaataaaaaagccattcagattagaaaggaagtaaaactatctctgtttgcaaatggcatggtgttgtatgtagatcatcctaaagaatccacaagaaaactaacagagctaataaataagttcaacatcaattgtatttctatacactggtaatgaagtcgacgcggccggc

SEQ ID NO: 723394 - DNA, 429 bp, Homo sapiens
catctcccatcctgtagctacaattggcatacaactactataaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaagaaagaaagaaaaagaaaagaagaaagaaagaaagaaaaagacagggagagagagaaagaaagaaagaaagaaagaaagaaagaaagaaagaaagaaagaaagaaagaaagaaaaagaaaagaagaaaaaaaaa

SEQ ID NO: 723395 - DNA, 300 bp, Homo sapiens
acaaaggcttagagaacatgagtacacacagtacttattccatctacgaagggatgatgatgtgtggagaaattacgaaggaaaagctcatggcttcatggtctcttgggtatgatcaagtgtaggaaaaagtctacagagagtgactagaaatgtgaaaatggaagccattaaaactgaagaagggaaatgaaacagaactattttaaaacgatgacaaattgaccaaggatttaatatttttgtctttactgtagagaagttatgcaaatacctcagaaggtgttggggataacatca

SEQ ID NO: 723396 - DNA, 1752 bp, Homo sapiens
tcgccggcctcggcgcgggggccaaattcgacacgagacgcttctcggccagcacgccagctcgcattcccagcatcaggcaacaacaggcacacatcatgcactttgcattcttcggcaggtgcttccagggcactggcacttttattggcaaaccaagcaagtcatgtccccaggtgtgtagtggcagccatccaccacacaccagcatccagcacagcccaccaacacataggcagcagcacacaacacagcacagcagcagcctcaacatgcacaagggcaagcagggcagccagcagccacagcacacaaccacaggcacagcacgcattgcaattccagcacacatgtgcaaatacccccacagcacagcacaggtctgctcacatcatcacacagtcggcattgtcacaatcaatggtcaaggcacagccacaacgcattatgccacagcactgcaacacacacagtatcccagccagcacgaacacagttccaacagtcaaactttccaggccacaccagttaggcacgaacatcgtgaccagcacacaccagacaaaacacagcaattccacacgtatcctatgacagcggcacattcacaaacccacgaccacacatttcccaccgttccgcacagtggcacaaaccggcaatcctatcccaatggtcacacccaaaattgtaggcgttaaccattatatccacgcacacaacgattgcaccccaggggacacattacatcagagacacttcgagcatctatccaattcacggaaaagtaacgcattatcccaggaccaacgcaagtatccatcacacgcactcggcccaagggataatcccacacacaattggcccataaaaggccacaaaaatttccacacaaactggacaaaaggaccatagtacaccaacggattctaacattgcgctggacccacttggggtcaggcggatcaccgtgtacgatgggcgaatattcacgttggcattcacaaaaacattgagaagtacttgagacacaaacaagcccaatatcagcacaattatcaaagaaccacatcacacctatcaattactacaccgttcgccacaggacttggaacaaccgacaccccgcgggacacgactattatcacaacagaggcactatcacacgaaacagacgacccctggatacaattaacatcaatctaacgacaaaaagcaatggctgacaacacgttatgggacgcaaacaaccgagacaaacttcccacaggccaacacacgttacacataacaccacacattatacgtgacgaggggcacaaacaagggacacattaccaacaatatctacacacacatgctaatgcaccaccgaacagagcatgcacaatgagggacagcgcacacatagacaacacatttaggcacactatcaaaatctcaatatttaagaaacagatcatggcaataatcatatgatgacaacatatacctacatatacacaaccacaacaccacatatatgactcaccatacataatacaccaccactgacgaataagtagataataaacgcgtatcgaaaaatctatcactaaacactacacatgcaacaaccatctatcatacatcaccacacacattaacactactacactatcacactacctaatcacatgtacatcaacaagccactactatactcaccaacacctaacgtatcacatctacacccagtcagcctaaacgaaa

SEQ ID NO: 723397 - DNA, 351 bp, Homo sapiens
tataatggcatacgaccgtgggagatctggtacgcctatgccgcatgactagtcttcgtagacgtgaaggtagcctacatttggggccgagtatgctctcgatcatgaatgccctacttttccacggatgtcccttcactatgacctggagggctcagcaggaagattctgtcggagcccagagaattttggctgctcttccacagcgtatagaaggggatgtccgatggcctgtatgggccctgtggagaaacgcctaggttgcactggccgtaggaagcctctccgtcaagtaaggccactggcgcgggtaggaggaccaagcctcgccaggtggcgtctccgtatccc

SEQ ID NO: 723398 - DNA, 346 bp, Homo sapiens
ccccccacttattcgaccggacaaggaagagctctgaaattaccaaatcctgatgcacattgcatgcacagcgttgccgcatggaatggcttacactcgagcgcatcagttatactccactagacgatctgcgatcagcaaatcattctactgtggaatggactcatacgcctgcgagttgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcacca

SEQ ID NO: 723399 - DNA, 127 bp, Homo sapiens
cacatgtggggagataagtcagctgaacagaaggtggtataaggagtaggggaaagacatgggatgggtggacaaagcctgcatgtgaaaggtactaaactttctcctgccacccaaagagccattc

SEQ ID NO: 723400 - DNA, 165 bp, Homo sapiens
gtcacatcagaagatggtgttttgtcgcactgatgtgaggatctgcggcatgtaacgagcacggtttacattctccttcgtggttgattttaactttcacattcaattcttcctgttacagaaccaaagccacacaaacttcacccatgtcactgctcacaactg

SEQ ID NO: 723401 - DNA, 155 bp, Homo sapiens
cagatctgctggtgataactcaggtattcctcgatcagcgccggtgaatcgaccaagtcgagcgcctggcaaaagcgctgccccgccccgccgttcatgtgatcgcccgatcaagatgcaggtaaccgccgtccaccgacagccattgtcgacgc

SEQ ID NO: 723402 - DNA, 770 bp, Homo sapiens
  misc_feature (571)..(571): n is a, c, g, or t
gctacagtcatggttgccgtcgtacgctgctgccgtgtgcagggttagccccgagtccccggactgaattgctcccgaaaggcgacgcgatacaacgtcgctgaggaggagctggaggaggacgacgatgaggagctagatgataccctgtcggagagactatggggcctgacggagatgtttccggagagggtccggatccgcggacggagccacttttgatcttcttcaccgtcttgtgtggactcagaacaatgtacgagggttgttccagggctagggccttgtgcgagtcgtgaccagatgtccgtttatgagtcgctggtgtcgttcccgttgtcgtttgagatggagatagttgtcaatactggacgcaacgagcacgcatagtcgtgcatgcgacgtcggtcacgataccttctagtgagccctaatgacatggtgtctctcagggacgggacactgccacggtgtgctctatctcctcgacttcctggaccagatctacgactggttattgcatgtattgagctgtactcaagttgggataaggttctcgaaacaatttcanacgtgtaagttggacttaagcatggatataagttcaggaatgttccttcttccaatcatgttgacttgtctgggcgcacattgtgatgccattttgatactcgtgagagaggcgcgaagaagatggggctcggaggttttggggttcatactgcaggaggaattgtaaagtttgcgtggagagtgcctggcggcttaag

SEQ ID NO: 723403 - DNA, 331 bp, Homo sapiens
ccgcaggctcatttccgtcggcaatctcgtcaatgccaacaacaccatcctgacgaccatcgtttcgcttgatccgatcgatttctatttcgacgtggatgagcgcaaccttttgtcctatgccaagaccgcccgcgaaaacggcagcaatctgcaggaaggcggcggcggcctcgaagtgacggtgcggctgaccgattccaaccagccgccgttcaagggcaagctcgatttcgccgagaaccggctcgatgatgccaccggaacgatgcgggtgcgtgcccgcttcaacaatccggatttcgtgctgcagcccggactgttcggccgg

SEQ ID NO: 723404 - DNA, 175 bp, Homo sapiens
cctcagccatctgagtagctggaactacaagcccgtgtcactgcacccagctcaaaaaaaataattaaatcttattaaatatattttataaaaacaaaactactttgcagtcttagtgttcactgtccacttagttgccaaagtaaagaattagtatcactctttgtttaggtta

SEQ ID NO: 723405 - DNA, 374 bp, Homo sapiens
cacggcgtgtagaggtgcgggtgttcaaggtggaatcggccaactgcagcgacgcgatccgttagcgggtcacaccacccagatgtgcgagcaccgctgggcccacccaggtctcggtgatgttgtgggctgggcaacagccccatgggccgcttcaacggcgcagagttgaatgggcaacgcacagcggtgtgccaggtcggcaacatcagtgaggcgtgcaacggcgtggttttcttgctgggctacatctatgtgttcgacctgaacgtccaggcccagggctgcttcgaatacaccaatacctcgatcaacccgccgcaaaacaccctgaaagcccagctcaatatccgctgatcaatcatcttgaacgc

SEQ ID NO: 723406 - DNA, 343 bp, Homo sapiens
cattgtgcagatacgatgatctccatgtcctctacagtttcatcatctgatttgaactacttgaacatacaccgggtacgtggactccaaacgcatttcaattctcggatcacatccatatgcaaaaaattcgtaactatggccagctcttacccttatgcaatctgtcaggatcagctactactaggtcagttgcaacctgtatgagttggtttccgttttccacatcacatatcttgcgcgattttattaaaagtcgcagttaacacatacgttaatcgagctacggagttcacggtaggatgcgttacgtagctctacacagaataaagctcgaaccaag

SEQ ID NO: 723407 - DNA, 211 bp, Homo sapiens
aaaaaaggggcccccccccccggggggggggcccccccccgggggggggccccttttttgggccccaaaaattttttttgggggggggggggggggccccccccccccgggggttttttgcccccccccccccccccctttatgggggggggttttttttttaaaaaaaaaaaaaaaaaaaaaaccaaaaggaaaatgaacccccaaccca

SEQ ID NO: 723408 - DNA, 131 bp, Homo sapiens
aggagaccccatatctataccaacacctattctgatttaatcggtcaccctgaagtatatattcttatacctaccaggctatcgtaataatctccccggatacagccccccgtatcctccccgggatacag

SEQ ID NO: 723409 - DNA, 621 bp, Homo sapiens
  misc_feature (30)..(30): n is a, c, g, or t
  misc_feature (73)..(73): n is a, c, g, or t
  misc_feature (78)..(78): n is a, c, g, or t
  misc_feature (460)..(460): n is a, c, g, or t
  misc_feature (474)..(475): n is a, c, g, or t
  misc_feature (483)..(483): n is a, c, g, or t
  misc_feature (487)..(487): n is a, c, g, or t
  misc_feature (491)..(491): n is a, c, g, or t
  misc_feature (494)..(495): n is a, c, g, or t
  misc_feature (499)..(499): n is a, c, g, or t
  misc_feature (509)..(509): n is a, c, g, or t
  misc_feature (517)..(517): n is a, c, g, or t
  misc_feature (528)..(528): n is a, c, g, or t
  misc_feature (552)..(552): n is a, c, g, or t
  misc_feature (555)..(555): n is a, c, g, or t
  misc_feature (557)..(557): n is a, c, g, or t
  misc_feature (567)..(567): n is a, c, g, or t
  misc_feature (577)..(577): n is a, c, g, or t
  misc_feature (588)..(588): n is a, c, g, or t
  misc_feature (590)..(590): n is a, c, g, or t
  misc_feature (592)..(592): n is a, c, g, or t
gtttcaattttaattaattgtgcttaaggntttaattaaattggggggttcccttcttagagcagctcgtacngacgnaggtgcatgcgctgaatgatgtcacggcagtcgttgaacacacggcggatgttctcagtgtccacagcgcaggtgaaatgagggtagcagtagtgacgcccatctccactggcagtgctgatcctcagaaactcatctcgaatgaagtacttggcccgggtcacgcgtgggtcctctccgggctcgggagtagcatcctcaggagtagtgtagcgagcaaattctggaaagtagtcctcaatcttcgatttcccagcaaggactttctcagcgagcagatcttgcttgttgaggaacaggatcacagagatggtgcgcagccatctgttgttccagatgctcttgaagaggttcagagcctcctgcaggcggtatggtctgnttgtcctcccggannaccatgtngtanctgntgnntggncaccacgaanatgatggnagtcacatcgntgaagcactggatccacttgcggngtncntcgcgctggncacccacgtnaaacatgtggnantngactttgtccacttggaacttggtcccaa

SEQ ID NO: 723410 - DNA, 730 bp, Homo sapiens
agtcagtttactcaatggagtactattcagccataaaaaaagagagatcctgccatttgcaacaacatggatgaaactggagaacactgtgttaggtgaaataagccaggaacagaaagacgaacttcacacgatctcactcatttgtggaagctaaaaattaaaacaattgaactcatggaaatagagagtaaaggatagttgccagatgctgggtagggtagtgaggtggtgggggagaaatagggatggttaatgggtacaaaaaaaccagaatgaatagtcgggtgcagtggctcacacctgtaatcccacacttggggagactgacagggggatcatttgagaccaggagtttgtgaccagcctggggaacatagcaagacatcatctctacagaaaagtttaaaaaattaaccagacttgatagtacatccctgtagtcctagctactcaagaggctgaggcaggaggatcacttgagcccaggagttcaaggctgtagtgaggtatgatagtagctatgtagtaatgccactgtactccagcttgggcagcagagcaagactctgtctcttaaacaaacaaaaaaaccttccttggttcttccttccctacctgtgaaataaaacccaaatctagatttcatccatatctggtgcagctatttctagcttctttcatgtcgttctctctacattaagtccgtatctaatagtactataggtga

SEQ ID NO: 723411 - DNA, 329 bp, Homo sapiens
  misc_feature (30)..(30): n is a, c, g, or t
  misc_feature (73)..(73): n is a, c, g, or t
  misc_feature (78)..(78): n is a, c, g, or t
gtttcaattttaattaattgtgcttaaggntttaattaaattggggggttcccttcttagagcagctcgtacngacgnaggtgcatgcgctgaatgatgtcacggcagtcgttgaacacacggcggatgttctcagtgtccacagcgcaggtgaaatgagggtagcagtagtgacgcccatctccactggcagtgctgatcctcagaaactcatctcgaatgaagtacttggcccgggtcttcacgaaactcttcagcgcccacttccggcgcatgaacggccccagtcctgctcaagcctggcttcggtgccatgccattgacagaac

SEQ ID NO: 723412 - DNA, 350 bp, Homo sapiens
  misc_feature (14)..(14): n is a, c, g, or t
  misc_feature (22)..(22): n is a, c, g, or t
  misc_feature (27)..(27): n is a, c, g, or t
  misc_feature (65)..(65): n is a, c, g, or t
  misc_feature (87)..(87): n is a, c, g, or t
  misc_feature (215)..(215): n is a, c, g, or t
  misc_feature (220)..(220): n is a, c, g, or t
  misc_feature (242)..(242): n is a, c, g, or t
  misc_feature (257)..(257): n is a, c, g, or t
  misc_feature (301)..(301): n is a, c, g, or t
  misc_feature (317)..(317): n is a, c, g, or t
gggcaatgccagtnctacacgnatgantttttttaattttttgtattatagagacagggtctctnttgcccaggctggagtgcagtnacacaattgtagctctctgcagcctgcaattcctgggttcaagagaccctcccacctcagtctcccaagtagctgagactacaggcactcaccacctcatccagctaatattttagtttgtagagatngaggncttgctatgttgcccaggccgntctcaaactcctggnctcctgaagtactgggattacaggtgtgagccactgcactttgncctacaccgatgaatnttttttttttataggggacagaggtttgctctt

SEQ ID NO: 723413 - DNA, 208 bp, Homo sapiens
atcgacggtgttgacaatggttgccaaaatatgaatgtacttaaggccacaaagttgtacagttaaaaatggttcaaacaggagttcctgtcatggcgcagtggttaatgaatccaactaggagccatgaggttgcgggttcaatccctggccttgctccagtgggttgaggatccggcgttgcggtgagacggtaacaccacagtac

SEQ ID NO: 723414 - DNA, 719 bp, Homo sapiens
agcggtggctcacgcctgtaatcccagcacttgggaggctgaggcaggtggatcacgaggtcaggagatggagaccatcctggctaacatggtgaaaccccgcctctactaaaaaaattcaaaaaattagccgggcgtggtggcacgcgcctgcagtcccagctactcaggaggctgaggcaggagaatggcatgaacccaggaggcggagcttgcagtgatccgagatcgcgccactgcactccagcctgggcaacagagcgaggctccatctcaaaaaaaaaaacaaaattaatattatgtacttaaattaaaattttggccagggcacaggggcctcaggctggtaattcccggcactttggggagcggctgaggcggggcagaccatagggtcccggagttggagaccagcctgggccaatatgggtgaaaccccgccttctgttagaattacaagaatttagccaggggtggggggggtgccggtaatcccagactacatggggaggctgaggcaggaaaatcattgaccccgggaggcagacggttgcgtggacccaagatggtgccatcgacttgccagcctggtaccaagagcaaaactctgtctcaaaaacattaattcccttcacttcaaatacttataatttatccaaagcggggacagggctcccatttgtactccagaacttggggagtctgaggcagacggttgt

SEQ ID NO: 723415 - DNA, 88 bp, Homo sapiens
gatctattctgagtattttttagagagttaatatttatattttagtaattttctggtagaggaaattgcacataaaatgatttggttg

SEQ ID NO: 723416 - DNA, 146 bp, Homo sapiens
gctactgtcttggtgggcgctactggccttggtgggggtatggccttggatgggcgccatggccttggtgggcgcactggccttggtgggagctatggccttggtgggcagcactggccttaggtgggcgctacttgccttaggtg

SEQ ID NO: 723417 - DNA, 397 bp, Homo sapiens
ggatttttttaaaaaaagttttagggtttttccttttttcaacttcacatacttcgtggctttgcaaaaaaaaaaaaaaaaaaaaaaagcagtaaaccgtatttaccaaaaaaaaaaaaaaaagttttgtttggtatcaaagtatagctgcaagctgagccggctggctgcacgggtcccagagcgcgtggggaccgcacgggtctcctgggccgctcgcctgcgacccgcgcgggtcagctgggccgcacccccgagaagccgcggagaggcaccgacaggcaggcgcggcccgacgtgtttaccgtccgcgtcgaccccggggagccgctccctcgcgcccgcagcacttgttcacggcgcggactccacggcggggactccacaccgcggccgc

SEQ ID NO: 723418 - DNA, 170 bp, Homo sapiens
tctcaggcattgtgagtgaggattaaatgatatgcttacacggctgtgtgccagagaggtggaaacgggtgtaactgtccagtaattgattagctgtggaatcattattagacatgtcgaaggttcaaaaaaattatggagccatgaaggatgcaaactagccagggggt

SEQ ID NO: 723419 - DNA, 630 bp, Homo sapiens
ggagccagggcgacggcctgcgtgatgattgcggggctccggtccgctggatcgtacgcctgtcttgcgacctgtacagctgggctgcctgggtgttccgtaccggctcggccacaggcatcgccgccagccagcgaaggttccgcggagtccatgggacctgattcaagagccagaccctgacggccgcctgcccaccccctctgcccctgctccactcgttgagcactggatacagccaggcccagagcaagagccctgagagacccccaagccacggccgtgagaagcctctttgtggctgaaaggtccctgtgacattttctgccacccagaacggaggcagcatgacacatgttcccgctcctctatcggccccgtgcctatcccacggagtacaccccaactagcacccaactccagactcgggagtgcccccaacagcaccctctccgagatgagcagtacaccccaacagctaccctctccagatgagagtacaccccaacagcaccctctccacatgagagtacaccccaacccgcaccctctccagatgcagccccatctcctcagcaccccaggacctgagtatccccagctcaggttatcgtcctgggtccagcctga

SEQ ID NO: 723420 - DNA, 363 bp, Homo sapiens
tatactgtgtgggttggcttcaatccttatgaatttttagttaacttttttgacatccttgcaggggaattttattttttggattttgacccattgcaggatcccaatgtttataatgtttcccaaggtggagatcttttccagttgttgatgccttgagttttgccaaccttgggtggcaaatgtgttgtgttcccttccagttgttgggagggggagttagagctggtcgttttttgattacccattattttggaagcaccctgagggctagttaatccaaacatgcatcaacaatttggcctgggaatatgtaacagccaaacctttttgtttagtgtttattaaaatttttaattggta

SEQ ID NO: 723421 - DNA, 238 bp, Homo sapiens
gagcagcaggctccagataacgatatgcggggggcagcacggtgctcacgtgtcgacggaacttgtgcagggaggcatgcaccgcagtggtgaatacacgtcgaccaggctccatgtatgcgttattgggtcgtgagcgcggagctcatgtatcgaaggaacttgtataggaaggtatgcaccgcagtggtgaatacacgtcgagcaggaggcatgcatgcatgctcgggtcctggac

SEQ ID NO: 723422 - DNA, 788 bp, Homo sapiens
ctggccggcatggcgatgacctccgcaacaccaagaccatgagatctctgagatgaaccggatgatccagaggctgggagccgatgattgacaatgtcaagaaacagtgcgccatactctgcagaacgccacttgcggatgccgagcagcgtggggagctggccctcaaggatgccaggaacaagctgggcgagctggaggagggcctgagaacggcaagtcacgtgacatggcccggctgtgttgcgtggagtaccatgagctcatgaacaccaagctgtccctgggacgtggagatcggcagtttaccgcaagctgctggagggcgaggaatgcacgcaactcagtgtgagaagagaacttggaccagtcaagatctctgtagtcacaagcagtgtttcctctggatatggcagtggtggtggctatggcagtggcctcgtgtgggaggtcttgagccggcggcctcgggtggaagcgctctatgccggcagagttagctagctggaaatgctaacaactccattcagcaaggtagagcgagtgctgtcgcgccctaggatgatgggactcagtagtggggggctctgaccttttagttgcaaagcacgtggccgagcgagctggcggggataggcgctatgtgcaaggtgcgcgggagtagcatgggatccaggctgtcaaagattggtcctccaccaactccttcacgtcccggaaaggacgcttacacagaagccttaagaaaccctgtcttgcaaagttcactggcctttcccaaggtgcag

SEQ ID NO: 723423 - DNA, 183 bp, Homo sapiens
gatgttcaccgcacagcctttcagcatgacttagtcattggtcacttcaccatagtggacaaagccacccggagggttgatgctcttgtctagattggtctatagcttttgcctggtttaaacttgatcagcttgccgtccttgataaggtagccctggccaatcttataaatcttcttgttg

SEQ ID NO: 723424 - DNA, 119 bp, Homo sapiens
gcaactaatatttcactttacatccaaacatcacttgtggcttcgaagccgcgctgatactggcattggtagatgtggttgactatttctgtatgtctccatctatggatgagggtctc

SEQ ID NO: 723425 - DNA, 300 bp, Homo sapiens
  misc_feature (133)..(133): n is a, c, g, or t
ttccctttgtctgttttactactgagtattattttattttatagacacacctcagttgtttatccattcaccagaaggaccgttgggttgcttccagttgtggggctactataaacattatgtatgagttttngtgtaacagaaaagtattacatttctcttggagaaatacctaggagtggaattgatggatcataggttaagtgtatgtttaactttataagaaaccaccaaaccccattctaaagtaactgttccatttggcctcctcactagcagtgcatgagacaaagggaaaca

SEQ ID NO: 723426 - DNA, 425 bp, Homo sapiens
aggaggttttttaggttggcccggggttccttttcaagggcggccagcttttccaggaccattccccccctgggtttggcctttttggccagggcctcaaccctttgggtggctttgtccccttttgtgaagtggcccatggctttttccttcttaaaggcttttttgttggaacccagaagcgggttctccccccccgcaagtccttttttgttccgacggagcggcgggcttttggggaggttggccctaagttccttggccccccccccaagttttgcccttgccggttcccggcccttgggggggaggaagccttctttgggccccttgaggaaggccggatttccaagggaggaggggctttattcccgggaccggtttttccgtttgtggggtttccattaaagtttttttcccctgga

SEQ ID NO: 723427 - DNA, 144 bp, Homo sapiens
ttacgccgccgcagacctcttctctgcacgccatttccgtccgcacccttcatggccacagttcagcatctgtaaggcagatggcgcctggtggacagcaaaggctttgatgaatacgtgaaggagctaggtgaggcacccggc

SEQ ID NO: 723428 - DNA, 145 bp, Homo sapiens
tcactgcttgccttgactccaggcccaagcgatcctcctactgcagcctcccgagtagttggagccacaggtgtgtgtccccacgctggcttttttttaaatttttatagggtctcctcattacccacagctaatcttaaactcc

SEQ ID NO: 723429 - DNA, 164 bp, Homo sapiens
gtacccgtgaagtccgtggaagcctgtgttactatgttactctgaaacgtagatccgtcggaaatggtgaagggagactcgaagtactctgaggcttgtaggagggtaaaatagagacccagtaaaattgtaatgagcagtgcttgaatttggcccttatcgag

SEQ ID NO: 723430 - DNA, 89 bp, Homo sapiens
tgagacaaggtctcactctggtgcccatactgaagtacagcggtgcgatcttggtgcgctgcatactacaccttctatgccaggcttgt

SEQ ID NO: 723431 - DNA, 107 bp, Homo sapiens
cgggattttttttggggggttcccccctcccgggccccccccctttggttttggggggggttccctttttttccgggtcccccttttttttttttgggcgcccccca

SEQ ID NO: 723432 - DNA, 832 bp, Homo sapiens
ggagagagagaactagtttcgagttttatttttttttttattaaggttggaggggaaatgcgggaaatggtacggggtatggaaacttatcatataagtaaggccagggtgagtggtaggaagttttccaaaggagaggtgttatcggaagctgggtcgtaacgcggaaatgccgggggtatgcctgtacgaatatcctataagaaccagggcaggttcaaaagtagggacctgagggtgaccacaaatatgctcgtcgtacagctccagcggaacactgccgtcatcatgttgtccctagcgaagcattgccatgcggcacacgggctgtaccaacctcccccaactacccgcgctacgcgcagtactcaccacagccacatcaacacgaccacacgcggccaaccacgcgccgcccccaaccacagcacaaccccaacacctctcccacgcccggcgacacacacacacaccagaaccaccccccctcgccacacaacacacccaaccagacggcaaaccacacacaggccaccacacgcgaccccacagccgcccgcccccccacataaacccaacaacccacacacagtgccccaccaaccagcccccacagacaacccgcgcgcccggcagccacacccacaccacaacagacacaccacccccacacagcacaccccacacccaccagcgccagcagccacaaccgaccccccaccagccacccccacccactaccccaccacaccacacccaccaccccacccgccgcccacccaccacccaccccccccgccccccccccccacccccaccccccccacccccc

SEQ ID NO: 723433 - DNA, 172 bp, Homo sapiens
aacccaacgtggctaggaagcacaactgtgacacatggacagctggatgggtctcggcaccacgctcacagaaaatgtccacctcgaaatgccacgacatacgagtcgatcatggcatatctagagggacagactgtggcagggttccagagtgagattcaagggcagggct

SEQ ID NO: 723434 - DNA, 407 bp, Homo sapiens
ttttttttttttgctaataaaatattatttgaagtaaatttccttcttccctgtatctgaacctacccaatgtttagttcctgtattttttgaccaaaatattagtcattgcccttatcatcatggccaggcacggtggctcatgcctgtaatcccaactttgggaggccgaggctggtggatcatctgaggtcaggagttctagaccagcctggccaacgtgatgaaaccccgtcgctactaaaaatacaaaaaattagctgggcgtggtgacaggtgcctgtaatcccagctactcgggaggctgaagcaggagaattggttgaacccaggaggcggaggttgcagtagctgagattgcgccgctatactccaacctggcgacaaaacaagactccatttggggg

SEQ ID NO: 723435 - DNA, 1995 bp, Homo sapiens
  misc_feature (1635)..(1640): n is a, c, g, or t
gaattccgagctttttattcctaagaggagaaaatcagtaacgggagaagcaggaggatgtccagaagaaatttcatcccttgctctcgcccctactctttctggtgttagatcgagcaaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaagactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaacnnnnnnaaacaaaaaaaaaaaaaaaaaagggggggccctcacaaaagtatacccctacgagggggcccaaaggtaaacgaggaccccagtcttctcgtggcaccaacgggggccccacaatagggactcgcgattaaacagacaaggacacgggccggagctgtcataaacacggtcgtctgaccggggaaaaaccgggtaacccttgcgagacaccctcggagaaaagaggacccccataaacaaagccagagggggggcaccacacatggggggcaccaaagcgcagccccacacaagaaactcttaaaggcccccaaggggggaccatacagacaacttccacgaacgcgccctaata

SEQ ID NO: 723436 - DNA, 1447 bp, Homo sapiens
  misc_feature (1087)..(1092): n is a, c, g, or t
cctgtaatcccagctacctgggaggctgagacagaagaatgcttgaacccgggaagcagaggtgcgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaacnnnnnnaaacaaaaaaaaaaaaaaaaaagggggggccctcacaaaagtatacccctacgagggggcccaaaggtaaacgaggaccccagtcttctcgtggcaccaacgggggccccacaatagggactcgcgattaaacagacaaggacacgggccggagctgtcataaacacggtcgtctgaccggggaaaaaccgggtaacccttgcgagacaccctcggagaaaagaggacccccataaacaaagccagagggggggcaccacacatggggggcaccaaagcgcagccccacacaagaaactcttaaaggcccccaaggggggaccatacagacaacttccacgaacgcgccctaata

SEQ ID NO: 723437 - DNA, 1136 bp, Homo sapiens
  misc_feature (1136)..(1136): n is a, c, g, or t
ggcagcaggacgtcaccaggagtgcgaagcgggcacgggcatgtgggccccgggacattgctgcatgcataggaggttggcaggggctcggcctgcgtggctgccggtcccacgaggctctgcggcccagtggtctaggtgctgtgatgcagggcccatcggttggtcttgtgtagatccgtcttgtattgccctcaccggctcatgcctccatggggcttggctatggcatgacaggtagcagcatccagggggacgtcaaaggagcaatggaggcagagaccaagacgtagagcgatggcagggcaggggccgtgaagtgaagtgagactcgtcagggacgtggatggcatggtgcacggcaagggcgctgatggatgcagcagcagggacggacgagctgggatggcacgtgagcctctcagtagccccgtggcccaagggcgggcctcgctggtgcggcgaccggacgccgggactcggtagccatcagcagttacagtggctgagatgacgcaggccacggtcttccaagcttgggagtggaccgtgcgccaccaagctggccgacaggccaaagacgccagggtccgagtggagcgtgacaaagcaggacatgacatggatccggatgtgacgagcgaggacatgaggaggcgcgtccggccttcctgaacaccttaggctggtggggctgcggccagaagcgggtctgtagctttacttcctccacggagtcggcacactatggctgccctctgggatccagaaccacaaaatgaacagcaatggtgctaccaggtcaagcctgggctttgaatccggaccaaatcctctagcttgcgaatgcatatgctgcactatacaaaccctggactactgactcaggaaatcgcgtccgcaacgtgaacgtagatgaaccccagactctataaggccaaagattatagaccccttctggaaaaagaagcgcgagagacaccaacccgcgaacacggagagcaaactaatagagaaaaccgttgtaggagaagatacacatgacaacatagttttcacagagtaagctcctccaggagagtagcctccgcacagcagatcatatacagacaggaaagagtaacaacaatcagatn

SEQ ID NO: 723438 - DNA, 173 bp, Homo sapiens
taccagaactttcacgttagggatctctgcagcagcagctttggggcggcgcctctatcgtcttggggtggacgatcattcccaattcccaattcaacgtggcggtctgcgcagcagtggcatcccttgttgcggttgccattgttgccgctgtctcacgccgccgtgaagat

SEQ ID NO: 723439 - DNA, 257 bp, Homo sapiens
  misc_feature (16)..(16): n is a, c, g, or t
  misc_feature (120)..(120): n is a, c, g, or t
  misc_feature (163)..(163): n is a, c, g, or t
  misc_feature (172)..(172): n is a, c, g, or t
  misc_feature (209)..(209): n is a, c, g, or t
  misc_feature (211)..(211): n is a, c, g, or t
ggagttctcggggccnagccacaggtggggagacgccttggcttaggtaataggaggataggagaggaggcctcacttctagctgctgtgctcagggtggggcacgcagaggccttgaanagtaggagcaggcagtattccaggatgactgcaggcccaccgngcacctggnagctgaaggacatggcgcacacagcagaagctccggnangcacatgccgcacgtggggagggcccagttcccatcactgttgggt

SEQ ID NO: 723440 - DNA, 179 bp, Homo sapiens
gtcgaaagatgtcagtgagatgagtcgtgacgggtgggtgccgggctttccccgtgtgtacaggcacaacctgtggctacttccctcgcacagtgacccgcggtgtcatccacgaattcacagcctgtttcccaggaggtgggctcgggagcgagtgtcctcccaggtgccgcccagta

SEQ ID NO: 723441 - DNA, 1522 bp, Homo sapiens
cttgtgagatgttctttgcctcagcggcggtgtgcttggttcgttttcgcctcgtttgtaaaatcttgtcttttttttgaccgtcgccgctctccaaggtgtttttgtttcttcttgagggtcccccgtagtgttttgtgtgccgcctccgttaccacgggggctcccccctggattgtccctcttctcggggggaaaccaccggcgacatattttttttgtggaggtttgtctactacggcgttttaaatattgtggggggcgccgccctcgtacctgtttttcttgcgggggccccccctctggatattatgggggggccccccacatatttggggagaaaaattggtgcctccatcgatagtataatatccttcgttgtgggagtatagtattgagtaaccacccctcgcgggtgccacatatctctgttgggcccctcgtaaggggggagatatagaaatatatgatatctcttgggtacgttctggccgtttttggggagaccacacaggagaaaatagggggggactaccacgagaggcgccctctaataatagataaaattattctctataatgtaagagcggccacaccagtttcctccacacgaagagctcttgatgaataacctcttgtggggtcctccacggttgagcatcctcaccaagatggttggcgcaccacatgtgggcggctgtgttttttttttctctcgtccccccacacgcaccacgcgccctggatagccctctcgtcgttttctcatcacaggagaattggttctactgcgtctcaaccccactactggtgtttacgatttggttttatggtggtcatcacgtgatcgcaccacgcgtgtgttttataagaggggtcctcgttgttgtcccacaggcgacgttttctcactatacccccccaatatgtgtctccacagcggtgcttctccacagagaggttataaagagtgagaggtcacactctctgtgactacacacctgagagagttctctcacatagagccgctcctgtggaaacacacccacacagtggtgggatactctctcacaatacacacacatagtcttgtctcctctcgcgggagaaaattttctctccacgcgcgagaccgcgcaccacacatgttatagagaatatattgcccacacacaacacacatctcgtcgtgagaaacgctgtgagacacctctccacgcagatgtctatattaaaagatgttttctctctcatattcccactgagaattctctaccacacaagtcacacatgtgagagactgtgtgaacttctatgagaattgttcttctatgagaaacacacaataggctttttatactgagaacttgagaccacacttgttaccacaccacagctccctcgggttttgttttggtatgacttataaatctatgaatagattgtaatgatctctgggaatgggggaggggaattaaaagttatagagcctttaaaattaagtgctcccatgtcccagggt

SEQ ID NO: 723442 - DNA, 237 bp, Homo sapiens
tctagaggatccgtgcaccgtactttctcggtgactgagatgtaagctatgcttttcccaccagaaatatggaagtttaacctgaagaacagactctggagctggactggtttgagccccacctcctaacttatctcctgtaagttattaaactttctgaactagtttcccatttatggaatgaaaagaataatactcactgcaaagggagaaagtacggtgcacgggatcctcgag

SEQ ID NO: 723443 - DNA, 711 bp, Homo sapiens
gcttcaaggatgtctgtttatgtctgtctaggatgttctagacaggtgttcacatttgtgaccaccttactcacaggtgcagtgatctcacagaggcagacatagattcatgcattttctggagagaacatttttgaagaagggaagctttggtatccttttggcttctatggagctttgctatctttttcttttcttttctttcctttttttttttttggagacagagcctcactctgttgcccaggctggagtgcaggtggtgctaccgtgggcccactgcaacctccgcctcccgggttcaagcgattctccgttgtctgagcctcctgagtacctgggatcacaggtgctcgccattacacccaactaattttggtatttttagtacagacggctaaaaatttcaccatgttagccaggatggtctcgatcaaggagtgaagtatttttctaattacttttccctggtttttatctcctaggtcttctgttccaagctcttagtgaattcggtattttccaggactggctctacaaatagtacagctttattttcaccctcattggttttctactaagactccgggagaaactgagttcaatggtttcatataaggattataccttgagttccattttccatacctttcaaaaggagcattactaactaaatttacaaacatttcttacaacaggacaacggccaga

SEQ ID NO: 723444 - DNA, 144 bp, Homo sapiens
tgatgtcgttgctcagcctcctgagaggctggtaaagacgtgcacaccatgcctgactaatttttgtatttttagtagagacaagttttcgctatgctggccaggctgacctcgaactcctagcctcctcatatgatccaccca

SEQ ID NO: 723445 - DNA, 222 bp, Homo sapiens
  misc_feature (29)..(29): n is a, c, g, or t
  misc_feature (80)..(80): n is a, c, g, or t
  misc_feature (144)..(144): n is a, c, g, or t
aagttttcaccatgttgtccaggatggtntcaatctctttacctcgtgatcctcctaccttggtctcccaaagtgctggnattacaggaggatccaccatgcctggcataaccctgtgtttctactccacattttctatgccangctggacttgagtgcgacaatctcagctcacttctgcctcttactctggcgtcaagtgatccgtcccgacgtcatcct

SEQ ID NO: 723446 - DNA, 192 bp, Homo sapiens
ctgtgggtacgtggctgggtttcaaaaatactcaactgtctggaaatgaaacacatacttctaaataatccatgagtttaaaaagacgtcgcaaagaatatggaaaaatactgtaaactgaatgattgtgagaacagaatatacaaaaatgtatgagctgctccccactagcaggggtgtgtccacacacct

SEQ ID NO: 723447 - DNA, 588 bp, Homo sapiens
  misc_feature (489)..(489): n is a, c, g, or t
gacagcatccctaaccaaaaaggagtgcattaaagaagttttccaagtgggcaccagtgttggggagtataaagaggtttagaaggctggctgtcaatacccacaacacttatgaaggcaagggaaacaggcccttgaaaagaaggtaatgtggagtgggtagcgtccgtatggattaagaaggggacggacttaccctccatggtaagagttacccaaagcatctgaggcttccaaggagatggggcagtgtgtcttcagctgctaagccaagaagatctgggaaggagtaagtcagagccttgggccagttggacagtccaatttccagtggcgtccctcacagatgggacacgacttaagaggaatcccaggctgtgggcattcctgggcctagtggccagatttccggcacttgaagcaagatcctgggggaggaagtcctgaaggaacgcctgaccgctgtggcttaggcgttttgaagttttngtgtgctggagatatggctggggttttctctcacagcagagtcaagtagttgcaactcttctctattactgtacaccttgaaggtgagggtaattaggt

SEQ ID NO: 723448 - DNA, 300 bp, Homo sapiens
gagggctagctacaacaaagctgttcctggccaaggcgctaacatccccgccgcgcagctacaccttcttcattgacatcctgctcgacactatcagggatgcagatcgctgggtgcatcgagcaaggcctacgcagaaaatccttttcactgcaggccacccgcgatcctctatcttcaactacacccataaacagatgacagcactacgccaacgaagcgacgggtgggtcctggtgcccctaccaacctactacacgttttgccagcacagcagcagtaagccggaacgacaccacc

SEQ ID NO: 723449 - DNA, 166 bp, Homo sapiens
ctagaggatactttcccgactagcccgacagactggcatgctgacagctactacaacaccacctacgtactgttgtgcctatgcatacggtccgttgtttgctctcagtcaccgtcttcaggttcgcagaccaagttcgacttcacctcctgtcgtgctagtcggg

SEQ ID NO: 723450 - DNA, 351 bp, Homo sapiens
gagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggtagagcttagaggcctctacaactggggacggccccgccattataggggcccacaaaactaggttggacagctgcacaggacgggactgaagaaaggataaaccacgatgttgggacctcacactgggtgtggtgctgggcatatcaactcaggaatattaaggaattgtggggacgggaatgttacaacctccgcag

SEQ ID NO: 723451 - DNA, 206 bp, Homo sapiens
ttcaattgcgtccgtgcactatcggcgtgcgttgggacgggcgaacgtcttccagctggagcggatggatgagagtgatgacggtgacgccactaccggcaccgcgcagatcctcaaagcaaggacggcctttgaccccccgacctcgcactcggcgatggacaaaatgtggcgtaatggcaagcgggtacgacgggtcaagctgg

SEQ ID NO: 723452 - DNA, 1103 bp, Homo sapiens
ggaaccttgtacgcttgctcaaaaaaaaaaaaaaaaaaaaaaaaaaaaaaaaaaaaaaaaaacgggggggcccctccgccccccaggcccaattttgggtcaacattatttttcccacatataaaacccgtttttttgggcgacccaacttcgaggaaattcaaaggcggtggggggggcggccaaaaatgtggtaagaacggttaacagacggccatctttatcatattaaacattcagcgcgccctaaaagaaggagacaggcgcgtttaaaagaagcgacctaagttattatacaaaaagagggggcccccccatatttcttggtgtcccgacagataacagcgagttggcgaaaaaaaactacccttgtgtgagagtacaccacgaggggcgcttgtggttgtgtcgcggagtagaacacacggacctagggaacttgtgcgaaaagagaaccttgcggtctttgtgagcaaaagcggggaagacttcgggaggatatagggcggtgggcaacaacacagggggccccaccaatagggtaagcccaaaggagtggggttaaggaaaaaaagccccgcgaaagtgtagaagggggagcaccttagacacctcacaggagggatagttaaccggaccaacgggtgttccccgaggacaaaaccattgggggcacgcgggcaagcgggacggacggcagaaacgcacacaccacccccctgggggacgcccgtggggaacccacacaaggcgcagtttcccgtggaccgcattggcggggacaatttctggacacgcgaaagtgcgtagtcgcgacaaatgggaaaaaaccgtgtcaaacgggggaagtagccgggaagggggagtgggttgaccacccagagagcaacaagaacaggatttgcgaccgaatcccaggggggaagtacaccaccaacgtggacacggaagacaggtgcggcgcacacctcacacgagcactgcccagcgccacacaagcaacaagagggggttacccggacagggtcaagggtactgattgaacagcaagcgccccaaggggttaaacataagggggcgaacccacatagggttgtagcact

SEQ ID NO: 723453 - DNA, 1368 bp, Homo sapiens
  misc_feature (2)..(2): n is a, c, g, or t
  misc_feature (64)..(64): n is a, c, g, or t
  misc_feature (149)..(149): n is a, c, g, or t
  misc_feature (314)..(314): n is a, c, g, or t
  misc_feature (335)..(335): n is a, c, g, or t
  misc_feature (390)..(390): n is a, c, g, or t
  misc_feature (444)..(444): n is a, c, g, or t
  misc_feature (473)..(473): n is a, c, g, or t
  misc_feature (479)..(479): n is a, c, g, or t
  misc_feature (549)..(549): n is a, c, g, or t
  misc_feature (603)..(603): n is a, c, g, or t
  misc_feature (652)..(652): n is a, c, g, or t
  misc_feature (792)..(792): n is a, c, g, or t
  misc_feature (900)..(900): n is a, c, g, or t
  misc_feature (910)..(910): n is a, c, g, or t
  misc_feature (913)..(913): n is a, c, g, or t
  misc_feature (920)..(920): n is a, c, g, or t
  misc_feature (922)..(922): n is a, c, g, or t
  misc_feature (935)..(935): n is a, c, g, or t
  misc_feature (967)..(967): n is a, c, g, or t
  misc_feature (969)..(969): n is a, c, g, or t
  misc_feature (979)..(979): n is a, c, g, or t
  misc_feature (1046)..(1046): n is a, c, g, or t
  misc_feature (1094)..(1094): n is a, c, g, or t
  misc_feature (1168)..(1168): n is a, c, g, or t
  misc_feature (1191)..(1191): n is a, c, g, or t
  misc_feature (1367)..(1367): n is a, c, g, or t
ancagacgactatcacccccccccccccccggacaccgaggtcctcactggggtggtgactgcnacgctgatgctgagtggaagccaagcccctccagtcagagctgggccgatctcagacccaaatgctaccaccaccaagccctgtntcgcgacggcagccgctgcagtcaccagaaacaatccttcctgcctcgacacccgtgccagccccagccaccctgacggcgggctgtccacggaaatgccacggccaagagcccaggtccttcacgctggcctctcccctgccgggctgggctccccagtccctncagagtccgttgtgccgagcnctggagaccctgccggacaggtcctgcagaggcttctccaccgtgtagcccagcnccttggtccgcccctccagcagggcgtgcttctcgcggctgcggctcaaacgcncgccgtcgcccacactctctgcgtgcctnagcttntcgtgcgcaatctccagctgcttctggtagtggttgtgcttctcgattttggcttcgaagtgcttgagcncctcccggaacgcctccagctccttgtccgtgaggttggcggactgcgccaggncccacaggtcaatcaccctgggctcctcgaactcagcctcagtgctgtngccctggtggctgaccctgcgcaggcggtccaggccctggttgatgtgcgcacttctccttcagctccgtgtgcctgctgtgcaggacgctgcccttgatgtcgctcaggtccgaggggctaatgacgttctcgtggatntcttcggtcctgctcagggtctccagcaggacgttgtactcgtgaactttctctttgtgatgcaggaaccccgccagagcttgtccagttcttcgccggagaattccnagaggtcttngcnttgtgcnanagcttttccagcntggggttatccagcccgttttcctgggtgcantnagggagttgnggtcactgccgagcgtcttttttttcgtccagaccatatttggctaagatgacattgaggttgcgtntgagttttgttttcttctccccatcttcgtccaagccgtcaagttttngttttttccaggcgagttcgtccttttcttgtatttttagatcagcgtggagttcggccagccttacgggaggnagatgcagttgttgggctttttnctacagttggtttaatttctccatgcggtattcctctccagattcgcgttttggggacggtttgggttggtttttttcccgcgagtacttgccgccgtggctcgcagcgggccagggcccgaggaagagcagcagcagtagcagcgccgggagcccgggcagaaacgacctgaccnt

SEQ ID NO: 723454 - DNA, 346 bp, Homo sapiens
ttcacctcagattcagaatctctgattcagaagttctgtagtgggcccctggcattaatgtgatcttgatccaacctatatatactcacagaatctatgacaccctgtgcatacattgcttgagttacttgaaaccagtatcttagtaaatgtttaaggttaatatgacctttactacttgaccaataccatatgttatgattcacataaaactctaacgtgctcaaaagttgtgtactaaagggagtttgtacctgttgaaattacaccacattccaatggtgcatttctgaaattacctcaataagggaaagactcatttaataaatatgtggctcatcctaac

SEQ ID NO: 723455 - DNA, 923 bp, Homo sapiens
tcgatctttatctatttatggaaaaaaccaatccgtgggaaaaacaaaaagggagaaagtgaggttagggagacaaagggtgcggggggtgtgccaaaaaagccccagcccctggagtgtgggggtggcgggagggaacggagaagggctcagcttggtaaaacctcagtgcctccggcctcgctccttctcttgggatgaacagggctcgtgggtagagtgccttctctctcagaaaagctcctgtgggcccagaggcacccagaggtaacggggtattctcacacggcgcacagagcccaaacatattcccacacctcctcggcgggacgagaagtgggagctacaaactatcagagcctcacgggaacaaatcttttatcggtgcgcccgggggcacaacagagtaagcccgtctccaaagagggtaaacacccctcccacaagagagagagggatacccaaacggggcccagagagggaataggggggcaacaaaaagccaaaacgccccactaccgtgggcgccgaggagagcacaaacgagaacgtgcgagaacataccacaactctcaaacggggagcccaacgcgcaggaccctgggcgccaggaaaccacagcggcccgggagacaccccagggggctgagcactgagacccctagggtctgggctgggcccagggcaaacaccccatggggacaatttgagcaccacatccaccggcgatccacaacaatccccacaccacaacacagcagaagaaaacaaacaagcaaagccacacaccaaaggcaacagagcccatcaagagagaagaagacccccccaccgacgaaggcccagagccccccctggggactagcggaacaaaccacacacaaaaaagacaaacaaaggaaatagagaccaaccgcgggcac

SEQ ID NO: 723456 - DNA, 483 bp, Homo sapiens
  misc_feature (424)..(424): n is a, c, g, or t
tcgagctccgtaccggcatgtgctgtaggccagcgcacaaactcatcgtaatgctcacctacgacgacttaaacgaacgctgcaagagacagccgcaacgcccggcgggtaggcgcgttcaccgcccgccgggaggtggatcaattgcctttttcagccgccaaaaagtacgcaaccaacgcattggcgtgaccatggcccatgccgtgttcagtcttgagcaaggccacaagctccatatgcttcctggaactggcggccttgagcagatccagccagtggctaatgggctgcccatagtttttttcgatggaggggaagtacgacgctggcccttttgtttttgtatcgtcggtcatgatgcaaactccctttttgctgaggtgataatgcccggataacgttaccgcctggactcaccggntccaccgtacgcccgtcactacacgcctccgctgcctacagcacatgccggtaccgaga

SEQ ID NO: 723457 - DNA, 758 bp, Homo sapiens
gatgaagctgatgggcttctttctcaaggttattctgattttataaataggatgcacaatcagattcctcaggtgacctctgatggaaaaagacttcaggtgattgttgctctgtccacatttgcattacttatgcgatgtagaagaaagctgtccgagaagataagtgcattttcactacagtgggtggacttaaaaggagaagacgtctgttccgagatactgtacaaccatgtcgtggtcccagtaaatcccaaaattgacagacctctgggaaaggcttggaaagaggcaacattagacatgatgatgtacatgtaagaagataacacaagatcgtggtgctaaatagtccagagatgtggtctgaagctattaagaatcctgaaaggggaggtatgctgtccgggcaatcaaggaaccatgagatggatcaagcaattatcttctgtaagaaccaagaatttgatgtggataacttggagcagtacttttatacaaaaggaggaggacctggattaaataaaggacaccaagtttctcaatagtgtgtggtctatcaggggtgaaagtaaaggctccatgaggaggaaagggacaaagctttggaaagatttaacgaaggggagggtgtaccgatttctggttgggacaggatggtagtgttagaggacttggttcccgggggggcttatgtgtaaatggtcctttggcgtggaaagagataagttcatgatggcgattgaaaattgagatgg

SEQ ID NO: 723458 - DNA, 323 bp, Homo sapiens
tggggagtccaggcatgtgctcatcgtcctactaaggggtacagaaacagcccagcgggcggtgtcgatgggcagaatgaagcctgtagggacaccttttcgctctgggttgtgagacaaacgacaacgtgtgttcttagccactgccgatggggagatccccaaacgccctgcttcgcgttcaccttcagctcttcgtgtgaggctccgggaacgctaaattcaatgtcattctgcctccatagatctttctgtgccaatgactcctgaattttatcactcaacctgggagcctcgacggttcctcaaacggagctggaaac

SEQ ID NO: 723459 - DNA, 137 bp, Homo sapiens
  misc_feature (21)..(21): n is a, c, g, or t
  misc_feature (72)..(72): n is a, c, g, or t
ttggaattggagcctatcccncaacccgaagctaacagcatcatgtggttactaactgttcctcattcaccngttgatgcctcccagaaaaaaacgccgccagccttcccagaaaggcccgctgctgttccaccaac

SEQ ID NO: 723460 - DNA, 569 bp, Homo sapiens
tggtccggtcccatgcacagttgctaaaagagactttaagaatcggccagcacggtggctcatgctgtaatcccagcactttgggaggcagaggtgggaggatcacaaggtcaagagattgagatcatcctggccaatatggtaaaaccctgtctctactgaaaatacaaaaaaaattagctgggtgtggtggtgttcccctatagtcccagctactcgggaggctgaggcaggagaatggcatgaacccgggaggcagagcttgcagtgagccgagatcacgccactgcactccagcctgggcgacacagcgagactccgtcttaaaaaaacaaaaaaaccccacaaattttagatgtgcgacatgctgcccaccctgggggggatactgctcattgtctcactggtagccaccctctaagcttcctgggatccatattttgtggtacactaagttgagatttattctctcataaccatgaccatattacctattttaaccaatgaatacaccgagagtataaacacaaacgaaaacaaaaaaaccctcaagttttaattagaagtca

SEQ ID NO: 723461 - DNA, 162 bp, Homo sapiens
  misc_feature (9)..(9): n is a, c, g, or t
  misc_feature (153)..(153): n is a, c, g, or t
cggctcagnctgttggcgcgaagagagtctaacccaaaattgcaaaactcccgttgatttccaggccctaccacacggcgatgtcaacttgtcctccagacatggacgactaccaaagatcccagctacgaagcatggccttgcttagaaacntttttagat

SEQ ID NO: 723462 - DNA, 371 bp, Homo sapiens
tgagacggagtctcgctctgtcgcccaggctggagtgcagtggcgcgatcttggttcactgcaacctccgcctcccgcgttcaagcaattctcctgcttcagcctcccgagtagctgggattacaggcgcccaccaccacacccggctaatttttgtatttttagtagagacagggtttcaccatgttggtcaggctggtctcgaacccctgacctcgtgatccacctgcctctgcctcccaaagtgctgggattacaggtgtgagccaccatgcctggccatttttttttgggggggggggcgcggtggttattttattcttttttgccctggctgtggtgccgtggtgcgcattttggttgcagtcatc

SEQ ID NO: 723463 - DNA, 312 bp, Homo sapiens
gatgctggtggcaggtgaaaaagggtaacctcaagctaaaaagcccagaaggggaagccccttgcgccgaaccctgtccttgtcagaggaattggcggtattcccgatctaccatgtattcagaaaggccatgtacagggggaaggtaccccgccgttaaatcccaggttgaaaagaaaaaggaggagaaggttctcgcaactgttacaaacccgttggtggtaacaagaacggcgtcccgggtgttaactttcgcaattgcctagttttttcccctgaggtgtccctcgaagctgttggcccggaaaaccg

SEQ ID NO: 723464 - DNA, 292 bp, Homo sapiens
  misc_feature (42)..(42): n is a, c, g, or t
accctttttaaattttgccccccccgggctttggggtgtggntgggggccccaactcagcccattagtttcccccagctcttgtggggaaagggatgctattttttccgttttgggccggagggaaaggagggaaagtattttttccctctattcccccaaccggggggctgttccaacaggatttcagggggcccaaggaaaccctgccccgcccccgcctgggtgcccctttccccccggtggtgcccccccttcctgcccgtccttttaataaacagggttttttttta

SEQ ID NO: 723465 - DNA, 139 bp, Homo sapiens
gagcaaagagcagtgcccagcccagctcagagggcaaatgggacagatcccagaggccctgaggaggtctctgctgctgatgatgtttgaccaaacgcacccaacccttggcagccatcttgtccctgcagtcatagcc

SEQ ID NO: 723466 - DNA, 203 bp, Homo sapiens
gcgacactgccagtgttcatctcatccatcatcctgcgcaggccgttgatgttatcctccacgctacatgcgcattagacctgtatccgtctcaaacttggttcggaagtcatctgcagccagacgggcgttgtccatctgcaggacaatcctggagttctccactggtggcaccaagaatcttgtcccgcaggtcctggagt

SEQ ID NO: 723467 - DNA, 232 bp, Homo sapiens
catgatatgaatctgagctctgtacctggccgccgcgctgggggcgactgcaattcctcagtcctgcgcggaggtcgaagagtacctgcaggcgatgctggccgcagctgatctgcgatgaacgcacgcaagaggtggctgcgcattctgctgaaggcgccggcaccgagcgcattggtgcgcccgcttggcggggtggtgatgcaggcgggcatcgatcttgttgcccgat

SEQ ID NO: 723468 - DNA, 190 bp, Homo sapiens
cacgagaatcacttccattttccactaacaaaataatttatgatcaagaagtctgactcagtgtctccacaggaacctgttcctcaccattctggatgtcattgattctgacatcacaccatcctacacaggtatttctggaaaaggatctggcaagaggatgaatttggctctaaacaaatgcccatgg

SEQ ID NO: 723469 - DNA, 250 bp, Homo sapiens
atgcgtgttggtcgtctctgaggatccccctttgatgcccttgatgcttactgtgactgtggatacgggggttccctttccccattcagtgatatgtcctctctgcttggtgtaaactattcttggtgaggacacttttgccaagtgatactctttccccagtctgattcgttgtctaagtgaatgattccattatctgttgcccgttttcctctgactatatatcactgcctcgtgaaggatcagcatg

SEQ ID NO: 723470 - DNA, 954 bp, Homo sapiens
  misc_feature (91)..(91): n is a, c, g, or t
  misc_feature (393)..(393): n is a, c, g, or t
  misc_feature (482)..(482): n is a, c, g, or t
  misc_feature (750)..(750): n is a, c, g, or t
cgtgcatgtgacacggctctggcttctgactcggcaggggactatctgggaacgtgttacgacacacgggaataattatatctatcttttntgccgtttatatttaggggttttgttgataaaatcaagtcttggtgtggctgctgaattaaatatttatgagtggtgcatttttaagtatagtgaacaagacaccatattaagtacagtgataaagcatctatattctgtaaaaaaaaaaaaaaatctgcctatgcatgttttttaagaaaaaaaaaagggctgtatcggcctgtatgggactggtaatgcgcttagtgggtctgacatatactgggaaatgtatgtatactgggcgtactttatattctctaaaatggcttaatggccttngaaatttggtaatcaaaaaaaagcttggaaaaaatctaaagggggagagtatccttaaaagtttttaacataagctggtcaatggcccntgtagatggttagcatgtttagcaaacctggtgaactcataataagttggtagttacatgtgaaacctctaaatggcttgggcaactggttaatggtcataaccagtttagtaatttggtcctggtcctggtcatgtgccacaaaatattgtactttttccactttttccccttggtatatcagttacgggttacacactgggtccattctggaaaacaacaacaacaaaagtccattcatatttttaccaatggtataagtgcccangtaatccactacagcctaaagcctcgcctttgtaattcgccttctgaccatgtcggcacttcaagagcctatgcccttggttcacccatggaacacagaacacgctttttatattcacctacttccaataacagtgtggcttgaactttacagaattctcatccttccaatgaggtccgtgaagggattcactgttgcacaaca

SEQ ID NO: 723471 - DNA, 436 bp, Homo sapiens
gtagagatggcgtccaccatgttggtcaggctggtctcgaactcctgagctcaagtgacccgcccttgttggcctcccaaagtgctgggattaccggcatgagccactgtgcccagcctatatagtgtgaagcttttaggaaaatcagaacagggtacgacagctgttaaaaacaatgtttaaatggaataactgttgactgtttacaggctgtaagaactattgtatacacaaaatacatacacaaagtttgtactttgtgtacaaatacacctttgtactttgtgtacaaataatacaaaacgtttgtatacacaaactttttacgttgtggcttggtatatagtcttaactgacttttcttataagaaccccatgaaacttacctgagttttaaaatgctatccaggacatcatacttatgtatacatgaaaa

SEQ ID NO: 723472 - DNA, 626 bp, Homo sapiens
ccgatgccgcatgcctggattaggcaagattggagataatcaggcaattacctgaatcaagatggaccgcttggtcaaggacatgaagatcaagatactgtaggagatctatatcttatcactgaccatgaaggaattagcgaccattgctagcattatagtagactctataaagcttgagggactaaagataatgccagtgcagactcagacacgagtcgttaagttgaataagatcatagtattagttgatatcggcgtcaacattgttcacgtgatactaggtgacaaaggctgcacagaggagttcgtagtcatctagctagacatgatcatggtcaaggtctactattgccttggacgcaaagactacttcggatacaagatcggcgttccccacactagcccttgcaaggagacaggccgttacggttctgtagtgcacgacttagcctgtatacaaagtataagcattgttccgcaaatggcctatgctactatgctgtctgtacagacacagtcaactaagatatataactgcatgaggtaactaggcatggtactttgaagactagtataactactgtaccacaccgcggctctagcagcggcacaaggcttatcat

SEQ ID NO: 723473 - DNA, 94 bp, Homo sapiens
  misc_feature (5)..(5): n is a, c, g, or t
  misc_feature (51)..(51): n is a, c, g, or t
ttctnccggtaaccaggagctgaagtcagcctcaggcattgatttcctgtncatcggggtatccagggtaaccgggagaacagcgatgggggtt

SEQ ID NO: 723474 - DNA, 960 bp, Homo sapiens
tctttttcgtgtcgtgagacagagatagcaatcaacgagtaaccaccagcgagagaagaaagaaacaaggcattatgtgactcctttgcttgtctggtttgtattctctgttgattactccgtccaacgcacaccttttcatttggctctttacgtctttctcattggtaattcttcggttgtttcgaatatttctctccctttgtcccgccacttgttgtccgctgggcacccaaatgtcgtgaatggtttctaacccaaacagacgtctttcccgaggatcccttgggctttcaacaaaggcaatcttggctggccccaacctccagaattatctctccccccgggctttttcaaattaggggtgcacctcatctcggcccacgccctggcggtccatctttttttcgccccaccccccacttatcatcgttggttgccagagtgctgtccgccatacctccttggtgctgtatctctaatctccccgaagtgttcctgattgcgacctacaagggtctgtctccgccccaacgtcgtggagaccaatattcggtggggtcacccaagggccagaatggaagttcttgtgcgcgctccccctctgtgataagaccaccccccttcatttttgaaaaacacgcatgctccccaaacaccttttgtcctccagccccctctttaactgctctctagtgcccggcagcctgctcatatttaaatagataacaatggttaaacatataattcccaccttcttcaccctgttagaacaacagcactcaattagtacagatagtccatgccaacaataaccacttttcttgtatgtgagaacactccagcttctcgcagagatcggctattttccctgctttattcccaccctcgaaaattctaaattgttcttcccccttcagggtttctgaacttctttttcacccaccgccccacaatgac

SEQ ID NO: 723475 - DNA, 328 bp, Homo sapiens
tgatgcagacaacgcattgccacaatccggcatagctttatgattacaaccctcagccaactcggcatagaaggcgcataactcaaggtacatcaaagccatttatgactaacctacagccagcatcatactgaacaaggacaagttgaaaagtttctcctgagaactgaaagaggacaaggcatgcccacttatcaccacttctattcaacatagtactggcacagtcctggccagagcaatcggacaaaggaaagaaataaagggtcatccaaactagaaaagaggaagtcaaactgttgctgtttgcacaatgatatgatttgcc

SEQ ID NO: 723476 - DNA, 445 bp, Homo sapiens
tatatatgttataaaattctaacttcggtggagtactttactttgatattccacttgcaaaacagaaccactgattccttcctgcttgacaagattgagtcgctatcaaggagctgcccgtgctttggaaatggtccaaatcgacgaggaactgccaaggagccccctcagacacctctctaagccacacaagccacggagtatagtatgtctccatcaccaaagaggagcaatcgacacctctctgcatagacaagactatcttgaccagaggcactgacagccttccagggtggcagagagacctgtgtgtgcaaggtggcagagatgtggcgcagaagagatgggcacttactccagtgctgatacacagaagccagctttgttcaaaacagtgttgtttagcaaggttgcactgtatataaattaaatcaacatccttaaa

SEQ ID NO: 723477 - DNA, 166 bp, Homo sapiens
tggctttgtaagaaaattattaataaatttacaggacgggtttaaactaacccgagggggaaaagggggcccttgcccttccaaaagcacagagcacaaaaatgagcccgttaacatggggagcctccgggcgggggttaaagccattaaaaagatcctcaaaggg

SEQ ID NO: 723478 - DNA, 636 bp, Homo sapiens
tagcggagcagtagtgaacaagaagcacggtgaggcggaaaaaaaaaaaccaaaaactcagatagtgtgcaagcatttccggggaggctatggaaaacaacaacgtatggctgggttgggggtatgcccggggggggggtgatattggcatgtatcgtcatgcacttcctccgggattggtgtcgacaaaaaataaaaagaaagaagagaaagaagatgaaatttcattagaagatctaatggagagagagcgtcctgccctaggtccaattgttcccaaactcactctagaatcttttctggccgggaagaaaagggaaaagacaagaaaagatggagtaaccttgaccatgatatggaaacgagggaaggctgacttcaagagcggggaaagcactagtgagtcaggggtcgtgaagtgtgtggaattccgtgcggaacgggtcaaggatgatgatgaggaagcagatgataccggctacacccagggaacggggggtgatgaggttgatgattcagtgagtgtaaatgatatagatgtaagcgggtacatcccaggagatgtagatgaaacgggtataagggtagccagtgttgagagatcagcaattatcttcagataagatgaagaaatta

SEQ ID NO: 723479 - DNA, 281 bp, Homo sapiens
ccggcgccctgcgagcaatagcaacaaggaccctggagagatttgaaccacgaatgggagagcccacggggtttctgctgaaggaaaacatcaggccctttcagctctattagatcatcgtgactcccttgtaccacgacagccatagtgtatcctcccagacctgtctatgcctcactctcatgcaggtggctcccctgctcctgccccgacagcctgcatctgaagcgacattggctagaccgtggtgctctgctggacgtgcgtgcctccagcccccc

SEQ ID NO: 723480 - DNA, 690 bp, Homo sapiens
gaaataggagttagtgcgttacgccgaccagctgtgacatctgttgtccgctgaaatgggcgcggtgtttacacatgtccgattatgggataggagaatgcccgtgtagccccatggatgtcccttaccctccacgatcaggccaacttcccccgtggcgggtctccaaagcagccggtgcgtggctactaccgtggcgctgtcggtggcacgtttgaccgcctgcacaacgcccacaaggtgttgctcagttgtcgcgtgcatcctggccaggagcagcttgtggtgggagtagcagacaaagatctgttgaagagcaacgttgctccctgagctgctccaaccttattcagaacgtgtggaaccatctgagtgaattcctggtggacatcagaaaaagccctccttgacctttttggattggtttcccaatttttccccccaccacaccccccctctttttttggggcggtcctcccccctcgtgtttttggtggggggcgggaggccaaacaaaaaaaccaaccacgtcatccacaacagcacaaccaccaccccacgaatattcttattacaaaaacaccgttcttcgtggcaggcaaggagagagaaggaagatggtaacccccccccccaacccaccttgcgagaggagcaggtgagacaccaccagcatgctcttaatcgagg

SEQ ID NO: 723481 - DNA, 180 bp, Homo sapiens
ttttttttttttgcccttatgtgtcactaaacaactagtttctctcccttttgtcagttcccattgtgtattttttcaaaagaagtactgtattcggatgccagctaataaattgtcacacaatggaaaatcatatgccacaacattcattgtaaggtttaataaaattaaatttgcacc

SEQ ID NO: 723482 - DNA, 945 bp, Homo sapiens
aatgccttcactatgccaaccggagtgctactgttgaggtgactcgcagaacttcatgaaaccgctagataaatgatcttctctttgaatcatagacattagtcatcgactcactcaatgtcatctagtcgttttagcgttactggagaatagttgtgtatgccgctctcagttttcataagagttacggtactactacggatctacagattactgtagtaagtcatcatcgatcccacctatgatcgcatttctcatgacgcgacggtaatacggatcgatcggttgctagctgcatgaaggtgggtttgctcatgatcgttagtgcataggactctagaaagctatgtcacttatctcatgaaaactcagatgacgaataatgtgactattcgatcccccgtaatttctaccatattctaaccgggcaatcgcctttcatgcagtcctaattcgcaggtgttgcgtatagaacgtgctctacgagatcttagcccctaataagggttgcatcgtgattaaaacttccttatgcacgcgcgaatgcgtgtctatcaatatacagcaggactttctaaacccgtacaggtgttcgactactatcatatgaaaccctgtacagtggtactctatgtagcaaccagcggtaaacgaggattttccagtcgacttttgaaaagtgcctaaggtgttccatcggcaatttataactcatacaccgttcaagaccgtagacaaagttggccacattgacttgtgcttcgcggcacgctcggcatctgattcgaaagaccatttctgtacgagaatgacccgcagttaatacaccgatttcacgagattgttgggaaccaaaccatgtgaagggataccgaggaaattctttactggcgccacccgcggcgaacgaagagtattaccattcggcccgactcgaacttaagc

SEQ ID NO: 723483 - DNA, 241 bp, Homo sapiens
tttgaaattccctcccccccaggttagggggagggccccttttccccttccttttccctttgggagggttttacgggtccttcgaaatggtaaccggtttcagccctgagccttgggggggggggggggaacgccctccggccggttttgggggggaaacttttaaaaggttggggtattttttccattaggtttcttttcagaagggggtataggcccaaaaaaatttttttcttttgga

SEQ ID NO: 723484 - DNA, 170 bp, Homo sapiens
ctctaggatcgtatatggtgtgtgtgtaacttatagttagagctgatattatgaggagagggtcggtgatcggagatctattgtgcgggtttgattatatggcgtatagagtagtactgctgactgttgtgtgttatattgaatgaattgctcgggataggtatgtgata

SEQ ID NO: 723485 - DNA, 575 bp, Homo sapiens
ctgtgtcatcccccttcgtgtaaagtcttaacaaacagctcctaagtgggggaaagctgccactgagaggctgagtttccatcgctaatagtctgattaaaaggtattaaagactccacatctgtttcagagacagcccagagtggggcctcatccttgcttgctctgcagcaagtatggtgggtggaagtgggagaaatgccaccagttcctcccctctccctctgaggctgggcctccggttaactcgggagcagaagggcagttaggaggggaggcgggtggagcccctcccaatcagaaaaagagcttggacatggatggattcccaggaggtccccagggggaccagaccagtgtgactatgacaagtgccactatgtgccaggcgctctgctaggcactttacacagattattcccaggcttacaacactggcaaatgggtaaaaccatcccctattgtagctgcagaaactgaggctctgaaagatgaatcatcttgctgcccaaggctgcatggctgtttagtggccaagtcggaatttgaacccatgtacgtatatctcttatcct

SEQ ID NO: 723486 - DNA, 418 bp, Homo sapiens
  misc_feature (5)..(5): n is a, c, g, or t
  misc_feature (85)..(85): n is a, c, g, or t
  misc_feature (212)..(212): n is a, c, g, or t
  misc_feature (238)..(238): n is a, c, g, or t
ggtcntgtttatcataattccccaagggaaagtagactagtatagtaaattactagaggatctgttaggaggagaggtagaactngagtctttttagagtaagatagagaatgagaatgtagaggtactgtatatactctattttctcatttaaggtttgtgttaagaataacagtagaagaaggagaagaatttagtagatctttaactgntgtatgatgacatccaacaattacantggactttcaagtgagaaggatctgtttcggagaaaatagagattgggatagtattgcaaatagaactcgatccagagtagggctagcagaaaatacagtcactattgaaagcaatagtgggggcagggactgcttcagtttcgtcgacgcggccgcgaatttagtagtagtagtcgacc

SEQ ID NO: 723487 - DNA, 123 bp, Homo sapiens
tgctggtgttgctgacatgagccaccgcacctggtctgacacaccattcagttttaatgaactttcaggtgctgtggccacgcccctcttgtgtggcatgcaggttgtgagagatggcttgga

SEQ ID NO: 723488 - DNA, 831 bp, Homo sapiens
  misc_feature (831)..(831): n is a, c, g, or t
gaatctgcgaaagcaaatcagttgccggctaaccttgacctatgatggaaataattcagtggcatctcatgtagatgtaccatttcttatgcaactcagagtgcaatggtgatgaaagtcagttgggaaccagtctgtgggaccaatggatctaacttacctgtcaccttgtctagcaggatgcaaatcctcaggtggtataaaaagcatacagtgtttataccctgtagttgtgtggaagtaacctgtctccagaacagaatattactcagcgcactgtggttgaatgcccaagagataatacttgtacaaggaaattttccatctatgtggcaattcaagtcataaactcttgtgttctctgcaacaggaggtaccacatttatctgtgtgacctgtgaagatggtccaaacctgaattgaaagcactggcaatgggttcccagtcactgttataagacccctaggaggaattctagctccaatatatttgggggctcgatggactacacccttgtttgaaggtggtccacccaacagttgtgggagcacaagggaggctggtagggatatatttaattccggtcattttgcggacgggcctactgtgggctatatctaataagcttaaagattccccaggcactttgtgtacaataatggtaacattggcatttgacgaaaaaattttcagggacaggatacccagggcatcggccatggcaggaaagtcatggggtgaggcaccatcgagattcttacatagctgcgacactttgtgctcttggggcacaatgtaaccgtgttggggtcacaaacgctgtgccgcan

SEQ ID NO: 723489 - DNA, 191 bp, Homo sapiens
ccgacccttaaataacagcgatataaagacaagtttggtatgtgggaaggcttaaatctggagcttgtactaggttctgcttttaaggttttgaaggctgtttctgtccctggttcccattctactagatgaatatttgccctctgggtctccttgattagagtatggaggggcctggctatctcgctggt

SEQ ID NO: 723490 - DNA, 352 bp, Homo sapiens
ggtttctcggccagagtctgcaggacagacttggcagcaggtaccccctgtgaggaacactgaaatggatcacgacggaacccccgaaaacgaaggcgaagagactgcgcagtcagtaagtcattggtgcccgctcgggatttccaagttcaggggaattctcaagctagggtttcatcatgggacaacagctatccacacaacagaaacagtatataaaagtattgaaacaactgcttaaagctagcagagcctcggtttcgcaggctcaattaagggacccagtgcaaactgttgtttcccataacccatggtccccagaagaaggcacgctggacctagagctttggga

SEQ ID NO: 723491 - DNA, 547 bp, Homo sapiens
ctatcctaatttattttatatattaatctacaatctctaaataaaaataattactccctaatttatatcttaccccacccaaaaaaaatatacaattttaaccctaaaacacaccacactacctaaccatcctttatcgccacaccaccctccacaattcaacccccccacaataatcaacaactccctcccccacaaaaaaaccaaaaaaacgaccacatcaactatccacctaatcccacaaacaacttacaactctctcacaccaaaacaataaacctcttcaacaaaaaaaaaaaaaaatcccaaaacacccatccgccattaacataaccacattactccaaaaaatacctccccccccacaaataaaaatttctctaactcaccccccctaaaataaaaaaacataacacattaatcacatcacaaaacctattccatcctccccggaatcctactaaaaaacaaacatattacaattaccaaaccaaccaatcaaaacaaaactactataacccccaaaaaataccaccacaactccgct

SEQ ID NO: 723492 - DNA, 302 bp, Homo sapiens
tcgaccttttgtccaaagcgacgtacaagggagggaacagtcaagctacagagcaataaaaagcatggtgtaacaataagtactactttacatgagaattagaaaacaacaacctagaaaaaaggaaaaagaagtgcaggaatgtaactgccgaagtgcaagttaagcgctagtcaggtgccagttaggaagggaggtgctctctgaagagttgggtcttcaaaagcttcttgaaggtagagagggacgcccctgctctggtagtactaggcagttcgttccaccaacgtcgacgcggccgg

SEQ ID NO: 723493 - DNA, 409 bp, Homo sapiens
cgtcgactccttggtttatttttttgagggcttcaataacaagtcgaccttcaatgacgaaatccttcccttgctacaatgcttaagcctttttccagggttgtcagttctgcttcattgttactgcaatccacaacatataagatcttaaaattatgttgatagtcctggaaaaggctccataccttgcatccccatggtttcctttcgaggcaccatcaaatttaagtttcacaaaatccagaggaaggcctgagtattaagattgggatagactatgaagaaacatagttttccatgaggaaggggatgtcatttgaggggatagtttcaattgattaagaatttgagcctcctgaagagatgtgtcgacgcggccgcgaatttagtagtagtagtaggcggccgc

SEQ ID NO: 723494 - DNA, 444 bp, Homo sapiens
  misc_feature (93)..(93): n is a, c, g, or t
  misc_feature (133)..(133): n is a, c, g, or t
aataatttctttaaggaaaactataacccactgatgaaaagaaatttaaaaaaacataaccaacctagaaattacttcccagtgttccatggnttgggaagaatttacctttaagaatgaccattattacccnaaaccctacagttttcaatacaattgtccatttgaaattacagatttctcattttttttttacaaacacttataaaagaacaatcccataaaatttctttacgtgaatctcaaaacgtgccataaattagagaaaagccaactcttaagccaagaaagaacaaagccttagaggcattcaccaccacattaagttctcaaattttatttatagggtttatagttaccccaaaaagtgcttgattttgtgtttattaaaaacagacacattagattcacgcggaattattattagagaacccttagaaaaaa

SEQ ID NO: 723495 - DNA, 315 bp, Homo sapiens
atgctcccacgatcaaaagggacaagcatcaatgcacagcagccaatgcagctcaaaacgcttcgcctagccacaccccccacgggcaaaccagcagtgcattcaacctttcagcacatacacactgaaagtttcaactcacatgctcatactaacccccagggtatggtcacatttctgtgcccagcccaccgtggttccaacaacgattcacaccccacagtccactagcacagccagtgctgtcaaagcagtgttttcagctccaccccactcccgcaatcaacagctcaacaaactccacctgcaagttgg

SEQ ID NO: 723496 - DNA, 1426 bp, Homo sapiens
  misc_feature (1380)..(1380): n is a, c, g, or t
taagggcaacagaactctttatttaatggtgggtttaaaatgaggagtcaaaatcaagtcccgggctgtggtggaatacccaaaggagaacaaaaaagcgtgccagggcagcttcaaacaagctcgtgaggtggccgggcgtgggccaataaggaaagcagttacggggacagaaggcagcctcccttcccccgagggaagggcaagaggagcagggtgccgtgggcgtgtccctgggggtgtgaccaccttcgtggtgcgtggtgcaagggggaaaggctgtggggcagaagcgtggaaaactcagcctcagacaggcctgggcccttccccgcggggacaccagggcgaggcttccagcgtgggccctcgcgggttcgaggcccctcgagggggccacgcgggaagtgggggtgggagggaggggttaaattaaccattctttatacagaacaattaacgaggtctccttaacagaaaaggtgcgcgtggagcctcaaggcccagggctcgcgaaataaccttcatgtgggaaacacacaaccaacaaaatataaacaaaacaagaggtgcgtgggtgaccaccttctctcaagacaactcggggggggaccatggcaaagcgctcctcacgcgtggggacaaaggggcgcctgtgagaacacaattttctcacaatatatacgagaaagaagccaatggtggcgctcatcttagggagggatatcacccacttggcgtgtgggggggtcccccctggggcgcgggagacaaaacgcgcataggcacactcataaaggaaaaacccaaacacacaaagtatctctggggggcgtccacttaacacaactcggcgaacgtgttccaccccactggctgctttgggggagcaccccccaaaccccccacggtgcgacacggggaaaagaacacactggggggccttctaacaatctcaatttgtggtggactagggggagacccacttccaccccgactggagatattttggaggagcccaagggaacgaccctggaggggccacaacactcttcggctgcaaacagccaaacaaaattcaaaacgaggacgaactggtgcgtaaagtgaaaatagagcaggacatagataataagggtgcccacaaaggacagacgtcacaagagacatactcgtgggcgtgcggtagggacccctatatttttggcgaaagatagcgaggcacagaaaaaggtgcgtacaaacaattgtgtagtagaacaactgctggtcgtaggaaacgaaggggatggcgctactcgattagggttacggacaccaactatctctgaactttaggagagaaaaccccatatggtgggaggactactagtactttantaggagggatagctataaaaaaacacaaacattggtggtatacaag

SEQ ID NO: 723497 - DNA, 319 bp, Homo sapiens
ccagtttacttaatattttctccattttctcatttgtgaattggggatatgatagtacttaaaacatcattgtgaagacaatagaatatttcatgtaagtgtgcataacttacaccgtttctggcatatttagtactccctaaagcttgtgtattctgttacttatcatatgttttgtggtctcttctctgcagccttggttttgtcatccacaatataagtacaataacatctatctcaacagctgtttattagaagtaggacagactgtgctgttcacgcatttagccctgccctaacttagtctcttgggggatcc

SEQ ID NO: 723498 - DNA, 180 bp, Homo sapiens
  misc_feature (150)..(150): n is a, c, g, or t
tccttcatcatacctaccaatgcatagtgtctctgtgcctcagtttcttcacctataaatggggatatgcctttagacaggtgagatgagggttaagggtacagtgcgcacagggaactatccttaatatcctgtaataatccgccatgnaaaggaatgtggtaggtatgatgaaggacg

SEQ ID NO: 723499 - DNA, 681 bp, Homo sapiens
ctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgctttaggctctgctagatggctaggactttaacaaatatgaaagaacgagctgagtctttaagacagagggaatatcagagacatgaaaatatctagagagatcgggagtggtaggctgagtctggaggtgagatatctggattcaatcacacgagttttcctatgccttcctgtaatgttggaggcttcatttattttcgtcaatcttggagctgtcatgggctttgtggcttgtggcgattattctgtgttctctgcgactcgtgtctactgtcccagctgtatgacgccgtattcatactttt

SEQ ID NO: 723500 - DNA, 942 bp, Homo sapiens
gatcagcatggcctatcatatagtagaaccagcccatgacccctaacaggggccctctcaggcctcctaatgacctccggcctagccatgtgatgtcacttccacctccataacgctcctcatactaggcctactaaccaacacactaaccatataccaatgatggcgcgagtgtagcacgagaaagcacataccaaggtcaccacacaccagcctgtccaagaaaggtcttcgagtgcgggatgatccctattgtattgaacctcagaagtttgttgtgtctgtgcgcaggattgtgttctgacgtcgcttttcaccagctctcgaggcctagtcccgcgtactcgccccacttgaggagggcgactggtcccccgccgaagaggcatcagcccggctgagaaattgccctagaagtcccactccgtaacagcacagtccggattactcgcatcaggagtatcaatgcagctgagctcaccatagtctaagtagaataacataccgaaacctagaatagattcaagcagcctgcttattacaactgtctactgggtcgtctattttaccctcctacaagcctcaggagtacttcgagtctcccttcagcagtttccgagggcagtctacggttcaacaattttttgtagcgcacaaggcgttccacggactgccacgttcattatgtggctcaagcttgcctcacatatctgacttcatccgccaactaatattttcactttacatcccaaaattcactttggcttcgaaagccgccgcctgaatactggcatttgtagatggtggttgactattcctgcatgtctccaccaatgatgagggctttacaacacacaatgcatcaccacagcactccaacccaataccataaccacaccacagcccattgggacaaaacaaaacaataacgcaacacccaca

SEQ ID NO: 723501 - DNA, 789 bp, Homo sapiens
ggagagcaaggacgcgggggagcagagatgatccgagccggcgccggccgccggctgtccccggatacgttcaactaaacctagaggaccggtggggtggtggatagtactaagagagagaaagcaacaggaatcgaatcaatgattttttcgaagggtacatagataatgaacgtggaaaagaaagacaaagaacaagcaagagaagagagaaggaccaaaagtaaaagaaggaggccgagacacgcgcggggaaagaagcggacacacagaaggagacaccatagagacaaggacgaacaacaagattgcatacgacagcaacgaaacagaagagaaggacgaagcaagaggaccaacaacaaaaaaaagagagaaagagatgaagaatggagagacagacaaacgacagcggaacgcaacaagacagacagacaccggacagcaggagagataacataatagaggagaacaaccagaagcgaggaaaacaacagacaaaagccaagcggcaaaaaagagaacaacgatgaaaccacacacgagaaaaagcaggcggcgaaacaagaccaagcgcgacgacaaggaacaaaccccgcacgaaagaccaaaaccaatggacgagagacacacaaaagaagaacaagaagaaacaacaaggagaaggaacgaagacaagaggacgacacaacacacacgacacaaacactaaaaacagatcaagactgagtgagaagaaagacaaaacaacaagcaacaaaagaaacgcacacacaaccaagcaccaca

SEQ ID NO: 723502 - DNA, 128 bp, Homo sapiens
  misc_feature (63)..(63): n is a, c, g, or t
ggctctgaattcaaagctttctaacgatagtacggggacaatgactgtcacgccactctacancacctgctcaagtgattcaacacgcccccacaatgtcagtggtgtttctcgctactttggaaaga

SEQ ID NO: 723503 - DNA, 444 bp, Homo sapiens
tgcaggattcgggacgagcactgaacgagtaccaaggagatgcgccctatgtgccatgcggacattgtggcccagctgtccagtggttgacaccatggctcagaactgtcgacctccgtctcattcccatccttcctgctgctggagtcaaccaccgatggaacgactgacctgcgcagattggtaagcattgaactgacagagatgctgatgctatggaggccaacgaagagctagacctacagctgatgccatcaggagcactgtgacctaggatataggctactgtctctagacgctgcagccattctgatgcactcactgtatgtattcagagtatccttgtatcgcataactgcggacatatgtatgtgctcgcgaccatatagtagcatgcgaggataggtgcactagcatgaataacagtgggccttagagcttttc

SEQ ID NO: 723504 - DNA, 153 bp, Homo sapiens
aggaatgggcctggcgcgtaccgttcctgatcgccgcgcccctgggctttatttccatgtacatccgcctcaagctcgaagacagccccgagttcctcgccctgcaacgcgccgggcaaacttcgcgggcgccgctgcgcgaggtctggcagt

SEQ ID NO: 723505 - DNA, 468 bp, Homo sapiens
cacgaggaacgttggccgtccggcatctcctgccggcagacgagcacgtcgaaatcggcgccgaattccatcagccgcccgagaaagtcaggcggcatcacatatcgatcgtgcgcgatcacaaccagggggcacgacgtgctcgcaacgagctggttcttcttgcgggtgacccagccttgttgcgaaaactctttcgactgtacgatcagcctggtgccatcgccgcgggcctcgaccgttgtccggagactctcgggaccgcagaccagtgtttcgcagcgcagcccgtcgggccacctcaacgcccggacgctgtcgaggaatgcgtgcagtcgcgtcgtgtcctggccgtcgtttatgacgccgaaggccacgccatcgatcgtcgccgggcgttgcgcctccggcagcaggcggaaccccgccaggatggagccattctgaggatagaaattctccagttcg

SEQ ID NO: 723506 - DNA, 310 bp, Homo sapiens
tcgacggacacataagtaatcatgacacagaggctgggtgtggtggctcatgcctgcaattccagcacttcaggaggccaaggtggaggaatcacttgaggccaagagttcaagaccagcctggccaacttggcgaaaccctgtctctactaaaaacacaaaaattagctgggtgtggtggttcatgcttgtagtcccagctactcgggaggctggggcaggtgaatcgcttgaacccgggaggcagaagttgcagtgagtcaaaatcctgccactgtactccagcctgtacaatagtgagaacccgtct

SEQ ID NO: 723507 - DNA, 586 bp, Homo sapiens
taattcccagggtgtgccatatttaattggctaggggcacagacccaaaaccggctatgcggaacaaggtctgatcagcaactgggggaaatagacaaaaaatatgcgggattcattcataccagccacgtgctttcatatgaatgaactccaggggctggtatgaagatgtcttaccaggtacaacaggcaactcaacacatgcctaaaagactccgtgtaaggggtttcagacaagacgagtcctctagcgcttgggtgttcacacctttactccagtgatccggggaaaccgccaacacagacgagcctttcttatttcttatactcaacctcttgtgatgacacagcaaaaacagacgtgactatgctctgggtatatagcagacaatctagccggttttccataccagacacgggaagagccgtggttaataaggcatcatttagacattacaactctcagaccgggtagtaaccaacggcagccactccaagggagtcaagggcaagggccaaagggaacgagagaaaatcatcacctagtagggaaaacgagtcaagcgaaagtgacacagaagtttcc

SEQ ID NO: 723508 - DNA, 2529 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagaccatatgctactatacagtggttctagataaagtgtttctggacatagggaggcggggcccgggcgcaataccgcctatagtgagtggtatttcaactcacttgccaatgctctcaacgatgtgactggcgtcttgttaccaatagacaggactgtgcccttgccactactggcaaccgattgggatgggaatagagct

SEQ ID NO: 723509 - DNA, 1415 bp, Homo sapiens
  misc_feature (39)..(39): n is a, c, g, or t
gctgcttcctgttactgaggccagggagttaaccagcanggacctcgccgtctgttgagcggctctgcctctgtggtgggcgtgctaagccctgtgtccccttaggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 723510 - DNA, 1489 bp, Homo sapiens
  misc_feature (39)..(39): n is a, c, g, or t
  misc_feature (324)..(324): n is a, c, g, or t
gctgcttcctgttactgaggccagggagttaaccagcanggacctcgccgtctgttgagcggctctgcctctgtggtgggcgtgctaagccctgtgtccccttaggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccaggtgcgtggtggctcgaggcgggggtgggggcctcgccctgcntgggccctccctgacctctccgctccgcacagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 723511 - DNA, 2284 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 723512 - DNA, 2235 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagcccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 723513 - DNA, 755 bp, Homo sapiens
agcggggcggggaccgtggcgctggccggagcaaggagctgcgcaacgcatcgggtcccggtgccctccccgacatgaaaggctccgcagtcagcgtacgtgagccccgatggggggaccgatgctccctctttctctagccctgaggtggccgggatggccgacgcgtgatctagagaatggctcctggcgcggacccgagaaggcgctactaacttccgactacacgtgactccggagaagataggaaacctgtagactagaactcgagcagtactcggcagacgtctcggggacccgtctgggtacgttgtgacatgagatactaatagatcaacatggggcggtaccactgtgtcgagtgtagcaaggaggcctagataacaagcaggctcgaaaagtccctagtagacccttagtcgagtcgcgctgctctaacggacttggcgagagctcgtcgggatcgtactagcgacttgcattacctgaataagagttcaagtcagtcgtgagcgtattggggccagctacttgttgtaaccatcgtgacaaggaagatgtgacgccactgtaagaagactcgcgggcgaaaacgtattatctatgagaggcttctgacgcaaggggacactactggagtggatagacctggttggactgaacacccgtaaggatacttcctacattgatcgaacgacgtagtttatgacctgggagaagggatatgcgacgagttctgcgctggctggaataat

SEQ ID NO: 723514 - DNA, 2387 bp, Homo sapiens
  misc_feature (9)..(10): n is a, c, g, or t
  misc_feature (1883)..(1883): n is a, c, g, or t
  misc_feature (1895)..(1895): n is a, c, g, or t
  misc_feature (1914)..(1914): n is a, c, g, or t
  misc_feature (1924)..(1925): n is a, c, g, or t
  misc_feature (1937)..(1938): n is a, c, g, or t
  misc_feature (1941)..(1941): n is a, c, g, or t
  misc_feature (1946)..(1946): n is a, c, g, or t
  misc_feature (1951)..(1951): n is a, c, g, or t
  misc_feature (1953)..(1956): n is a, c, g, or t
  misc_feature (1959)..(1959): n is a, c, g, or t
  misc_feature (1966)..(1966): n is a, c, g, or t
  misc_feature (1968)..(1968): n is a, c, g, or t
  misc_feature (1983)..(1984): n is a, c, g, or t
  misc_feature (1986)..(1986): n is a, c, g, or t
  misc_feature (2005)..(2005): n is a, c, g, or t
  misc_feature (2036)..(2036): n is a, c, g, or t
  misc_feature (2041)..(2041): n is a, c, g, or t
  misc_feature (2057)..(2057): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaaccccccnatcaatggtccnacccccaaaaacccccccnccccaccccnnccaaaaaacacnnaanaaaancgttnannnnatnccccccnancaatctccccccccnnancccccccgcacaccgcccnccccccccagccccccccccccccccacccnccccncccccccacccccccncccccccccccccccccgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 723515 - DNA, 2090 bp, Homo sapiens
  misc_feature (9)..(10): n is a, c, g, or t
  misc_feature (2016)..(2016): n is a, c, g, or t
  misc_feature (2037)..(2037): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcagggggnaggggtttttttttttttttntttttttttttttttttttttttcctttttttcctttttttcctctttgtttg

SEQ ID NO: 723516 - DNA, 412 bp, Homo sapiens
ttcttgactgcacactgagactttacagacgggtatgttccactccgctttatctcccacctatacctcccaataatgtctcccggcgatgaagcatggagagcccaagacacagggaaacagattgaacctctcggggttgtcaggcagctactgttggagagaactgtaccgcacttgccgcagattatcagagaggatcaggctggagtaggccgtgtctgggtccggagtcacgtccactgagtataactgagcctctcttaattcttggatcttctccatatctgactgcattttatctgtgaaactgctttagactctccgtcaagaatagacatttttgggcaaaaatgtggaatagctcttgcaaatctggaggtgtgatccatggttcaggaatcctgaatct

SEQ ID NO: 723517 - DNA, 1812 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagcctgcctggtccatgggatcctctagat

SEQ ID NO: 723518 - DNA, 303 bp, Homo sapiens
agggctcgcgatagcaggctcttgagcggcccattatgagaaggggggcaaagaagggggaacatgcctgtcacttgcagaggtgacggggtggaaggagcagacagcagtattttgcagggagcctgcgttgggatgtcaacgaaacacggtggccagacgagaatattatgaacgcttggaccggtagaattgaaggcgttaaagtgcatgggttaggtgggaaaccaggtcgttctgtgtgcgggcgtgtggatggaccgaccgatgagggcagaataagcgatggtgggcaccgtcttt

SEQ ID NO: 723519 - DNA, 1761 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcgacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 723520 - DNA, 271 bp, Homo sapiens
cacatttcccccattttattcattaatgttgccaaatggtttagggggccatggggggaaaaaagggtaggagtttcccccccatccccgtccccaggtcaggacatgctgggggcccctggagggaccctgggcccccgccccagggcaaaaaacgttttccagctgctgccccctggcttccgctgtttctcccctttttcccctttcctcctgcggttggggggaaaaacaggaggccgtttgaggaaccaggcctccacctgcccct

SEQ ID NO: 723521 - DNA, 268 bp, Homo sapiens
  misc_feature (26)..(26): n is a, c, g, or t
  misc_feature (194)..(195): n is a, c, g, or t
ggtctagaggatccctagcagtagtnggggatctcatctgtactatagagtcgtgcatccccatccatgctactactcccgttctgttcagtttagacatgaagcgcatcactcgcatgtacatgagggataaaatgaggagaaggaggttgggatggtgtctaggcagagtgacatcggcaacaagaatgatnnggggaggacacactccatccagtcagttccttccatgctgatcttagatggatgaggagaaacgtcgaatcga

SEQ ID NO: 723522 - DNA, 1939 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 723523 - DNA, 193 bp, Homo sapiens
tactagaggatcccccccttccccccacagtgagaatccatctccaaaaaaaaaaaaaaaccccaaaagtgtgggaaacaataccagttgtgtccttatgatgagtttatttttaactcttctcacatttggatttaacggaattgcaggacaattgggaccattaaacccccttcatgtgtgtgggtgagaa

SEQ ID NO: 723524 - DNA, 772 bp, Homo sapiens
ggtcccttccaggcagttaatgcgctcctgaaacaccttgtttctgcagcttgatccttcccggtacttctcctcctcggggtccacgcgatggatgactagtgccaggtaccttgagcaaatggatgtcacacacgccagcattcacccggtcctggtcatattgattgaaagctgtagatcttcatgatggaggcggccactgggtcggtggagaagtgcaagagaatggcctccgttgatcgcaggcgtcccgcatggtccatgtcctccagggtcggccccagtgagcaggacaggtgaagtacactgccaggcactacgccaggtgggcagagccttcctctctgggctcagataccacgttggtccctggggcctcggggctcccgctgacggtggcgttcggcttgaagttccatttctcacctggtttcggatggtgtcctgcgatgtggggccccaggcccgggactgcttctgctccagccgggctagggcggcagcggctgccatctgtgcctcattggtgggtccctgacggggcggcctgggggctggctggttgggcttctctttgtgggccttttcccccacggactctttgagcttctgaccgggtcccgcgcttttgaacttgatgtcggccttgaactcctgaaagaatttcttcatggtggcggctggcccggcggcggggggccgcgggggcgggggggcacggggcccagtcggggacggggccgccggagaccagccaccggaagaaaat

SEQ ID NO: 723525 - DNA, 1579 bp, Homo sapiens
  misc_feature (23)..(23): n is a, c, g, or t
  misc_feature (35)..(35): n is a, c, g, or t
  misc_feature (171)..(171): n is a, c, g, or t
  misc_feature (185)..(185): n is a, c, g, or t
  misc_feature (272)..(272): n is a, c, g, or t
  misc_feature (278)..(278): n is a, c, g, or t
  misc_feature (351)..(351): n is a, c, g, or t
  misc_feature (355)..(355): n is a, c, g, or t
  misc_feature (368)..(368): n is a, c, g, or t
  misc_feature (374)..(374): n is a, c, g, or t
  misc_feature (611)..(611): n is a, c, g, or t
gggcgagtaagatggaagatgangaggtcgctganagctgggaagaggcggcagacagcggggaaatagacagacggttggaaaaaaaactgaagatcacacaaaaagagaggaaatccaaatctcctcccaaagtgcccattgtgattcaggacgatagccttcccgcgnggccccctccacanatccgcatctcaagaggcccaccagcaacggtgtggtcagcagccccaactccaccagcaggcccacccttccagtcaagtccctancacagngagaggccgagtacgccgaggcccggaagcggatcctgggcagcgccagccccgaggaggagcaggagaaacncatnctcgacaggccanccaggntctcccaacccgaagacagcaggcagcccaataatgtgatcagacagcctttgggtcctgatgggtctcaaggcttcaaacagcgcagataaatgcaggcaacgaaaagatgccgccgttgctgccgtcaccgcctcctgggtcgtccgccacgggttgcactgccgtggcagacagctggacttgagcagagggaacgacctgacttacttgcactggtgatcccccttgctccgncccactgtgaccttgaaccccatgcactgtgaacctcccccttctcccccttcccactgtgattggacatcggacaagggctgtccaagtcaatggaaagggaagggtgggggtcagcgcggacacggttggcgcgggaccccagccaacggcactcagcagagctcagcacagctgccacctcggcccactcggggctaaagccagtgccacgcaactaacacgctttatcactgctcacttaactccgggactttcacaaacacaaatgaaaactcacacccacccacccccaagctgcactgtctccatcacttaacaagtaacgttccactctcgaacaatatcctttcttctcaacccttccatatccacgccgcgcccactacccacctatctgcactggccaacgcaaacccgccgccctggccagcgcggccaacacggcccacccgcacctcccccactcccaccaaaggcgcagtcgcgcaccccaacctccaacacactgctcaccctgcagaaacatcaccctacgacaaccccttacacccaaccacggcacacggccacacctaacccaccccggatatcccctacacgccggccccacacaaccgcgcacacggcccctgcaacccccacaggaaccaaccaacaccccagcgcaactacccctccgccccgcgcgaccataacacacccccggccaatatggcccctgccccggcgaaaccggggcacaacctcagaacggcccggacaaaacctggaggacggcgctcacacccccaccccgagccacttgggggcactactacgcagcgccaaccggaggccctccaacaccacccaccgggcccccaccaccccgcaccacacccccccccaacccacccccgacctacagcacaaccacccccccgcacacaccggcgcaacacaccccaccagcaccccccgcaccg

SEQ ID NO: 723526 - DNA, 268 bp, Homo sapiens
  misc_feature (55)..(55): n is a, c, g, or t
  misc_feature (72)..(72): n is a, c, g, or t
cgatctccgaagccgcccaaggccccagatctctctccccggcggtccccgcccngcagggcctcaagcccntgggttcctcacgcaccccacggactctttgagcttctgaccgggtcccgcgcttttgaacttgatgtcggccttgaactcctgaaagaatttcttcatggtggcggctggcccggcggcggggggccgcgggggcgggggggcacggggcccagtcggggacggggccgccggagaccagccaccggaagaaaat

SEQ ID NO: 723527 - DNA, 1524 bp, Homo sapiens
  misc_feature (23)..(23): n is a, c, g, or t
  misc_feature (35)..(35): n is a, c, g, or t
  misc_feature (116)..(116): n is a, c, g, or t
  misc_feature (130)..(130): n is a, c, g, or t
  misc_feature (217)..(217): n is a, c, g, or t
  misc_feature (223)..(223): n is a, c, g, or t
  misc_feature (296)..(296): n is a, c, g, or t
  misc_feature (300)..(300): n is a, c, g, or t
  misc_feature (313)..(313): n is a, c, g, or t
  misc_feature (319)..(319): n is a, c, g, or t
  misc_feature (556)..(556): n is a, c, g, or t
gggcgagtaagatggaagatgangaggtcgctganagctgggaagaggcggcagacagcggggaaattctcctcccaaagtgcccattgtgattcaggacgatagccttcccgcgnggccccctccacanatccgcatctcaagaggcccaccagcaacggtgtggtcagcagccccaactccaccagcaggcccacccttccagtcaagtccctancacagngagaggccgagtacgccgaggcccggaagcggatcctgggcagcgccagccccgaggaggagcaggagaaacncatnctcgacaggccanccaggntctcccaacccgaagacagcaggcagcccaataatgtgatcagacagcctttgggtcctgatgggtctcaaggcttcaaacagcgcagataaatgcaggcaacgaaaagatgccgccgttgctgccgtcaccgcctcctgggtcgtccgccacgggttgcactgccgtggcagacagctggacttgagcagagggaacgacctgacttacttgcactggtgatcccccttgctccgncccactgtgaccttgaaccccatgcactgtgaacctcccccttctcccccttcccactgtgattggacatcggacaagggctgtccaagtcaatggaaagggaagggtgggggtcagcgcggacacggttggcgcgggaccccagccaacggcactcagcagagctcagcacagctgccacctcggcccactcggggctaaagccagtgccacgcaactaacacgctttatcactgctcacttaactccgggactttcacaaacacaaatgaaaactcacacccacccacccccaagctgcactgtctccatcacttaacaagtaacgttccactctcgaacaatatcctttcttctcaacccttccatatccacgccgcgcccactacccacctatctgcactggccaacgcaaacccgccgccctggccagcgcggccaacacggcccacccgcacctcccccactcccaccaaaggcgcagtcgcgcaccccaacctccaacacactgctcaccctgcagaaacatcaccctacgacaaccccttacacccaaccacggcacacggccacacctaacccaccccggatatcccctacacgccggccccacacaaccgcgcacacggcccctgcaacccccacaggaaccaaccaacaccccagcgcaactacccctccgccccgcgcgaccataacacacccccggccaatatggcccctgccccggcgaaaccggggcacaacctcagaacggcccggacaaaacctggaggacggcgctcacacccccaccccgagccacttgggggcactactacgcagcgccaaccggaggccctccaacaccacccaccgggcccccaccaccccgcaccacacccccccccaacccacccccgacctacagcacaaccacccccccgcacacaccggcgcaacacaccccaccagcaccccccgcaccg

SEQ ID NO: 723528 - DNA, 1115 bp, Homo sapiens
  misc_feature (586)..(587): n is a, c, g, or t
tgatacgtctgttgcgcctcttacacctcttgttgttccattggtctgttaagccttgcggagacctatgtgtgtctcctatcgtttgacctctgaaatttcttccaattgctggagcccttccttatggctccagtgctagacctccttattgtaagcaagatctgaagtgtgagttaaaagctacattgagagttgttgcttgaaccattataagaattgcatgcaaaagacatagagaacagccatgaaaaagtgaggaatcaccccaatgtgggctctttttctttctttaggctctgttgctgtccaatagagagcatctaatatgtcttgtccaaaagatgaaaacagacgatcagctacctccagcatgttgtagatgatgtagagcttgatgacggactgcccccttatcaggtggtacatcatggagtagtcaacatagtgcatcataaaatagcagattaccaaaatgacacccttcaaaatgtcacacacctgggcaggctgaagcaaacgtctgtcccacaaggagtccctgtgccaccacattccattctataaaggaagtgaaagtgctccnnccttcggtcttaagccatagcaaggcaaagtgaggagcctgaatagtgccaggaaaactcttaaaggaagcagggtgaacacatacaaaaacgcatccaggcacagaaagattccaaaaaccatcagcttttccaattctcttggtattcgcaaacaagtgtatactctttctcttctttctgtatacttggcctcattatgttcaaggaagtaccctcttgttagttcagcactgaggaacctcaacaatgaaagctctgtgcggccccggcgcctctcccgccgccggtcgctctcgtagaagcccagcgtctctgtgagctgaggcgccggcgggggcccctgtccgccgctgccgcccggctgctccgcctcgccgcggccgtcccgctgcgggccgtccacgccgccaccgccgccttctcccggagcggccgcgtcgccgacgcccgccatgttccgagcacaacaaactgtccccgccgcctccctccagcctctgcctccgccggccccctccccccgct

SEQ ID NO: 723529 - DNA, 1434 bp, Homo sapiens
ccccgagatggagtctcgctgtgttacccaggctgggtgcagtgggacgatttcagctcactacaacctccacctccagggttcatgtgattctcctacctcagcctcccaagtagctgggattacaggcacgcgccaccaggcacggctaatttttgtatttttagtagagacggggtttcaccatgttggccagtctggtcttggactcctgacctcaggtcatccgccctgcctcagcctccccaagtgctgggattacaggtgtgagccacgtgccggcctgcaatttgaatttcaaagtttattatataacttagggtagcttactatttaaaaaacttgtgaatatctggcttataaagcgaagcatttttttgtaaagtgaatgtatatcagccaacttatttttatataaatgcagattttcatatgctgaatgctttgaagtgagacatattgtactaaaaacattacttacaaaaattgggaacttatatttatttaccctatgtaaagatctgaatttaaatgtgcacttaaaatgtgtatttcttacagcaaacatatacataatcataacatttacttcataatttaaagttctagcatgggtttctaaatgaagttgtgaaactaatttccctagcacttgacaattttggatactcaagggggtactggttctaaaatgtctgggcagcaagaatcttcccagcctacatgaggacatgccatgcctgcaggcttgacccagaggtgtgtcccagaccagcagcatgagccccaccgccctggaaatgcagattctccagacccagcctagatctcctaaatcagaatccatgtttaagaagagcccccaagtgatgacagcacagtaaaggccagaagcaccataactagagtcggtagagcattcttgactctcaggtaccttcagaactgaagacttgaagctgagtgccctgccaggcctgtgcggggtaagcaaggcccttacctccagcatgttgtagatgatgtagagcttgatgacggactgcccccttatcaggtggtacatcatggagtagtcaacatagtgcatcataaaatagcagattaccaaaatgacacccttcaaaatgtcacacacctgggcaggctgaagcaaacgtctgtccgtgcggccccggcgcctctcccgccgccggtcgctctcgtagaagcccagcgtctctgtgagctgaggcgccggcgggggcccctgtccgccgctgccgcccggctgctccgcctcgccgcggccgtcccgctgcgggccgtccacgccgccaccgccgccttctcccggagcggccgcgtcgccgacgcccgccatgttccgagcacaacaaactgtccccgccgcctccctccagcctctgcctccgccggccccctccccccgct

SEQ ID NO: 723530 - DNA, 100 bp, Homo sapiens
tttcaatcacggtcaaggcatccagtctttcatggagggcaaactaagggtgtaaattaggatcctcactgaactggcgggaccctaagaggctttgctt

SEQ ID NO: 723531 - DNA, 1049 bp, Homo sapiens
tgatacgtctgttgcgcctcttacacctcttgttgttccattggtctgttaagccttgcggagacctatgtgtgtctcctatcgtttgacctctgaaatttcttccaattgctggagcccttccttatggctccagtgctagacctccttattgtaagcaagatctgaagtgtgagttaaaagctacattgagagttgttgcttgaaccattataagaattgcatgcaaaagacatagagaacagccatgaaaaagtgaggaatcaccccaatgtgggctctttttctttctttaggctctgttgctgtccaatagagagcatctaatatgtcttgtccaaaagatgaaaacagacgatcagctacctccagcatgttgtagatgatgtagagcttgatgacggactgcccccttatcaggtggtacatcatggagtagtcaacatagtgcatcataaaatagcagattaccaaaatgacacccttcaaaatgtcacacacctgggcaggctgaagcaaacgtctgtcccttaagccatagcaaggcaaagtgaggagcctgaatagtgccaggaaaactcttaaaggaagcagggtgaacacatacaaaaacgcatccaggcacagaaagattccaaaaaccatcagcttttccaattctcttggtattcgcaaacaagtgtatactctttctcttctttctgtatacttggcctcattatgttcaaggaagtaccctcttgttagttcagcactgaggaacctcaacaatgaaagctctgtgcggccccggcgcctctcccgccgccggtcgctctcgtagaagcccagcgtctctgtgagctgaggcgccggcgggggcccctgtccgccgctgccgcccggctgctccgcctcgccgcggccgtcccgctgcgggccgtccacgccgccaccgccgccttctcccggagcggccgcgtcgccgacgcccgccatgttccgagcacaacaaactgtccccgccgcctccctccagcctctgcctccgccggccccctccccccgct

SEQ ID NO: 723532 - DNA, 939 bp, Homo sapiens
  misc_feature (267)..(267): n is a, c, g, or t
  misc_feature (289)..(289): n is a, c, g, or t
  misc_feature (291)..(291): n is a, c, g, or t
  misc_feature (305)..(305): n is a, c, g, or t
  misc_feature (924)..(924): n is a, c, g, or t
  misc_feature (928)..(928): n is a, c, g, or t
aagtatggttgagaatttttaagtggttaattgaaaaagaccaaacaagaccgtctgtaattttccaaaaatatagactgcttcaaatagaacctacgtccagttctgggaatcagcaaatcaattagaatcgcatctgatcaactttatgccccttaagtagttttaaaatttcagtactcaagtacaatcaatgatgtaatcagcctcacaacttagttatttgcatgaacttcaggaaataacggctaacacagcccttttggncaacagaagtaattttttagtngnaagaaatttaatgnagttatggttcagttgctgtttacagcttgagaattaaaacgttgggttcactctatattcaagaagacatccatctcaaaaccttttttcatttaaaactaatctgtaactgcaatatgaatacaaatgcaagttttaaaaattcttttaaaatgagaataaaaacctacagcttatagaaactgtaacattgtaacaatacgtttaaaactggtcattgaatgtaggattcataagtacacattttctcatctagtaatttttttggcataagtttcagttcaggaaaagttcagatgcaacattttatggagtgttaaatatttctgtactgggcaaaactactgaacttcatggtcactaccacaccgtcagctgtctgtgaaaaatctacttgcagggcaagttaacaggtttctatggctcaagtttgcttaaaatacagaacaaaaaaagtcaccttggcatgaatataattaagaaatcagccgtgtgcttctcacgtttgggctccgagacgtgggagatgcccgctaacctaagaccttccgagggcgatgcaaggacccggacagaactttcccggccgcagaccccttctagggcacacctggcctncgcngccgcaagctt

SEQ ID NO: 723533 - DNA, 1649 bp, Homo sapiens
  misc_feature (1067)..(1067): n is a, c, g, or t
  misc_feature (1101)..(1101): n is a, c, g, or t
  misc_feature (1109)..(1109): n is a, c, g, or t
  misc_feature (1169)..(1169): n is a, c, g, or t
  misc_feature (1183)..(1183): n is a, c, g, or t
  misc_feature (1375)..(1375): n is a, c, g, or t
ttcgtgtgtgggttggctcgtcccgaccagagcccaccccactggtgggtgttgtcgagtaggctgctccattatatttccccgcgggggttggaagaagatgtggtgtttaactacaagcgacgagaacagacgttccccacacggttgttgtccctcggggaaagaagtggtgtcccctctccccccctcgaatggtgtgtgactcgcaaagatggctcctgtttttttggtgcttgtgggtggggtgtctccccccttgtgggagcgttgtgcttctgtttggcccacaacaggttgctactataagtgtgtacaacgccaccacacggcgcgtcttttggtggtgtgaaaaagggtggggttactcatcggggcctgtattaccccaccgtggtgccccgcagcgccccagaagtgtggttcacacctgttggtgccacaactctcaacacttggtagcaccggggacctccacggaagatgtccttctgttctttgggggagaaacaccacgaggagaaatttggtgtgtggtctaagcacacaaaaacggggtgaatatttcccccgcctcccctcctccgcaccacaactgttgagaacacggcgtctttgtggtgctcctctggttcgtgggataatatatctctccgctggttttccgcgggagtatttcttcccccctggggcccccccacaacaacaaccccaccggggggcgcttatatgtgaaacagccacaccagcggtgatagcaacacggggtaatgccccccaccatcgtagaagagcgctcggggagaaaattatggggggctcctcacagcttattagtgtgcgttgagaggggtttgtgcggtgcgcggttttttgtttgccccacacacggtgttctgcggcgtttctcgtgagcacccctctgctgcagtagggtgctctgctcccacactctctacacacacacaacggtttgttgtgtagagagtcctgcgtggggcgcgcgtgggcgcggtctttaaaagctgtagagagatttgtcgctgagagagaccacaacagagacncccacggtatattttctctctcaccacactgggnctctatanttagagaaagagacacaacacaggtgtgcgctgtgtgatatctactatatagtcgcgggngtgtatataagggnagatatatattctcttagagatatacacactgtggagactccccagaccacagagagttcacacacaagagtgtgtgtgagagaagtatcgtctgtgtctctgtgtgtctctctcaaagtgtctgcgtctcagacgccagaccacccgacagaccctttgtgtgtgtgcgccacactactacacagagggcntgtgagtgtggaaagagatattcccaggacaccaataccagagatagccaaagagctgtgaaagagagagatatgtacaccaaatatttcttgggctgggatattggaagacttaaacatcctcgtgggatatccacacataccaaataacccagttccaattgttgtccttgtttttgataaattagattcccaattgtaaaagggttacatttcataactcccttaagtaccagaaatccaccatgaaaaataaaggttcccataaagccgt

SEQ ID NO: 723534 - DNA, 441 bp, Homo sapiens
tcagctcggtccctcttatgcaagtgtcaatataatgcagtccagtatcactggacttaggacttcaacaggacatttctggaaaacaacaaaggcacctgacaaaatatgagcagagaacacaggataagaaagtatgagagccccagatagattattctttcttgaggtttggaggtataccaagaggagatgagcatatgattcaaaggaagaacagattacagacaagctttgcttaaaatagggtaatttgatatgtttctaagttgtgagaagatgctagtaactgatttttaaccactgacacatgttccatagtcaagataattccaaagcaatcttaaagtttacgccatttgaactttcaccttgggaatatggtgcttgaggtggcaatgtataacaaatatttgctagaaaaggaagtccttagaagtc

SEQ ID NO: 723535 - DNA, 959 bp, Homo sapiens
tgatacgtctgttgcgcctcttacacctcttgttgttccattggtctgttaagccttgcggagacctatgtgtgtctcctatcgtttgacctctgaaatttcttccaattgctggagcccttccttatggctccagtgctagacctccttattgtaagcaagatctgaagtgtgagttaaaagctacattgagagttgttgcttgaaccattataagaattgcatgcaaaagacatagagaacagccatgaaaaagtgaggaatcaccccaatgtgggctctttttctttctttaggctctgttgctgtccaatagagagcatctaatatgtcttgtccaaaagatgaaaacagacgatcagctacctccagcatgttgtagatgatgtagagcttgatgacggactgcccccttatcaggtggtacatcatggagtagtcaacatagtgcatcataaaatagcagattaccaaaatgacacccttcaaaatgtcacacacctgggcaggctgaagcaaacgtctgtcccttaagccatagcaaggcaaagtgaggagcctgaatagtgccaggaaaactcttaaaggaagcagggtgaacacatacaaaaacgcatccaggcacagaaagattccaaaaaccatcagcttttccaattctcttggtattcgcaaacaagtgtatactctttctcttctttctgtatacttggcctcattatgttcaaggaagtaccctcttgttagttcagcactgaggaacctcaacaatgaaagctctagttattacgcgaagtgcaacctcaaccggatcagaaaaacctccctttccttggatctttccattcacccgtgtttttcctctgttcctcttagtgaactctgaattttgaaccccagaggccacttcaccacactctccggacagcagcttacctgtccctccatgtcacctaaac

SEQ ID NO: 723536 - DNA, 144 bp, Homo sapiens
  misc_feature (140)..(140): n is a, c, g, or t
ctgattatagttgcagttcaatgttgtgctgtgatgggacatttctgttgacccagtctggcaaagtgctggcctgtggactctatgagattcaatacagctggcgtctgacatcagtagcatgtacgggcaattatcanacca

SEQ ID NO: 723537 - DNA, 954 bp, Homo sapiens
  misc_feature (939)..(939): n is a, c, g, or t
  misc_feature (943)..(943): n is a, c, g, or t
tgatacgtctgttgcgcctcttacacctcttgttgttccattggtctgttaagccttgcggagacctatgtgtgtctcctatcgtttgacctctgaaatttcttccaattgctggagcccttccttatggctccagtgctagacctccttattgtaagcaagatctgaagtgtgagttaaaagctacattgagagttgttgcttgaaccattataagaattgcatgcaaaagacatagagaacagccatgaaaaagtgaggaatcaccccaatgtgggctctttttctttctttaggctctgttgctgtccaatagagagcatctaatatgtcttgtccaaaagatgaaaacagacgatcagctacctccagcatgttgtagatgatgtagagcttgatgacggactgcccccttatcaggtggtacatcatggagtagtcaacatagtgcatcataaaatagcagattaccaaaatgacacccttcaaaatgtcacacacctgggcaggctgaagcaaacgtctgtcccttaagccatagcaaggcaaagtgaggagcctgaatagtgccaggaaaactcttaaaggaagcagggtgaacacatacaaaaacgcatccaggcacagaaagattccaaaaaccatcagcttttccaattctcttggtattcgcaaacaagtgtatactctttctcttctttctgtatacttggcctcattatgttcaaggaagtaccctcttgttagttcagcactgaggaacctcaacaatgaaagctctcttggcatgaatataattaagaaatcagccgtgtgcttctcacgtttgggctccgagacgtgggagatgcccgctaacctaagaccttccgagggcgatgcaaggacccggacagaactttcccggccgcagaccccttctagggcacacctggcctncgcngccgcaagctt

SEQ ID NO: 723538 - DNA, 549 bp, Homo sapiens
gactcttagttacgacccaattacagctgctatacagatacggattttatccttcaccatgacagtattgcgacaaagcgaatgatcactcaaacttctattacaccctatattgtatttcctgtatctgcctaccaggtgcaaggtccttcgtggatgcaagctcaacatatattctacagcatcctggttgccgtgtaaacatccctcaatggagcactaccattgtcactactagcccgcatctaatgagtcagccctgctgtgtcctagacaggatgtagtcgatctgtccactaggcagcaccgagagcatatcatgcctggaacgtcaggtaatgcagagggagcctatcttgccaacagtgatgtccctatatgcggaccgacagcggttcctgttgaggaggcaagtggtcaacagcaggtggctggtctgagacgtctaagtgaccattctccatatacctttcaacctaataagtaacgtgtgagatgtaccagaaaggtgttcttacatgagagaagggtgtgacaggctgaccaatc

SEQ ID NO: 723539 - DNA, 375 bp, Homo sapiens
  misc_feature (30)..(30): n is a, c, g, or t
  misc_feature (36)..(36): n is a, c, g, or t
  misc_feature (81)..(81): n is a, c, g, or t
  misc_feature (108)..(108): n is a, c, g, or t
  misc_feature (190)..(191): n is a, c, g, or t
  misc_feature (290)..(290): n is a, c, g, or t
tagggccggtgctgcctgcggaaccggcgnttgagnaggcagcgaacatcatctttgccagtacaggagctcgtgccgtgnccacagcccacagcccacagccatggntgggaccatgacggtgaagatgctggcgggcaacgaattccaggtgtcctgagcagctccatgtcggtgtcagagctgaagnncagatcacccagaagatcggcgtgcaccattccagcagcgtctggctgtccacccgagcggtgtggcgctgcaggacagggtccccttgccagccaggnctgggcccggcaagcacggtcctgctggtggtggacaaatgcgacgaacctcttgaacatcctggtgaggaataacaaagggccg

SEQ ID NO: 723540 - DNA, 136 bp, Homo sapiens
tttaggatgccttcgagtcggcgaagtcagaaagagcatgaaacaaaaacccaagaaagcatctcagactgcaccgaggaaggcgtccgggtcgagacgtgtgccctcgctctggcaaaagagacagacctgaagg

SEQ ID NO: 723541 - DNA, 895 bp, Homo sapiens
ggggtcatggtgtgcttccgcctcttcccggttccgggctcagggctcgtcctggtctgcctagatcctgggagctgtgcggtcttatgcatggaacttaatttgacagattcagaagaatgccacttgcctttatgttaaaacatggcagatgagttctcacagtgcgctatgaaaactacaaaatgaaaaacttataaaagctgtaaccatttcagcaccacggacactgtgacatatgaatggaagcatgttgtggggatgatcgagaatggctcccaagagatagtgcagtgcagttcgagacctggcttttcctggatcggcgaattttaccgaaggcagccagtctacttgattcaatgacagcgtctcatttgtgcctacaacactggtgatagcacaacatttcctgatgctgaagataaaggaattcttactgtgatgaatcttttgtgccatcagaattccattgatatgaccttgttagatgcaatagtgtatcaacttcggaaccgactgatgttgtccagcactactgggatgttcttgtaccacgcgttttgtccaaggatggacgggaggccaaatgagttcctgtgtggattaagacgcaacttccagggtggccccacataataccagtgtgcgatttctagtaaaaaagtaatccaaggaagcggagtggtactagtccgtactaatggaggccctgctgcgggtacacggggcggcgacactcgccacggagagggggtcgtaacacaaaggcccaaaacgctcccgggagggcgctcacaggcattagaccagggccaagtataatgtcctgggagacagcccatctcggagaaaattgtgggggaaacaaagccgcaataaagaggtcccaccg

SEQ ID NO: 723542 - DNA, 777 bp, Homo sapiens
gagcgcgtggggccaagaaagaatacctcctctgaaaaatggcagaagcagttttccatgccccacaaagaggaaaagaagagtgtatgagacttacgagtctccattgccaatcccttttggtcaggaccatggtcctctgacaacgacacttcaagactacttccgctgctgaaacatgacttaaccaaccaactgtgacttgtgacggaactgcggacggaccacttgagcacgctctactgggcacacacggttattctggacaccaggtacttctttcacgaagccgtcccacgcttcacaacctttcacgattcctaaaactggtttgctaacatggaaagactactgacacgacaacacacttgcctactcaatacaccacttcaacacgaggtattcacgcactacgtcgttcgacgtcgggcaagacacgacggctgactgcgtaagaccacgggcgccagagactgaagacgttaccacgtggcggcaggaacttcccctccacaaacggacttctaagccacgcggacaaaccccggctttgtaacactcattccttcccctctgatgacaccacgcgacacctgcacccgaagcggggtcacacaaatgcatcattgcagcaaccacccctacacgcactacgctcgttgaccacatgcgtgtgctcctaccacaaacctgggtgcgaccacggcggcacatccagtgtaacgctgcagagcgaacgaacagcaacgcacccttacctgacgagtgcagtctggc

SEQ ID NO: 723543 - DNA, 289 bp, Homo sapiens
ttcggacccctatcccgatacggttgtataggattgcttgcaattgctgctgtgttggcatctgctctggccgtatcatctaactgatgagcaccgaaggatatatttcctacgccctctcagccgatgaacatgcttggaataggttgttagcggtaactaagattagctatggtacttcggaagataagttgatcttactaactacctgatttatgtccgcgtgtctgcagttttatgtttcacagctcaaaattctaattatgtgcaccatgtatacgatacaatg

SEQ ID NO: 723544 - DNA, 116 bp, Homo sapiens
agcggggaacaatcactttggctaggactagcaaaagtgaacaaataggattacatgaagtgaaaaagcttatgtacagcaaaggaaacaatcaacaaagtgattgttccccgctt

SEQ ID NO: 723545 - DNA, 183 bp, Homo sapiens
tgcagcactggtagcaggatcgtcctagccagctggctccatatggtacgaggatgttaggagttgacgctacagaacattcaggtattgtaagtcctcttcagtacagcagcctttcttgtcatctgatggacatctgtttaaatggagcttgtcagttaacataagctaattggatggttg

SEQ ID NO: 723546 - DNA, 127 bp, Homo sapiens
atttgtatggaatatctgttcctgcttcttctactttcaatccatatgtgtctttaccacctgagaagagtttcttgtaggcagcttatagttgggatcatgatatttgcatcattcagcccgtctg

SEQ ID NO: 723547 - DNA, 223 bp, Homo sapiens
aaaaatttggggggctctcccccgggaactctacaaaacattttttgtcacaaagaccatacttcaaacctccctgttcttatgaattggaacagcatacccccgattcggctaggaccaactcatacacctcctatgaaaaaacttcctaccactcaccctagcattacttatatgatatgtctccatacccattacaatctcaagcattccccctcaaacc

SEQ ID NO: 723548 - DNA, 740 bp, Homo sapiens
  misc_feature (177)..(177): n is a, c, g, or t
  misc_feature (206)..(206): n is a, c, g, or t
  misc_feature (209)..(209): n is a, c, g, or t
  misc_feature (236)..(236): n is a, c, g, or t
  misc_feature (311)..(311): n is a, c, g, or t
  misc_feature (351)..(351): n is a, c, g, or t
  misc_feature (353)..(353): n is a, c, g, or t
  misc_feature (368)..(368): n is a, c, g, or t
  misc_feature (383)..(383): n is a, c, g, or t
  misc_feature (406)..(406): n is a, c, g, or t
  misc_feature (436)..(436): n is a, c, g, or t
  misc_feature (440)..(440): n is a, c, g, or t
  misc_feature (469)..(469): n is a, c, g, or t
  misc_feature (480)..(480): n is a, c, g, or t
  misc_feature (496)..(496): n is a, c, g, or t
  misc_feature (648)..(648): n is a, c, g, or t
atatagtaggctctgtatcgtgatggtaaagtaaaatacatgtgtaaattggtgtcaatactacctgtcagttttagtatccaaatagtgcaagccttataaaaaccattaaggtaacttacagagcatacacaaagaatagtttatgtatagaaaatagtctgttctttccatttngagagaaccaactaaagccatttagactnggngtcttttactggggtaaacctcttttntgtaaaaattcatggtttgaacatttaattttcctaaaaaattttatatttcatctgttttcacatttactaatngaaaacacttttgatcaagttgatttattatttaaatgtntngaatggttcgggtgntttttcattacattntgtgtccattaacttgtgttttnatcttaaatctctcctactttctttgtatnattnagtcttgagctaaaaatctggcttttgtnagcgtatattnaatgatgtttaatgantgcatctagggctatgggtttactttgagttctgtctgattacattatttcgaattttgggatatctgtgttttttttaattcagggattgagatacaactttctaaatctgtatcgttaatttctaatgtatttatttcgagatgttaganaatgtggcccttttttcaaggcagctggaacgggtggctgaaatgaagccagggaccgttgggacaggccccaattgtaaaggacctttggg

SEQ ID NO: 723549 - DNA, 825 bp, Homo sapiens
  misc_feature (49)..(49): n is a, c, g, or t
  misc_feature (77)..(77): n is a, c, g, or t
  misc_feature (83)..(83): n is a, c, g, or t
  misc_feature (100)..(101): n is a, c, g, or t
  misc_feature (174)..(174): n is a, c, g, or t
  misc_feature (179)..(179): n is a, c, g, or t
  misc_feature (202)..(202): n is a, c, g, or t
  misc_feature (210)..(210): n is a, c, g, or t
  misc_feature (212)..(212): n is a, c, g, or t
  misc_feature (219)..(220): n is a, c, g, or t
  misc_feature (240)..(240): n is a, c, g, or t
  misc_feature (248)..(248): n is a, c, g, or t
  misc_feature (267)..(267): n is a, c, g, or t
  misc_feature (284)..(284): n is a, c, g, or t
  misc_feature (298)..(300): n is a, c, g, or t
  misc_feature (314)..(315): n is a, c, g, or t
  misc_feature (318)..(318): n is a, c, g, or t
  misc_feature (320)..(320): n is a, c, g, or t
  misc_feature (332)..(333): n is a, c, g, or t
  misc_feature (335)..(335): n is a, c, g, or t
  misc_feature (348)..(348): n is a, c, g, or t
  misc_feature (354)..(354): n is a, c, g, or t
  misc_feature (381)..(381): n is a, c, g, or t
  misc_feature (394)..(394): n is a, c, g, or t
  misc_feature (397)..(397): n is a, c, g, or t
  misc_feature (432)..(432): n is a, c, g, or t
  misc_feature (461)..(461): n is a, c, g, or t
  misc_feature (467)..(467): n is a, c, g, or t
  misc_feature (515)..(516): n is a, c, g, or t
  misc_feature (532)..(533): n is a, c, g, or t
  misc_feature (819)..(819): n is a, c, g, or t
agaaatgatgaaaaaataagtgaagggtgttgaagatggattaaatganaagtgtttaatggaatgggaaagaagantgtggnataaggaggtggaaggnntgttgagtgatcattgatgatggggaaaaaataattatggtgttaaaaaagcttaaggaataattggtatttnttatnaaagtattttttatggtgtagtntggggaananaaatttnnaaaatttgataatttttggnattggttngtgtagagaagggaaaaanggtgagggaaagggagncagaagaggaggannnaaaagaacggagtnnaantnttgggaaaggannanagggatgggagtnatgttngaatgcatttgcaaaaaaaggggattnttggtgaggggtncanataggaaaagagtaatgattgagttcactggtggntgcatgggttgtataatgaagggagttgncaaagnaatgggttgaactgtggccaggtagagaatggaaagatcatcaaggtnntgagagagtttcaatnnggtgagcatgcgcttaagtgttagaactgctaagggagagaggttgccatggaaatctggccaaacatgttaatcaacagttaggaaacccacaggctgagccttcttaatcagatccaggtgactgttcaaatatgcatatatactctggcatctggctgtggcctttacttgtagttctggaaaagcagcatggccttgtaccacgtggtctatcaattttccagttacgctctgaccaccttcattcagccagaacccaggtaccatggctgagaaataaggncccaga

SEQ ID NO: 723550 - DNA, 173 bp, Homo sapiens
agcagaagtcacgaccaaactcatagagggatgtcatcaacaccttgaacactttgtgtaccagagtagtgtaatgtctcaaaggtctctgacatgcccattagcaaatagatagctagccggtcctctccttgacgcaggctataatccagagagcctcctgacacatggtc

SEQ ID NO: 723551 - DNA, 1200 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctg

SEQ ID NO: 723552 - DNA, 2358 bp, Homo sapiens
  misc_feature (9)..(10): n is a, c, g, or t
  misc_feature (1286)..(1286): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccaggtgcgtggtggctcgaggcgggggtgggggcctcgccctgcntgggccctccctgacctctccgctccgcacagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 723553 - DNA, 1457 bp, Homo sapiens
acgcctggtgcagcgtggggtggcccgggggccctggtgtgccctgtgtgatggtggaaccgctggtggcattcctgcggaggtttcggcagtgtgcatcctgtgggcctggggtctgctggcactgtggactggtgtgccggggcctgaggcctgctggagctctgcgtgagtgcaatggccgacgtgatcaaggaagtggatgcccagtcaaccacagattgggccagcatatgagtcaaggcaccatgcaagcatcaatgtcgccagtggcaggcagcatctatcgtcgttctcgccgtgccacattcaaaggcacatcagcagcatccatttgcattttcttaccatggagtggccgtcgtctccaaggcatgcagaggttataggcacagcattcatgccgcagttgccagcaaagccagcacacccgttgaccctggcaccagactgccacccaggtgttccacaggcccattctgctccgccgtcatcgcggggaccataccaacaagaggccaaccgatccgggaccctgggagtgcgtcaaaggttgcatacccaaacgggacgagctgggcacccacgcggcaccactaccggtgggcgcgcacaattcgacttcgctggcacccaaagacgtacatcacacatcagcagccacacgagtagaccgccgagcactcgtgcctaccctgagcgtgggaaacacatcggaattcggcggcaataggccaccactacatactttggttccgctcattctggcaaaacgggttggaccccatgagccccgcattgacagcgacttcttggctggcatcgggtaccgcgccataccacatccaccattggacaacacgcaaagagggggacacttcgggccaccttcgcaatcgccttcccggacacacacgccgtgggcaggcccccgatacacgtaaacggcctgggccatcccacgggacttgcgggcctgtgggccacctaccggacactggcaacgtggcgactaaacaacacccttccagcgacaccacggagggcgactatgcacgacttgcaccacccacactgggggaccaacacggtccgcgaccccgaggcgccccgcgcctttgacagggccccacatactctaaaagacaacatgatcagaggcatacccgtggtgcaacagccccgcgacagcagtgctgggacacacggcgcacagccagtgggcaatactgcaccgccaagtgtactcccgtaaaccacagggacaggttacaacgtggagcccaccgcctcggtgcacggcaccccctagacacgcagagtcccgcgggcaagcgcgaacacactgcggtcatggcgtgcgtgcgctcaaacactcaacgggaaaccagacacgaagacacgaacacggaaaactgcacggacagccacacaacgcagcgcgcgcgaccacacgt

SEQ ID NO: 723554 - DNA, 1533 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1231)..(1231): n is a, c, g, or t
  misc_feature (1380)..(1380): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaacccgngggcatcaaatggcggggggcgggaaaaaaggggtactggaatgggccatgggccaaagcggttccctggacccagttttcctggtccaagggggaaatcggcggggccccaaaagggaggcggaaaaattccgaaaagccaggtaccnggtagagaatcggcgaccaaggccgccgggaaccaagacacccgcgctagtgacgcggtctataggggggacgcaagcgagtctggagagaccacgaattcgcgggcgcagaacagcggccagagaacaaaagaaaaaccagccagcgccgac

SEQ ID NO: 723555 - DNA, 1695 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggcgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 723556 - DNA, 531 bp, Homo sapiens
  misc_feature (112)..(112): n is a, c, g, or t
  misc_feature (114)..(114): n is a, c, g, or t
  misc_feature (116)..(116): n is a, c, g, or t
  misc_feature (430)..(430): n is a, c, g, or t
  misc_feature (490)..(490): n is a, c, g, or t
  misc_feature (506)..(506): n is a, c, g, or t
  misc_feature (531)..(531): n is a, c, g, or t
caccgcacccagccccaaactctttaatcttatgagaaagcggggccaggtgtaatggcttgtgctgtaatccaaacactttgtatttgtaatccaaacacccacaaagtgngncntccagctgaactcaggagtcccaagaccagcctaggggcaggtgcaatggctcatgcctgcactttgggaggctgaggcaagtgaatcgtttaaggtcaggagttcaagaccaagtctgtccaacatggtgaatgaaaccccaccctctacttgaaaaaaagtacaaaaattggccaggccgtggtaaggaaagaggaggtcaaagcttgtaaaaaaccagcagaataattttgagccagaaaatcagacttcttttctctttttttgagacacctttcctgtccttagtgtaaaaggctagagtgcagtggcnaatcacagctcgctgcaaccatgacctcccaggttcaggtgatcctcccacttcagcctncccagtacctgggatnacacaagcaagccaccatacccagn

SEQ ID NO: 723557 - DNA, 269 bp, Homo sapiens
tttaaggctgcagtgcaacaatcacagctcactgcggctcaactccccaggctcaggtgatcctcccacttcagcctcccaagtagatgtgactacagatgtgccccaccacgcctggctctttatttttgtatttttgtatttttttttttttttgggtaaaaatggggtttggccatgtggcccaggctggtctcctgaattccggggctcatgccattcgcctgtctgggcctcccaaagtgtgggaattacagacttgagccatg

SEQ ID NO: 723558 - DNA, 1410 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1242)..(1242): n is a, c, g, or t
  misc_feature (1256)..(1256): n is a, c, g, or t
  misc_feature (1301)..(1301): n is a, c, g, or t
  misc_feature (1303)..(1303): n is a, c, g, or t
  misc_feature (1311)..(1311): n is a, c, g, or t
  misc_feature (1314)..(1314): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaaaaaaaaaaaaaaaacnccgggggcacaaanggggggggggaaaaagggggaaaacaaagggcccaggggccaaangngggtccgnggnccaggtttgttgtcacacagggcgaaaaatgggaggacaccaatagagagcgcgaaaaacgagaaagcacggtaccgtaagaactagacaaagagc

SEQ ID NO: 723559 - DNA, 1168 bp, Homo sapiens
  misc_feature (9)..(10): n is a, c, g, or t
  misc_feature (1103)..(1103): n is a, c, g, or t
  misc_feature (1126)..(1126): n is a, c, g, or t
  misc_feature (1131)..(1132): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggtgagcgcgggcgcggggcagggaacgttccggggnccttgccggcgggttaacgcctncaggnncggcacatggaggggctgatgactgttgggcggccg

SEQ ID NO: 723560 - DNA, 1463 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaaaaagaaaaccttttggggggcctgggcccaggcgactttagactcgagcaagtttatgatggcggccgaaattggagctcattggccaatccccctataggggggcgtattaaaatacatgggccgggggttaaaaacggggggactgggaaacccctgggggtccccaataattgccttggggacatccccttttgcaggtgggggataaaaaaaaggcccccccatcgcccttca

SEQ ID NO: 723561 - DNA, 1289 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaacacaaaactaaaggacctctgggctacaataaacaaatacatttcttcctacctttcctcatatcattatattctcttctattattctcctccgtcgtactcaaaaaaaa

SEQ ID NO: 723562 - DNA, 188 bp, Homo sapiens
tgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattccaaaaa

SEQ ID NO: 723563 - DNA, 104 bp, Homo sapiens
atgcaggaaggtaaggtacagtaaaagcctacttggcctttataaaagaaaaccattctgacattgcttttaaaagggtacttagattccctgcatatgtaggt

SEQ ID NO: 723564 - DNA, 859 bp, Homo sapiens
atcccagcacttgggaggccgaggcgggtggatcacgaggtcaggagatcgagaccatcccggctaaaacggtgaaaccccgtctctactaaaaatacaaaaaattagccgggcgtagtggcgggcgcctgtagtcccagtcacttgggaggctgaggcaggagaatcgctagaacccaggaggtggaggttgctgtgagccgagatcgcaccattgcactccaggctgggcaacaagagcaaaactgcaaaaaaacataaaataaaataaaaaaagaaagtacatctcaaaaaaaagaaagaaagacaagaaaaagaaaaaaaaaggaaacacctttgtcttgtgtccagtcagtgggctcccaggaaaatgttccttctctttttgtggcatggacactgtggaatctggtacattccggtagacattctcctttaatttggactgtaagtctgacctctatgattaattacttcagcccctgatggctcccgtgcaagctcctttggccaatttcaccttagcttctggtacgtctgggccagctaagcgcatctatcatcatcccttccagctcctgattggtctgcgccaaaggctgggcaagctgagccacacgtttttcaagcaccgcctgtgaactagggccatattcttcccttccagtcataaaacctggcccagccccgttgaggacccattcaaaccctattcgcggaagagctcatccctgattaattactcactcactgggtgaccctattctagggaaaaagattgggtcccaacacgagagactgcgccgcgcacgcaagcgtcttcgggaacatcacagaggaacggctggactaagatgtg

SEQ ID NO: 723565 - DNA, 1218 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1216)..(1216): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaacaataaatatatttattttttccacatacttcnca

SEQ ID NO: 723566 - DNA, 175 bp, Homo sapiens
tgagagaccgtgttgcaatgtggtctcgaagttctgcctcaagtgatccacccaccttgggctcccgaagtggctgggattgcaggcatgacgcaatgaactggcctttcatccaccttagtcatcacttcctttcttctcttccagttcattgcaacacgggggtaccgaggct

SEQ ID NO: 723567 - DNA, 789 bp, Homo sapiens
aaaaacaaaaattaaggctaggtacgaggccgggtgttgaatcggccgagggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaacaaaaacaaataaaggacctctgggctacaaaaaaaattcactgggcggtgttttacaaggttgggacggggaaacctggggttaccaattaatcgcctgaagcaatcccctttcgcagtgggtaataggaaaggccgacgatcgccttccaaagtgggcacctgaagggatggcaatgaggggtaattggggaaacgggtggggagaacgctttt

SEQ ID NO: 723568 - DNA, 1126 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1121)..(1121): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcaaaaaaaaaaaaaaaaaaacaaaaaaaaaaaaactttttggggcgccctgggccccgagaaaaagtttttaaacaccatttgttggggggccgcgngggcc

SEQ ID NO: 723569 - DNA, 1547 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcaggctacaaaaaaaaaaaaaaaaaaaaaaaaaaaaaaaaaaaaaaaaaaaaaaaaaaaaaaaaaaaaaaaaaaaaaaaaaaagggggggggggcaaaaaaaaaaatccacccgagggggggcgaccaaaaaaaaagcagcacacaagaagatgagagatagaaagaagggggacccacaaaggagagagagagcattaaaaagaaagacgtggaagggaggcaggcgaaaataaacaaaaggaagaagagagaaacaagagacgaaagaggaaatagtagaaagaagaaggacaccaaactaccgcgagggggaaggaacaaaaaaaggaagaggaacacaaactgccaccaaaaaaaaaaaataaacagcacaaaaaggagagagtaaataaaaagaagcgaagaggaaaaaaaaaaaggtgaaagacaaaagacacccaaagaaaagtagccacgcacacaaacaaaaaacaggcagcagcgacgacaggcatcaacgaacaacaagagaaaataagaag

SEQ ID NO: 723570 - DNA, 871 bp, Homo sapiens
  misc_feature (392)..(392): n is a, c, g, or t
  misc_feature (415)..(415): n is a, c, g, or t
gcagaaggagacggaaggacgcatgcgttggtgagtcccggattctggtgtggttcttccgctcagagctgtgtgaagcgcttccgggtcgccgacgtgagtagtcctcccggagcgatgaagacatctgaggctcagcagaggttaagtgagctcagggcaacggttcaagaacagctcagtatacgtggtaggagcgcatggactcagaatggcacgatcatatgaggccatgtccacatttgttccccttcagtcttccctcgtgtgactgagactcgtgtggtttaatctggatcgaggcctgtgtggaagagacagagcatggatggcagtcaggaacagtgaggatcaggcctggttccaaagcatcgcgtgagaaagacaacaanctggttcctattggcaagccagnctcagagcactatgatgacgaggaagaagaggatgatgaagatgatgaggatagtgaagaggactcagaggatgatgaggatgtgcaggacatgggacgagatgaatgataccgatgagttcagcggatgtatggacgagtgtcactgaggtggcatgggaaggaagaaaggatcaggaccagtggatgatctaggtagacaaggcagggtggctcagggagattccaggcagccaaagtatcctgatccaaccccaaaccctgcccacagaaacagtgatggtcccagtgctgaaaagtgcgcttggggacctctcaagtgtgccaggatctggtctctttgggccctccaggcaatcagtctgacttgaaatccccaggctgaactatcacttctggcagtactttaccttgattgccagctggctagttcttataagacaaggggtgttcaaa

SEQ ID NO: 723571 - DNA, 734 bp, Homo sapiens
gttctcaaaaagccctcctgcccactcagtccttcatccctgcctgctctctattgaagtctgttccgctccatacccaacaacactggtaaaggctgcgccatctttgaatagtgtttccatttattatttgtgttattgttatttagacaatcaaatcgttcacttaaatgaatacattatgaacatattttaaattgcctatggacttatttaagataacaattcctcagatcttaaatttttttcccctttttggttaaaagggaaatggggggctgaataggtgatgataatttatttttcttcatacaattagccattattctgaaaatgtttatattcttttaaaaatttatagtcattatgggttaaaccataatgtcagtaaaacagcatctacattagtctgggggaaaaaaactatatctgccaccagcagaaagatgaatttggtgggcctttgaaagtcagaggattaactagtgttgggggggaacatgtcttaacacagatacagaacctgtcttatttctgcttcatgaactagtaacacaaacactggagaggctgtgatggggtgtgtccagctgtctgctaaccagatgaggcttttgagcgttgtgagcccaaggaacagcaaaccaccattctgggtttaataagcccttatactctccagtattgagaatacccgggacagaagttaaacctgggggggaaaacaaacagtt

SEQ ID NO: 723572 - DNA, 297 bp, Homo sapiens
aatctagctgtttcagggtacacagatccatttgttccgaatgccactaaaagctatatttcgctgtcactgctgctccaggtaatatttagtctgtggaaaatctatcatcagtagggcactgttgtttattggatgagctgaaaagaaagatatgcttctggcatccagaatgttttacggtctttcaagttgtatcaaatgtgacctgcagaatcgtttaagtgttctcaggatgcataagttggagctgaaatgtgacatctaaccagttgctaaaagtgtgcagtggtatct

SEQ ID NO: 723573 - DNA, 1053 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (989)..(989): n is a, c, g, or t
  misc_feature (1053)..(1053): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgggccattaagcctttaaaagcccngaaagctttctgaaaacggtgaagggaaatggtcccaaaaagaaggcccggggtccctgggttn

SEQ ID NO: 723574 - DNA, 424 bp, Homo sapiens
tccccctcgtggatgcaaaggtcgtaatacagccgggaacttaacagcagtgggacactgagagctagagcatctcgatgtaatacaccatgacttaacacagtgggacacggagagctagagcatctcgatgtagtacaccatgacttaacacagggggacacggaaagctagagcatctcgatgtagtacaccgtgacttaacacagcgggacactgaaagctagagcatctcgatgtagtacaccgtgacttaacacagcgggacactgagagctagagcatctcgatgtagtacaccgtgacttaacacagtgggacactgagagctagagcatctcgatgtagtacaccgtgacttaacacagtgggacactgagagctagagcatctcgatgtaggacaccgtgacttaacacagtgg

SEQ ID NO: 723575 - DNA, 289 bp, Homo sapiens
ccctgccattgagtttggagggccctgttggagcctttggacctatagctcaaggccaaaaaaatccctggctttggaattaaatagcttagattgtactataacccctacttatgaactcagggactattagggactattcaggggctatgaatttgagcctttgttttttgaactgtaaagtggaaatgatgtaaacccccttgcaaaattgtaaagttgggtaaggtcatgaacataagggcctggcccaaagggtgccctgtaaataaacagacatccctcctta

SEQ ID NO: 723576 - DNA, 379 bp, Homo sapiens
  misc_feature (12)..(12): n is a, c, g, or t
  misc_feature (19)..(19): n is a, c, g, or t
  misc_feature (44)..(45): n is a, c, g, or t
  misc_feature (50)..(50): n is a, c, g, or t
  misc_feature (75)..(75): n is a, c, g, or t
  misc_feature (82)..(82): n is a, c, g, or t
  misc_feature (113)..(113): n is a, c, g, or t
  misc_feature (117)..(117): n is a, c, g, or t
  misc_feature (130)..(130): n is a, c, g, or t
  misc_feature (161)..(161): n is a, c, g, or t
  misc_feature (165)..(165): n is a, c, g, or t
  misc_feature (172)..(172): n is a, c, g, or t
  misc_feature (220)..(221): n is a, c, g, or t
  misc_feature (243)..(243): n is a, c, g, or t
  misc_feature (250)..(250): n is a, c, g, or t
  misc_feature (253)..(253): n is a, c, g, or t
  misc_feature (320)..(320): n is a, c, g, or t
  misc_feature (322)..(322): n is a, c, g, or t
  misc_feature (367)..(367): n is a, c, g, or t
ttagaccaggcncatgggnatgttccagccagcggttctgccanntccgntatgacaggacttctcgcctttcanattgtcncaggtgagctcagaagctgatttcttcaccngtgntacagctgccaanacagcgcaccagaccacacttgcccgatatntagncaaaccntccatccaagttcatggcatcagcttctccattcatgatcttgccaanncagtcttcggtggtctctgttnatacacnctntattttccatacactgttaacactccactcatcacacttgagcctctcgtggtggctcagcgcacancncttcacaggcgcgcactcatctgttggggcttctgcgcatgcgcnttcccctcgtgc

SEQ ID NO: 723577 - DNA, 104 bp, Homo sapiens
atacagaaaacaaaacgaaacaaaacaaaaacaaacagaataccagtgaccatccaaaagtgggacataccgcgctgacccatatcgaccccacccatagctgg

SEQ ID NO: 723578 - DNA, 92 bp, Homo sapiens
ccgtcatcgcttgtggtggtgtgactcgcgtcgagagcacatccgaggtcgacgcatctgcggtggtcgcggatgcggcgtcggaatcggct

SEQ ID NO: 723579 - DNA, 202 bp, Homo sapiens
tatatagaagaggtagaaaaagggactcgcagtaccttcagctttttctgctcttaagaaagatgaagggctgggcatggtggctcatgactgtaatcccagcactttgggaggcaaggtaggcagatcaggaggtcaggagtttgagaccagcctgagcaacatggagaaaccccatctctaccaaaaatacatatattag

SEQ ID NO: 723580 - DNA, 372 bp, Homo sapiens
  misc_feature (304)..(304): n is a, c, g, or t
gtgaattttgtaagagcccattgttcctgaaataagccatatattatagatatgttagcagaatacttgataaatccttatttgtggatatttcttttttttttgagacggagtttcaccctcttgccccaggctggagagcaagtggcacgatcttggctcactgcaagctctacttcccgggctcaagtaattctgcctcagccacgtgggaggctaagggaggaggattgcttgaggccggaaggtgaaggttgctgtaatcccagctactcggggggccgaggcaggagaatcccttgancccgggaggcagaggttgcagtgagccgagattgcatcactgtactccagcctgggggacaagagcaa

SEQ ID NO: 723581 - DNA, 264 bp, Homo sapiens
ctctctatccagatccacttctcttagaccatctaaatacacgcgcggattttaaaagagaacatagggccggacgtggtgactcatgcctataatcccaacactttgggaggccgaggcgggcagatcacttgaggtcagaagttcaagaccagcctggccattatggcgaaaccccatctctactaaaaatacaaaaatttgccaggcatggtggtgctcatttgtaactcccagctacttgggaggctgagattacaggtg

SEQ ID NO: 723582 - DNA, 726 bp, Homo sapiens
  misc_feature (699)..(699): n is a, c, g, or t
gtttcaccgggctggccaggctgctctcaaactactgaccttgtgatccgcctgcctcggcctcccaaagtagctgggattacaggcgtgagccactgtgcccggcctggaaagaagattctttacatgaagagaggcgagtcaaaggtctggcacagcagcagctgtaacacggaaactgatctcctctccccacctgaaggttgatggatataggagagggagcatcatcagagccaagaggcaagaagtgcctttgaggagccaggttttagttaataaggatgacttcagagcacagaatagaaattatgggggagaaagaagtgagggacatcttataacactatgagatgtgctaagacatgatgctatctttcaagacactgacttttaccctatataagtctataactccattatcatagtcctcatctaactcaaggtttgctttaagattatattggcattgagataaatattaatgccgagattcacaactaggtgacacacctagactattgggtaaagtatgcagatagtggtaatattaaaaatgtgtcttaaacatctgagcaacactttgtttgatacacatgatgtctaccgcaggcctcagaaagacagtatcacagaaggctggaagatgaatgagactgaacttcatcaggcaataaagtcaatatgaatttttcaaanaagaggggccacaggggggggctgttt

SEQ ID NO: 723583 - DNA, 295 bp, Homo sapiens
cgtctatgccactgagtgatgcgtgatctcggtcacataactttctccgggttcagcgattctcccgctcagcccccgagcagctgggaccgcaggcatgcaccaccatgcccagctaatcaaaaaaaaatttggagtgatggggcttatgtgttcccaggctggtcgtcaactcctgggctcaggtatctacccgccttggctcccagggtgttgggattattgtcatgagccactgtgcctggcagccatagactcttacagttgaatacaatgatgattttttgcatcatta

SEQ ID NO: 723584 - DNA, 106 bp, Homo sapiens
  misc_feature (24)..(24): n is a, c, g, or t
  misc_feature (42)..(42): n is a, c, g, or t
  misc_feature (67)..(67): n is a, c, g, or t
ggtagatagcttttggatgattgnggcatgcttatattatgnaaaaaattgctaataaagataaatnctacatgttcagaataaaagttacatttttcaaatattg

SEQ ID NO: 723585 - DNA, 1430 bp, Homo sapiens
cccctccccccacgaaagcgagcagagcggagagagcgcggggaagtcggactaggctcctgtggttcttattctcggccgtgcgtgtgtctcctcccctgttggtttcctctgttgtgtgctgccccacgttgttgattttgttccagagtgcttcccccactctcgcggggtgtgtgtctccacgaagttgttgccccccccggggttttctcacaggggtcttttttccttgtgcctcctctctgttatgcacctctggtggttcttactttctgcgcgaagggcaccccctgtggggcgccccctaagatgcgccttttttacccccgcggtgagttcttttttttgcggcccccctctcatggtttcctccggggggggttgctccctcctccctatattaggggggcctctcctttttgtccgccgggccacaattgtggttttctcgggggattcttttaggggagaattttggtggggaaaggagaattcccgggggtccccttaatgggctgtgaatccttcccaagaaatctctttatatggcgcgcagttctgggcgcccgcctacctctttattgtcccgccatatcttttagagaagagtatagctctgtgtaaacccaccgggtgtttcgttggcaccactatctctcgggagatacacactctcttttgtatgggcgcccctctcctcccccggggggggtgtcctctcccccccgcttttcctgtgaggggggcgcaccttccccacaagtgtgtcacggggggccgcacacatgtggaaggggtgtcccccctgggacacacacagaagcagggagagaagtgtcaagggcgcgccttccctcctctctttccctccgtgcgctgcacatagtggggtgttccccccgggcgacctgttgtcctcctttggcttctctctcgaggaggtccccggccttctttccccccccgcggagattttcttgttttggcgcccctcttcttgcggtgtcccccactgttccctcttcccccacgggttctaataagggttggtatatattctggccccttgtgccacacaactcttctccaagcaccacattcaccgcgggacacccgagattggtcaaaaacaccgttcacgaaaaggcgcgtttgcgcggtcacatctccgagtgtggcccgtgctcacagcgccctgggaccccctctgggttccacgccctcggaggcgctgggagagcccgcgagattaagtttgtagatccgcgcctttcgggtgggggctgtactttcctctttggttgtggacacccccttttgtttttgcccctctctgggggttttttttggtccccccggagggggggggggcccggggggcgggggttttttttgggggccataaaaattgttcttggggtgtgtta

SEQ ID NO: 723586 - DNA, 389 bp, Homo sapiens
  misc_feature (18)..(18): n is a, c, g, or t
  misc_feature (52)..(52): n is a, c, g, or t
  misc_feature (67)..(67): n is a, c, g, or t
  misc_feature (121)..(121): n is a, c, g, or t
  misc_feature (311)..(311): n is a, c, g, or t
  misc_feature (361)..(361): n is a, c, g, or t
  misc_feature (380)..(380): n is a, c, g, or t
agcactttgggaggcttnagtgggtgaatcacataagccataggagttcaanactaccccgggcaanatggcaaaaccccatctcctataaaaaatttaaaaattaggctgggccgccggntgtcacgccctgtagttccagcactttgggaggccaaggcggtcagatcatgaggtcaggagatcaaaaccatccctggcccacatggtgaaatgctgtctctactaaaaatacaaaaattagctgggcgttgtggcacatgcctgtaatcccagctactcgggaggctgaggcaggagaatcgcttganccagggagtcggaagatgcagtgagctgagaatgcaccgctgcactccancctggtgacagagctgagnctctgtctc

SEQ ID NO: 723587 - DNA, 167 bp, Homo sapiens
tggacattctacctacgaggtcgagcataacataaataattggaatctccagctggagctattgaacatcccgcataatgggattacatgtgtggaagcttctgcagcggggctatggtgcaacttcaggtctcatctccatcaaagaaaaatacgtgaaagatatg

SEQ ID NO: 723588 - DNA, 152 bp, Homo sapiens
tatactaagtcgagccggtaccccatcttctccttacacctagcagagtgttctctatcttaggggccatcaattttcatcacaacaaattatcaaatataaagaccccctgtcgatgaacctcagttactcaaacgacccctctgtcgttc

SEQ ID NO: 723589 - DNA, 417 bp, Homo sapiens
  misc_feature (96)..(96): n is a, c, g, or t
  misc_feature (99)..(99): n is a, c, g, or t
  misc_feature (104)..(104): n is a, c, g, or t
  misc_feature (119)..(119): n is a, c, g, or t
  misc_feature (198)..(198): n is a, c, g, or t
  misc_feature (231)..(231): n is a, c, g, or t
  misc_feature (240)..(240): n is a, c, g, or t
  misc_feature (245)..(245): n is a, c, g, or t
  misc_feature (274)..(274): n is a, c, g, or t
  misc_feature (401)..(401): n is a, c, g, or t
  misc_feature (404)..(404): n is a, c, g, or t
  misc_feature (412)..(412): n is a, c, g, or t
cctccccctccattgtcccctccccccccacacaccttcctttttgtccttgtgttgaaaagggtatcttggggaatgagtttattattttttccncgncctcncctatacatcccccnccccatcctccaggtttgggaaatatccatttttttggccagtcttagcatgtttttttaatgtcccattccccccccnggcccaaaagagattttatgacatatattatanagagaattntatanccatatatataaatattagagattatgtncccaagggcatgggctcaaatgccccctgccagtcccccccccaggcttcagcatcttttttggcctggggaagtgggagggatgtgatgctggaaaaggctccaggctgtgttcaatgcccctaancanaatgtggnggcca

SEQ ID NO: 723590 - DNA, 318 bp, Homo sapiens
gacaacgccgagggtcaaattaataaggaaatgcgaagaacctagaatagttcagagcacctttggagaatacgcacttaccatatggctacagtaattagtattgacacaaggatacatatgaaacagagcaagaatccactgggaggccgaggtgacggatcacctggtgccaggagtacaagaccagcctgggcgacataccgaaaccccatctctactaaaaatacaaaaaaattacccaggcatgatagcaaacacccataatctcagctactcaagaggctgaggccatgagaattgcctgaacctgggagg

SEQ ID NO: 723591 - DNA, 144 bp, Homo sapiens
ccgggtacttgcgtccctcagatctacttttctaagagccatatgccaccccaagtggtatgtcggccatccctatatcttctggtagggccggcagcctgtgaggccctgtccccgttccgactcgtccccgcccgcgggccg

SEQ ID NO: 723592 - DNA, 105 bp, Homo sapiens
ctctacaggatccccagttacgcctcaccggctagccgggcagacaggagcgtgtgcctgtctacctctctccgtccctggacgtgtgtctcggcctcatctgat

SEQ ID NO: 723593 - DNA, 164 bp, Homo sapiens
agatgtccgatacagttcctacagcaattttttatatactgaactctcttatatccccgatgggcgtcagaatggagagtgtatctctacagctccttctagagcacaagcaggcttaaccatgaatcttggggacactggtactcatacgattcacaaaattc

SEQ ID NO: 723594 - DNA, 467 bp, Homo sapiens
  misc_feature (213)..(213): n is a, c, g, or t
  misc_feature (344)..(344): n is a, c, g, or t
  misc_feature (413)..(413): n is a, c, g, or t
  misc_feature (464)..(464): n is a, c, g, or t
ggaagattacctttctgccccatccccttttcagcttcccttccagctgagaatcactttcattggcaataaaatctcccacatttactattcttcaatttgtttgggcaacctcatttttcctggatattagacaagatcttggcagccatgagcatggatgcaaagggcctactgagatgttaacacttaaaccgttcgtggatggcaganctgaaggagcactgtaacacaccctccagggctttgggagtcacaggcatgctgcctgaaacagggcctgcatggagtttgctcttgccagtgcccaaaaagtggtcgctcaggctcctgcacccactcanctgctttgctccctcccgcaagggtgggaaatgcagcagtctgagtgagtagagtttgatcccacaggnaccaaatgggcagcagtttcagtgttcatgcactccagttccacccattgnttt

SEQ ID NO: 723595 - DNA, 203 bp, Homo sapiens
ccctatttttcttttttaaaatcataaaccggcagaccagatttggtttgttttgaagaaaaggaagctctataaatttaaatttatattcctgttttttttttttataatttataaatccccagttcttttgccttttatttttgtgtaatttgtaatgtttgttttaaaaccaataaataaagcccagaagtttaatgaga

SEQ ID NO: 723596 - DNA, 1139 bp, Homo sapiens
gagccctggggccccgcgctccgcctgcagtgaagtggcgttgcatttcccgtggggtaccctctgagctgccctcttgtgactccttagctggggcgtgctggtcagacaaatgtgtgccatccgtggccggagtgtgcgacccatgatgtgatgggggaatgatgcctgccggacacggtgctggaggcctggcagagtccgacgctgcgtcccggaggtggccgcatgtggcccccaggctgctagggccgcaggccgggactgtggccgctgagcgctgtggccgcgaatgccccaaaccggccctgctttggggctcaccggcagcataccagaggcgcgggatcgagactggatggtgccctgctggccctatgtgatgaccgcatgctttgtcctattcgccaccccgacatatccaaccgctttgtgaccgcagcctgaccgcaccatctggtcgggggatcgacgaactcactttatggaaccacaagtggggcaagtttacctatagtcaacccgttacaattcttccttttgaactgtgcaccccgtccccatgtggcacatagcattgcttgaataagggatctttggccatgggcctacccctgaagatgggcactacggcattgggttaaccttttcgtgtccccaaacaacagcacctggtgggactaacaattcattgaacgccattcaacaacgtcttacccttggcgcacattggatgcaacgcagtttacccttggttggcaattttcccttttgaggcttacccattgtggctttaggatacccacctcattttataggcacgtataacccttccgacgcttggtaccataggggaattacttaggacccaatagtgcttaccacgctatcgttgtcgggacagtgagccaccttggcgtgtcgcaaccaaggtccgtggccacctgtccactattcaagccagtttatgggaacgagccggggacaactgtccccttcagtacctccagatgtctacacgctaaggttaccaaattacccttgtacctatggagcccccatcaactccagcttggaaagtggatacacttatcactaccatatgggtcgcttggtcccaaagtcgctctgaacgcatg

SEQ ID NO: 723597 - DNA, 1359 bp, Homo sapiens
  misc_feature (428)..(428): n is a, c, g, or t
  misc_feature (1029)..(1029): n is a, c, g, or t
atagggtgttgtttgttgtctccttctggtgggtgcccccgcttgttcgcttgtgttgtggtgtttcaccgaggtgtctagcgggggtcgtgcttcttctcctcgttggtgggcgtcgccacatggtgtgttgatctcctgcccgtgttggttggtggattatctcgtgccgggggagtcgacaaataatttgacgagggggtgtacttatcacgcgtggtggagcacacgacccggttgtccgccgcgcaagaaagttgtgcgaggtcttcatccggcgaccctcccgggggggtgattttgaccggggggttctctcgtgcgccccctctctctctattctggggctcccccccgccgccagaaagtgcgcgctttttattagcgcgcgcgagcgctatttttacacctatatagagttgggcgcngtgtatacacacccccccttgtgttttgtggagcaccacacacaagagcgcgcataaacatcttgtgcgcgcgcagcagagatgacacccgcagaggatggagagagagtgtgtgcgcacagcgcgcgccttgtatatatgtgtgtgtgttggtctgttgtgtgtgtgtcgtgtgtcgtgtgtgtggtttgtgttgtgttcgttcgttttgtttgttggtgcgcctgtgagcacttctcacgcgagattttatacacacacatcttcgtgagacacgcgcgtgaagaggggtgacacacgccacagcgtccgcgcgtgtgtgaaagcgcggcagcggccacatctcgccgctcgcacacaagtgtgtgcacacacacaggggtggccccgcagaggagacctttgtgagatgtggcacacacatgtgtgttgtgttgtgtgtgttaaagtatgggtcacagttctcacacaatatatgagagagatgcgcacatgtgtgtgtacacacgcgagaagtgtgcccctcttgccatctctctctatatagaacgcgcacccccggcacactcttctctctctctcataagagagagaaattggnccacacagtgtcgctctctctctcaacacagtgccacacacacacgcggagagagagtgatgaatataccactctgctcttttctgtgtaaatatatagtgaatacgccaaatattttttaatatctttcccctctaataactctttttatatttgtgtttattttgaatagatagaagcctcttctggccccccctctccccctctttttttgccccccacctctgagaagtatgaaggcttttggtctccctgggaatgggtggagcgccaccccgggcttaccctgtaccctgacttgagaccccgttgaatataaagtgcaccccc

SEQ ID NO: 723598 - DNA, 429 bp, Homo sapiens
ttatcatccatggtgaggagggcagcagggggactatttcctcaggtgaggtctttagttaggcctctgagcccaagctaagccatcatatcccctgtgacctgcacgtatacatccagatagcctgaagcaactgtgaaaatatccttaactgatgacattccaatattgtgatttgtttctgccctaccctgactgatcaatgtgctttgtaatctccctcacccttcagaaggctctttgtaatcctccccacccttgagaatggacttggtgagatccaccccctgcctgcaaagcattgcccctaactccaccgcctgtcccaaaacctatgagaactaatgataatcccaccacactttgctgactctctttccagactcagcccggctgcacccaggtgaaataaacagcctcgttgctcac

SEQ ID NO: 723599 - DNA, 969 bp, Homo sapiens
cagcgagcgctgcgtctcgatgtcctgagcccgtgcgtctgtctgcgatccgaggcctccggctgcgcgtggattctagcgtgcgaaccggagaccatgggcaaaccagcacagggtggcaagtaccggggtctccatccatgacttcccaggctttgacccctaaccaggtatgcctgaggctcgtgtacacgtggcatgaagggcttcggcatgtgacaaggaggccatatgtgacataatcaacctcagggagcaacagtgcatgaggcagtgatggtcgtgccagatgcatacagagatccgctctactggcaaagtgaccatcactttgctggagtttaacaggtatgagattgagcggagcgacacgctttgagacgtgttgagtatgctgaggccgtgagtgagggccacgcatgcacttagttgatgactgcctaaatgcaacacttacacatggatggccgaatctctgtgggacactagtgcctagctgcatcgcaagcaaagtgcccgtcgagttgaggatcttttggcctttgccccggggacaccacagtggaggccgaaggactggccacctagttgtgtggttgagccgacggcaattaccagacatgattagtccttaacaggacgacggggggaccccttggccatggcctggagcgaatcgaatatcgaggcagaagaaacacattcgtaggtacccgacgcactttcgccaggtacaacgcacttgagccttgtggctagacgcatcccaccatggtccattcctcgaccgaggggtaaaacctcacgcaggggcaaccggcgacggaggagttggaaccagggtacatggcctggaccggcctgaagggggaacctcatgggggtataatcaaaaagccaggcgggcagagtggatttcaccaggggggacccgcgtatagataacgccagaaagggcccaatgtggag

SEQ ID NO: 723600 - DNA, 246 bp, Homo sapiens
cgctatctgtggtgtaccgtggctgtggaggttaggttgatcctcagcctggtgcagtgggtttaaaggatcctgtcttaccacagctgcgggagtagatcacagccgtgggtttgccaggtcccaggaacttctatatgtctaggggtaacaaacaaacaaacaaacaaacaaaacaaaacaaaacaaaaaaacagaaaacaacaaaaaaacctgcagtggctcagttggctgtggaggtatagg

SEQ ID NO: 723601 - DNA, 133 bp, Homo sapiens
ggctggctgtgctggctgtactagctgggctaggagctgtggaggctgctgttatgtgtaggaggaacgccgtcagttggaaaaggagggagctgctctcaggctgcgttcagcaacagtgcccagggctccg

SEQ ID NO: 723602 - DNA, 704 bp, Homo sapiens
  misc_feature (9)..(9): n is a, c, g, or t
  misc_feature (74)..(74): n is a, c, g, or t
  misc_feature (76)..(77): n is a, c, g, or t
  misc_feature (87)..(87): n is a, c, g, or t
  misc_feature (106)..(106): n is a, c, g, or t
  misc_feature (122)..(122): n is a, c, g, or t
  misc_feature (138)..(138): n is a, c, g, or t
  misc_feature (143)..(143): n is a, c, g, or t
  misc_feature (258)..(258): n is a, c, g, or t
  misc_feature (260)..(260): n is a, c, g, or t
  misc_feature (266)..(266): n is a, c, g, or t
  misc_feature (276)..(277): n is a, c, g, or t
  misc_feature (289)..(289): n is a, c, g, or t
  misc_feature (299)..(299): n is a, c, g, or t
  misc_feature (318)..(318): n is a, c, g, or t
  misc_feature (383)..(383): n is a, c, g, or t
  misc_feature (443)..(443): n is a, c, g, or t
  misc_feature (502)..(502): n is a, c, g, or t
  misc_feature (598)..(598): n is a, c, g, or t
  misc_feature (604)..(604): n is a, c, g, or t
  misc_feature (616)..(616): n is a, c, g, or t
  misc_feature (618)..(618): n is a, c, g, or t
  misc_feature (624)..(624): n is a, c, g, or t
  misc_feature (627)..(627): n is a, c, g, or t
  misc_feature (632)..(632): n is a, c, g, or t
  misc_feature (640)..(640): n is a, c, g, or t
  misc_feature (666)..(666): n is a, c, g, or t
ggcatctgnggctgccacactttccaagacagacaaggggaactctccaagcagaggggaaacaacttccaggngnngcgcttcaanggcgctggggggggggggngggggggggggcggcntggcgatggggggggngaccnggggggcgggggtctggcgggctgggcacacctaaccctcatctcctggtgactggaggtcacactcccttcttcaggggtgccatgcagactctggacaatctaacaggcgcangngtctcncggggggggnngggggggggggngggcatgggntcgggtccctgggggtggngggggggggctgggggggcttcccctctggtggggggggtggccggcctgggtccttgcgttctnaaactctaaagtgcttataggaatcagctgggggtcttgctaaaatgcagggtctgagtngggaggtatagggtgaggcctagactctgcattcctaacaagctcccaggtgtcactgncgctgctggtccacagaccacactttgagttgcaaggctctggtcatacattgtgtttgtgcacatcagagaaggatgcctcttcttcaacaaggnggaacnccactccagggnanaaggcnggnggggncagcgcanctgcacaggacttcagcccccacttncccccaacacacacagatgaactcggtagctctggaga

SEQ ID NO: 723603 - DNA, 402 bp, Homo sapiens
tgtattggcacagggaccacacaccgtgccagatcctctctccataccctctccctgaggcagtgggcttgtcttgcagaggacgtggtaccaagagaatggcagatgtgattttccaaagatgacagcaagaggctcccccatatcccagatgctcatcttacaatgtgacttggacactccaagtcacatgggggggtacggtgttctctgcccttgaaactggtgtgggcccgtgactaccagtggaagtgacaccatgtgaccttcaaggctaagtgataaaggatgaaacagcttcttgctttgtctgcttggagtgttgcctttggggatccgtgggtggcaaatcttgaggttggcatgcttgtgaggaatcccagggccacatggagaggcccc

SEQ ID NO: 723604 - DNA, 304 bp, Homo sapiens
tggacttttaaaagaagtaagcctttatttccttgtttggcaaaaaaaacgggctaagtgggtggcttttgggggattagccaaagagaccaaatcccatatcctggtccgactcctccgacttttctttggtttcaaccttagctggggctgcagcagcagcaggagcagctgtgggggcagcagccacaggggcagcagccacaaaggcagatggatcagccaagaaggccttgaccttttcagcaggggggaaggtgtaatccgtctccacagacaaggccaggactcgtttgtacccgtt

SEQ ID NO: 723605 - DNA, 311 bp, Homo sapiens
cactaggggagatgcacttgcgtgatacccatggtaaacatggcaacctcccagtccaactacttccttatgataaaccacatagtggataattaactgaggtgtctcattgggagaggagacatcgtgggcaccaagcagatggaacagatttttatgtcccttcacgttaacgttgtggagcttctggggataaagaccattaagcacatcgtcatccgatggcagctggaaaactgtccagctctggcgaaacagtcgccgcacagcctcgggaatgttcgctttgtgttcaacaccgtcgtgctcag

SEQ ID NO: 723606 - DNA, 620 bp, Homo sapiens
agaaaaagctgtctatatcatggataccatcttcttctggggagaaactttcctgtttagctttactttaaggttgccaatgggtgtacagttccaagagtggaggggcccttttgagttgtgagattattaactcaaaatttcaaggtcccaaagtgttgctgcaatgtagatggcaagggcagtctttctctggtattctcagaagattcaatctttgtgttctagattttgaaggggttgattgtcctcagtcagcagactgtgaaaagctttcttcaccaggtggaaatatactttgacaaatagagctaatgttataacatcagccctcttgcatgggaaagcttttatacaaccagaagacatgcattgaaaatgacaattgaatgaaatctttctataaatgtttaaatggctcatcagctagcaaaaatgtacctgaaattttggttgtctttccaggaatatgggtttgaaaagccaacattggttgtaaactcttttagcaacatggaacagtcactacactaattaatacttttttttttattatactttaagttctagggtacatgtacaacgtgcaggtttgttacataggtatacttgtgctatgt

SEQ ID NO: 723607 - DNA, 791 bp, Homo sapiens
tgcagtggctcacgcctataatcacagcactttgggaggctgagacgggtggatcacctggggtcaggagtttgagaccagacctggccagatgacgaaccccatcgtctactaatagaatataaaaattacgctgggtgtggtcatgcacgtgcctgtaatcccaactactctggaatctaatggcaggagaatcgcttgaaccctaggaggctagaggtgcatggtgatgccaagatcacgccactgtcatctccagtctggtgtgacagagcgagcaagactcgtctcaggaaaaacactaacttagggaaagaaaaaaaaaatcgcacatggggactgacctttataggggagcctattgttccgattgggaagttccccattttggcctacgagacgggggagggaaaattaaccaactctgtgagccttgaggagtaacggaggaggtaagggtcataaggcaatcctctccgggctcccggtttcagttgctgaaccctttggaaacccagacaggggaccccgggataaaccgagattcctcagtctccagaagactacgtatatagtccattggacggatttatgggaactcgggattaggcatagtcctaactaaactgggagaattctcctttaacgtggtccccttaaaaaagtaatcaggcgaaaattttcatcagcgaatggtgcattacgggggggatttccaagtttgtgaattttccctcttggggattcgtccagaaggtcccgaatgggaatgtgccacggggtattttacg

SEQ ID NO: 723608 - DNA, 198 bp, Homo sapiens
cttcagccaccagactcaatagctcatcaaaccgcataccaatgcgtcgtaatctgcctcgttttcctggcttgcgcagacaaggcgaaacgaacgtgccagtgctctgccggcactcgcataagtgcgctcatctgattttttccttccatttgtttttctcataatcacggacgcgggtgaagggtaccgagctcg

SEQ ID NO: 723609 - DNA, 203 bp, Homo sapiens
gctgttcagaggagtcccttactcttaagcagaggctggggacatcggatgaatggcttcccctcatgtgatgcctctgtcctagacagtcctaggcgatgtacacgaaggatactattaagcatcctacagagaaaagatgaagagaacatccaggtcacactctaagagttcatgatggctagcatccggcgatgatggga

SEQ ID NO: 723610 - DNA, 239 bp, Homo sapiens
tgttactccaccaggatacctgcagaaaaacctctcccatgcggtctgcgaaatgctgctctgctgagatgggcacaaagcctgtggcagaagagctggattggagtccagcgaggtgctgaccagttgtgcaatcctgcgggcaccgccaaggcctcggctctcccacctgcaaaatgtcctatctgctcacaggtatgcacagggccactctctgcattgagacacgcatatcaggc

SEQ ID NO: 723611 - DNA, 296 bp, Homo sapiens
  misc_feature (95)..(95): n is a, c, g, or t
  misc_feature (198)..(198): n is a, c, g, or t
tggctccagggaaacctgagactgtggccctcgtctctgctgagcgccacctttggacacaggttgtggggtcctcactgcttacctgggctctntgcaccatgtcccttcctaaaggaggaatgagggaaaggagcccaccgggactgcagaccaggccatgccacggcctctctgctagacactcacaggccccancccaggagggcaggctctgtggggaagtggatcacagtcccgagagcctcgcaatcctgaaaaaacaaaaccccccaaacctaaaaaaaaaaaaggga

SEQ ID NO: 723612 - DNA, 462 bp, Homo sapiens
ggcgagattagtggtcagggactgcatctcatcgaaacagttagtggcgacgacttgtgactgcttctggtgtcagtaacatctgtgccccaaatcataactgccaagttcttcgtgtacttggaatctccttgggttacttgtagctggtgccatttctcctcatcgacccaaatcccgcttcccagatggaccttgccattgtctaggatgtacttgtccatgacaggcgcaggagcggggtaataggacgacgtatttgcttcctcactgaaagtgctccgtaactccggctcgggctcgagacattctgactttactttttccagatcaatggcgggaccgctgccaagcctcaggagcagcacgtcctggagcctccggttaaggtcacggagctccttcatttcagacacaagtgccccgtactccttgagcttcttggcctgttgtaccagctgc

SEQ ID NO: 723613 - DNA, 941 bp, Homo sapiens
  misc_feature (298)..(298): n is a, c, g, or t
cacatgacagtctcacccaggataccacatgacatttgtcattatgtctccttaggctcctcttgactgtgacagttttctgtgccctatttttcaatctgctttgagctactttgcaagaggtgctttttcctttctttctttctttctttttttttttttttgggagcacggggtctcctctggttccccaggcgcctagatgttgcggggccccacaaacccaacaggtttaattggcaggctttagaacctccttggggcctcaagggggatctctccacacttaggcctcccnaaggtggctggggatacaacggtgtggttgccgcccaccatggcttgggtcctttttccacttttttggctaaaggcgcctggatggttgggggggtcaaaggcgcggtccattttcttcataaactccttccgagtcagcaacctttggcggagtactttcaccaggttgggcgttcctgaccttattgacacgaccagggggatgttgctttcccccgggtgctaggtgctggcccaggctttccatgggccttttggtacctgcagatcctggttccagtaggtcccaggcaggctgagattttggttcccaaaaaagttccccgttggccccccaggctggcagagcatctggctggcgggaatcagacccttagatggcccagaatccaatataagtggcggggaaacccagggcaccgcgcgcatgcagaacaggttgatacttattttcacagctggcctcggaagcgggctcttcagacacaacacacacgggggggcgggggcaggtgtgaacccgacttgcggccgcgggggaacactgtggcgagtgaacgcgccaattttggagggcgcggctcaaaacaaaggcggcggcgccagcggcgggaaaccgcggggaacaccgggcaagaaat

SEQ ID NO: 723614 - DNA, 242 bp, Homo sapiens
tgactcgtaccgacgctctctctgtgggggagggcatacccctcgtaatgcacagtgtgggtgaccccgtcaccggagtcatcacgatgccagtggtacggccagaggcgtacagtggatagcacagcctggatagcaacgtacattgctggggtgttgaaggtctcaaacatgatctgggtcatcttctcgcggttggccttgtgggttcaggggggcctcggtcagcagcacggggtgct

SEQ ID NO: 723615 - DNA, 106 bp, Homo sapiens
  misc_feature (4)..(4): n is a, c, g, or t
taanctctcccaccaggtgtggcggctggattgttgggtggggagaggtgagatgagcagccttgtgtgctttaagcccagccttcccttcccctcactggtctct

SEQ ID NO: 723616 - DNA, 236 bp, Homo sapiens
gtgaccgtgacgcaagggttggtcatccccgcgatcatcggacaatccgccgccttggtgcacgtctggccgcagtacgtcgtgcctgcgtacgtgttcgttccgaggcccgtctggcagccgttcgcgccgaccgcctcgccgtactttccgccgccctgagggccgtcgcagatggtcacgagacgcttgtccgtgatgtcttccgtcagcgtgcagaggttggtcgcggtgca

SEQ ID NO: 723617 - DNA, 357 bp, Homo sapiens
tcccacctgctgttgcctgctccctagtgtacaggttagaatataagggcccttagaatcttcctaggcagttcattgcctatatgaggctctccagcttgcatgaaaaagtcccttgtggaatttcctcaaattagggtttggcaatactgcaccgtagtcaataccttctagtgtacagctatgggtggtgaaaagagcaaggcctgggaataaagagacctaagctctagtcccattgtagctccaaacccacttgttacatttttggcaaaccacttgccctttgtaggcctaagattcctcatctgtgacatgagggtctgacaatgtaatttatatccctcttagttaaaa

SEQ ID NO: 723618 - DNA, 254 bp, Homo sapiens
gggcccccagaattaaaaaaaaaaaaaaaagaatccccctggggcaacttaaaccccttttttaatttcccccccccccctccccttttttcccccccctttttccaagggggttgggttggcaaaaaaaaacggggaaaggggggcgggaaaaacccgccaaaactggttttcccccaaggattgggggtcaaaaccccgggatttaaaaaaaaaggggggggggccttaaaaaaaaaaatctttctttctta

SEQ ID NO: 723619 - DNA, 1083 bp, Homo sapiens
  misc_feature (633)..(633): n is a, c, g, or t
taacccctccttagctttatgcgcgcagaaaaccaaattaacccccccccccttttaacggggtggtgcagggaaaaaaccaaaaacgccaaaaacccgtgcctggatgaccaccactgtcattgccccccgcaaatttaatccgccctgataaggagaattattgtatttccattcttgctcccatgtgagcatggaggattagaatatttgagtgagtagtacgccctcactgtgggtggagcacatggcacatttgacgcccccttatgtgataaacatcaagagagtggagatggaagaagtgccacttaggtccagagcacgggagcatctcatgagggagaccaagagggctgctggcgagctcacccaccagagaaagtgctcactaagaaagagcgaacgagatcgtgctaggtgcgtgatagagagaacaaaagcagtgcccatcaatacaaggggtagctacaaagagagagaggtatagcatccagaagagagcccacacaatgagaaagagagtgcgcctaccatagggataataagggccaattagaaggagcattcaggcccatgaaaatgtgagcacagggtgcgggacataacgcgatggtgtgtgtctctacaacnaccgaggagggtagatcacccaaatacaggagcaagtgagggtcaataggtgcgttgcgacccagcacaataacacgacacaacaagtaaggaagaagaaaaacaccacagccccgcatattaacaagcatacagaggagaaacaaaacttagaaccaagaccacacatagaaaaaaacgacgatggacgagagaatcacaccagagaaagacaccgaaagacaccacgggaggcaaaacccacctgaggggcgaaacaaagaatggcggaataagcgaaccagtcagaaacaggacaaagacaagacaaggagatcgtgaacaccccagcaaaacgggaaaagaagtgagatggacgagaccaagacgaaaacgaggatgatctcggacccccgcagaacccagaagctcgaggtgaaaatcaataacgagaacaccacgagagtgacc

SEQ ID NO: 723620 - DNA, 694 bp, Homo sapiens
  misc_feature (35)..(35): n is a, c, g, or t
  misc_feature (73)..(73): n is a, c, g, or t
  misc_feature (79)..(79): n is a, c, g, or t
  misc_feature (92)..(92): n is a, c, g, or t
  misc_feature (100)..(100): n is a, c, g, or t
  misc_feature (104)..(104): n is a, c, g, or t
  misc_feature (109)..(109): n is a, c, g, or t
  misc_feature (113)..(113): n is a, c, g, or t
  misc_feature (127)..(127): n is a, c, g, or t
  misc_feature (131)..(131): n is a, c, g, or t
  misc_feature (150)..(150): n is a, c, g, or t
  misc_feature (153)..(153): n is a, c, g, or t
  misc_feature (163)..(163): n is a, c, g, or t
  misc_feature (168)..(168): n is a, c, g, or t
  misc_feature (170)..(170): n is a, c, g, or t
  misc_feature (195)..(195): n is a, c, g, or t
  misc_feature (244)..(244): n is a, c, g, or t
  misc_feature (272)..(272): n is a, c, g, or t
  misc_feature (291)..(291): n is a, c, g, or t
  misc_feature (314)..(314): n is a, c, g, or t
  misc_feature (331)..(331): n is a, c, g, or t
  misc_feature (369)..(369): n is a, c, g, or t
  misc_feature (376)..(376): n is a, c, g, or t
  misc_feature (389)..(389): n is a, c, g, or t
  misc_feature (391)..(391): n is a, c, g, or t
  misc_feature (394)..(394): n is a, c, g, or t
  misc_feature (551)..(551): n is a, c, g, or t
  misc_feature (563)..(563): n is a, c, g, or t
  misc_feature (610)..(610): n is a, c, g, or t
  misc_feature (685)..(685): n is a, c, g, or t
acccacaggggaagttgggggcagacacccttctnttccggtacccttgaacatggtgtcagggtgtggctanctcganggacaccgaacanctccacangganggtantgcncaaggttttttgcntccnctaaaatgtcccgcacttnctnaatgcagctnaaacnangagcagctcccccaagatttttgtntgcttcatccctggatcaccatgtcaggtggtgtctgttcttaatatcnaagttcaggtttcacggtggcgtatggncagctcctccccatatgtntggttacaatatgtaaactgggnttgctcctcacctagcntgcaggaaacccttggtatctcacttattcaccttctnctgggtnttttgctcaacancnaanttctttttcacttggttgggtcccagcatgaacatggtggcatggcgggccctggcaccatggagaacagcctgctgccagtgatggcctggatctccaagacggcctccagcactgtcatgcccttgaccagctagtgctggtacaggacctgggnaacaggcatgtncttgggcgtgactggctcaggggcagaggacgaggttgaggaggaanctggatacccctgtccatggtgggctggggctggaagggtggctcagtggcctcgaagtgccgggaggactccanctggcacca

SEQ ID NO: 723621 - DNA, 800 bp, Homo sapiens
  misc_feature (252)..(252): n is a, c, g, or t
  misc_feature (431)..(431): n is a, c, g, or t
  misc_feature (564)..(564): n is a, c, g, or t
ggtatgaccttgaaccctcgacgaacgatgatggcggattctctggtaaggctgaagtggcgtgtgtggtgccctaggaggggccgtaagctctggttgccgttcggaaatccgagcttgtgctcaagcacgcgtgtctcagtatctcgaggcgcattgacgttcacgagaccggacgcgtatcccaagaattggtgtcgtgagtcgcaagcacattatcgacttttgctcacctcgatgctaggactattntctcggcgtccaagatggcatgcttgctcttcacgacttgggaatcatcttgcagaggacgggtgtgggtccgcgtcgttatgggctccaatggagtcattgcttgtccaggcatgcatatgattgttgatatccgtgagctcattgcttatgggacttatgtcgccattggactgcangcgccatcgattcctctccaatggtccacatgcgtgtgcccgtgagacgacatgtattgtatacctcgaacatcatggttccataggggagatggccatatgcaagataagcttcgcgcagaggtgcaagagnccttgtgtcacttgtctatgctgtgtaagactattgcctggagcgcttggcgaattgacacatcgtagtcatccgactagtagtgcgaatcatcgcgacaagctgtttgaccaaagcttgtggagatgctctggaccgtgtatttggacttttcaatatcttggatagaacttgatgtgtatagccctctttttgccatcctgcattttcgtctgtgcccaattaacgcgtcaaca

SEQ ID NO: 723622 - DNA, 606 bp, Homo sapiens
agcgggcgactcgcggatcgtcacacggtcaggccacgcgcgtcaacgccccgggctctgctaaaagtgcggggtcagattcctttcaggtgactgggttgggaggagaagtcgctcacgtaattgtcggagccgaaataaacagagactccgcgtcgggcgtgacttacccggaagtccccaaacagcactacccttcgctgaaacctcgggcgccccgtcaagccagcagaccacgggaaagcagtcacggccagaaagccgttggaacaaactccacaggatactctcgcgggccgagacaggactcccataagttcacgcgcactggcccccgagggattgcacagggctgaacgcagaagggcaacacggtggaccttgcaagcaggggtcgaggctggcgccccagccccggagccaaggagtacccgggcagcggaccctccccagaaagggcggagccgacgagcactcttcctaactgaccggagcgcgcagcctgctgccgaggccacggagcctgtcctgctccatccggtcctcctggcgccgggggtgctgaaacagcccgggggacagtaaagccgctccagggggagccca

SEQ ID NO: 723623 - DNA, 888 bp, Homo sapiens
catgtagattaccgtgttcgcgtgcgctcatgcttgtcgtctgtagcgcggcgtgttcctgtactgtttgtcagttggcgagtgtttgtggccttggtcctttccttagctttcccccgtggcttgcttcgcgcgcggtgctgggcgttgttaccgtgccgttgtcccctccgacatgggtccccgccgtgatcctgggcgcatgtttcccgccctggtcgttggcacccagctttttgtgcttgcaagctttcctcgccgccagccgcgtggtgaaccgcattgttacccaaaccctgaggttcacgggcccaacaatttcaatattcgcgcccgggattcaacacccaatagaattgttgtctgtagtcacaacctcctaatttctggacgcagctcccaccgctgcgaatataaaatccttctttctaacagagacgttccacaacacttactcgcccacccaataaaagcggttgttgaggagcttttttagcaaaacgctctccgataaacctctgtcccttatatccccccctcgtttaacagctccgggggaaatcttctgtggtatattgaacaccgcgtttgtctgaggcacaaaaattcaccttttccttccgacacggagtctccaacacatcatcttgtgccgaccagccctataatagaccctcctgaacataatttttgtacccaaccacaacacaattgggggcgtcacacatcaaagcaccccagcaacggttagccacaacaaataaaacccctccgttgtacgccccgaggaacaacccgctcacaggttgcattaacacacctgttccccccttttcccccttttcccccaccccccaacccttcccgggtttcccttttaaaaaaaaa

SEQ ID NO: 723624 - DNA, 424 bp, Homo sapiens
gcggaattggcgcagtcttaaaccacaggccacagagctggagctggatataccatgaaagacttctgaatccaggaagagagactgactgggcaacatgttattcaggagatggggtctcaccctgtcacccaggcttgagtacagtggtgctatcacagctcactgcagccttgaactcctgggctaaggatcctcctacctgagcctcctgagtagctaggactggtctccctctgttgtccaaggctggagtgtagtagtgctatcacagctgactgcagcctcaaccttcctggcttaagcaatactctcacctcagcttccctagtagctggaactacaggcatgcaccacaacacctagctaatgcttgtagatatagggtttagccacgttgcccacgctggtcttgaactcctgg

SEQ ID NO: 723625 - DNA, 179 bp, Homo sapiens
tcggacccctttagatgatctgcctgatggagacagatgaatgagagggagagttatcggggactccttcagatctggggaccgcttgggcccacattgtgcccgggtgccgttaatctgctggccttgcccacacaggtgcagccccgacggtatctgaagaagctccccctcatagg

SEQ ID NO: 723626 - DNA, 140 bp, Homo sapiens
aaacctgggcctctcgctcaacgaacatcccgctcaaccaataaggcatgctcataaggaaaggttaaaaaaattaaaaggaacccggcaaatcttaccccgcctattttacaccaaccccatgttcggttgagcggaga

SEQ ID NO: 723627 - DNA, 100 bp, Homo sapiens
cgcgatgactatcacctcctaaaggactagaggaaggcatcaaacgctgatggggaggctggaagactggcagccgcgggactgggcagatcctcaagca

SEQ ID NO: 723628 - DNA, 381 bp, Homo sapiens
  misc_feature (9)..(9): n is a, c, g, or t
attcgcggncgcgtcgacatagaaactagagcatagcttccataagattatgggcaaatagtccaggcacggtggctcacgcctgtaatcacagcactttgggaggccgaggtgggcagatcacgaggtcaggagatcgagaccatcctggccaacatggtgaaaccccgtctctactaaaaatacaaaaaaatcagctgggcatggtggcgggctcctgtagtcccagctactcgggaggctgaggcaggagaattgcttgaacctgggaggtggaggttgcagtgagcagagatcatgccactgcactgcagcctggtgaccgagcaagactccgtctaaaaaaaagtcgacgcgggcgcgaatttagtagtagtagtt

SEQ ID NO: 723629 - DNA, 141 bp, Homo sapiens
cttattgtggacctcttactttttgttttatttatttatttattttgagacagagtttcgcttttgttgcccaagctggagtgcaatcgcacgatctcagctcactgcacttcggcctgagcaataagagcaaaactcctc

SEQ ID NO: 723630 - DNA, 180 bp, Homo sapiens
cggcacgaggctgaccctgggccctgagaagggagcagcgggtggcctcagctctggttgggttgggctgttccccgctgagggttggttgagtctccaggctgagtgggagtccccagactttcaccagttcagagcaaatcttttgagtctttagaaggagttccttgtaaagaccca

SEQ ID NO: 723631 - DNA, 888 bp, Homo sapiens
cggacgcgtgggtcgacccacgcgtcgattatcctcctgcttgcaactaatagcaacagcccttcataggctatgtcctcccgtgaggccaaatatcattctgaggggccacagtaattacaaacttactatcgcgtcagtcccatacatgtggacagacctagttcaatgaatctgaggaggctactcaggtaaacagtccacagccctgcacacgattctgtataactttcacttctatcttacccttcattgattgcagccctagcagcagtccacctcctattcttggcacgagaacgggatcagaacaaccccctaggaatcactctcccattccgataagagtcaccgttcggcacgcctgacgtacacaatcaaagacgccctcggcttacttctcttcctgctctccttaatgacattaacactattgctcaccagagctcctaggcgaccagacgaagtgtacaccctagtccaacccgttaaagcacccctccgcagatgaggcccgaatgatatttcctattcggctacagaagttggtccgatccgtccctatacaattaggaggcgtccttgtgctgattactatccatcctcatcctaggaataatccgccatcctgcgtatattgccaaacaataaaagcagtaaatatttcggcccagctaaggcagatcacgttgattgactcctagccgggagaactactcattcttaactgaatcggaaggaaaacagtgagctacccttttaccgcctgggccaaggtggcattcgtacataggttaaagaaatctaagctatccgactaactcctatggaggaactatccatgggtaaaaacacaacggacaaccaagagacacgggggcgtaaatc

SEQ ID NO: 723632 - DNA, 789 bp, Homo sapiens
  misc_feature (437)..(437): n is a, c, g, or t
ggggctgcgcgcgtccctctgggtgagttgtttttatttttgggatccgtgcttctgaccccaaggttccacatctgccatctgtgatagaacctgctcgctcaccagtgcccaggctctcggggctcctggttgtcctctggtgcaccagctcctgctgtccttcacggttctgaaaagattctccattttctgtcttgtttcagggctgcaatctagatgttttctttctattttattcattctcttttcagctgaagtaatcttgtttaatgcagccaccaaggttttattttcagtgcctatgtttttaactctagaagctcaattagtttattttaaattaattttttaatttaaaagagatggaatctcacttcagaggggtaaaccttgtgtgatgtaggtggtgagctagtttcttcagcacagatatngtttgcttctgtgagagccatgggacaccatgggcctcagagagctgcagcctatgtgggaatcgagtccactctctcccaggtgccgctcatctcctggtctgtccatcctttcctcccaagaacacctcaatggtttctagctcttggggtttatattacgttttggggtcctactatttatttacttattttattttcgagacaggttcttcgctccccaaccaggtggagtggcgtggcacctcatgggtaaccaagctcaagcctcccgggttaggatcctctgccaaccccagtttggggcccaaagccctgctgcacccggttggatccaaaaaggggccaatcg

SEQ ID NO: 723633 - DNA, 518 bp, Homo sapiens
agttcgcacaagaagataacccactttatattacacatatcgcagacacatactaatgtaccaggaactacaaactaaggcaaatgaacaagctgacttgcatagatatcatctgccttcatggaagcaacaagaacttcaggccctgactcatgtaaaatgacaacaggattaaaaaccaaatttgatctcacatggacacaagcaaaaaatatagtaacaagattgtgctcagaagtaacgtcttaacacctgcccaatcaagaggcaggagattacatcctagaggtaaatgtcctgaagccattatggcacaaatgagaaaatcacacatgtgccttcatttggacaaactagtcatatagtccatgtgaccgttgctacttctacacacatacataatgggcacacctgccagaaaggagaaagtaccttcccatgttaaaagacatttattatctagtaatgcagacatgagcagttccagacacaattcacacagatcctaggcccggatc

SEQ ID NO: 723634 - DNA, 114 bp, Homo sapiens
tatactcagaacgaaagtcggagttcgaagacgatcagataccgtcgtatatcgacataaacgatagcgacgggatgcggcgggttatatccatagtaccggcggtaggttcgg

SEQ ID NO: 723635 - DNA, 124 bp, Homo sapiens
  misc_feature (28)..(28): n is a, c, g, or t
  misc_feature (41)..(41): n is a, c, g, or t
  misc_feature (60)..(60): n is a, c, g, or t
  misc_feature (86)..(86): n is a, c, g, or t
tttatgagtctaggaatcatatcaagancatctcaaaatanataaataatagaggcagtntctgctcaagaacgagaacacccgcnagtaattgtgcagcttcctctcattccctgctacttgt

SEQ ID NO: 723636 - DNA, 136 bp, Homo sapiens
ttaaagtcatatgtctgatatgagtatgcaactcctgcttactgtctggtccatggcatgaagcattattcccatcccctcactttcaatctataagtgtcctttgccctaaggtgagtctcttgtaagcagcagg

SEQ ID NO: 723637 - DNA, 1433 bp, Homo sapiens
  misc_feature (1148)..(1148): n is a, c, g, or t
  misc_feature (1151)..(1151): n is a, c, g, or t
ggagaagcatgtggcaccgacgaccgttcgtagcgtagcgagcttgcgcgtggcccctggaggagcatccatctgctgttgacgcgaggccccgccttgtaacccgcaagggacttaacatgagacgaagtatagacctcacgattatgttcttgaagacgcttcaaacacgcgccggggcaatagtacagtagtccatccaaggcccgtgacttgtcccgtcatactgcactctgcgtgccgacactcatctgagcatatgtacactgtgcactcattggtagggacggcgggtcacacgcggcatcgaggtagccccactcatagcggaagtgtgcctaaagccgctgcctcctcgacggcgcgattccacttgccgctcttgtgtagctttaggtcgtagtgctcgggtgtatctgacctcgagataagcgctcaattgtataggaactctcttcacgtggatgcccgtagggcattagcgaggactctctgcgacctacctgggcccagacgtcgagcgaaacgtcggtgcccgacgaacagtacagaggacgtaacgctggtggctatcgtacgggccttgggactttgccgctaagtgagggcatgtattggcctaattcggaccagacccatggccttcacatctttgtcttccttggggcagtcaatacgagaacataacaagaaagacctcgatcccagaaatcgtgatcgagagattcaattccatcgcggaatttggtggtagatagaagtcagcggtttcgctgggctaggtgccatggacaggagccgccatgttctccccaaagtcggcgtgttcgctttaccgttggggtgcctcagttgtggaccatttcgttttcgccagaggcaagttcacgaccagaaaaggaactccatccctttccgagacctttcccaggtctcgacgtcgaagaggtaggttagacaccgtgggggtaccaattcggtgacttgggaagaaccctgggttacttagaccctaagccaaacgcgtgtgcctggaatccgcgggagccggggcaattcgggggccaaatcgtcaacccggggagtcatgtaggcccacagcggatggggacattggcacgataacgtccgacaggaattcaggcgcngtncccactttggttgcatgccctcatggttacgagacagtggaaacgaagattagagggactacgagtccggctagctccactcgaggaagaccgtccaacgctaacatccgggatcgttgcggaattccgcgacgaggcgtccacaataacctcgtgttggccgtacacattgctactcacaccttgtccactgtgctggacttttagcgactttataacgcaccggcatagggaggtaatagaataaggttgcgcgagccccgttcccatacagattcacag

SEQ ID NO: 723638 - DNA, 600 bp, Homo sapiens
ggcggggcgcggtggctcacgcctgtaatcccagctctcagggaggctaagaggcgggaggatagctgtgagcccaggagttcgagacctgcctgggcaatatagcgagaccccgttctccagaaaagcggaaacaaaaaaaaaaaagccaagaggaccaaaaacaaaacaaaaaaaaaaaaaaagtggtggggggcgcgctctggggccccgggaaaaggctttcaagaaaccacatctcggggtgggacgcgacgcgggggggccccacaagtgagtgggtaacaggtgagcaacctgggggcaatagaggcggggttccacacaaaggagagaccccggggagcacagagacacagggggcgcggggagtctctcccacacaaataaaaaaaaagaggcgccgggggggggaaacaccggagagcgtggtttctcgtgagcacaacaatttcccacagcgagggggaggtatctacgagagagggagacaatatacaggggggagcagtttatataacaaagggggaggcgcacaagagaggaaggacccaagaattttcacaaatttaacgcccgggagtctggtgggtgggacac

SEQ ID NO: 723639 - DNA, 342 bp, Homo sapiens
ggtataccgtcaattcccttaccagaacggacaggcggactccacgggactgggaggggttcagctaagagtcgatcgaaggtgaccacgaggttaaaaacagcggatgatgccaggtgccaagaattttagatttttacttgggcaaatacgaggctgacggcatataaaccaaaagaatactttcagaataggggactctttaaaataagcaactgagtaatactttatccgaatacagaaactggagaaaagggatccgacctcagaaaactattctcttcagggacggacggtaattggcatagagttccctggggcgggcggtgttttgttttcttt

SEQ ID NO: 723640 - DNA, 806 bp, Homo sapiens
attaatgaacataatataacgaaacatatgtcaaacgctcgtcatgatataattgatgtatccattgtgtcgtatgggccagaactttatgattcaggacatctgctcaagccaaatgagcacagagctaatgaacatgtccatagggcgacatgtaagctatgaaagctaaattgtctcgtgcctacttcagacaggggctgtcgtgtcatgtctggagtctttgagtcacagaaactcagggaaagtctgtcgtggcatccaagaagatacatagcagattagggatgtggttggatcacaaggtcacattatatgcaagatgtttacttctgctagaatctcattatctgtattctagcttaccatactaccatcgtgtatctttaccaagaggatcctctgtgcgaagagcaatttcctggactgtctgtgaaaggaattttttctacatcctgaactatttttcctattatcttttcaccttgctttatattcatcctataatttgcttgtcatcacaatgaacgtatgttttgcgaatcatcaattctttctcattctccatttatcttgacaggtccttttggcccttattaacctctcaacttttattgctgtatactagtcagaccagaacatacgttccactacatcagttacttggcatcgatttcacctcagttatattattgccaaataataatttgtgtcagcatttgcacctattgggttattcatccaaaccccttggatctctttgagtctaactgataatctccactgggaaggtgggattgaatgtg

SEQ ID NO: 723641 - DNA, 126 bp, Homo sapiens
ggcccctcctttatggtgcgggaactttttttgtcttccctttttttttcttggcccggaattttttgtaaattatttgaagcaaatatggaaacttttcaataaaaataaagataggccccccga

SEQ ID NO: 723642 - DNA, 144 bp, Homo sapiens
  misc_feature (39)..(39): n is a, c, g, or t
ctttttcttttttttaaaaaaaaaaaaaaatggggcccntgggggtccccccccccccccccttttttaacaaaggttacttgggccgggaaaaatttgccgtctttggaattttaaaacctttaaataaattgggaaagggga

SEQ ID NO: 723643 - DNA, 632 bp, Homo sapiens
  misc_feature (567)..(567): n is a, c, g, or t
gggagagggggtctcagtcatccatgatacagggtgggtcgccaacggggtagtgaggtggaatgggaagaactagccatccttaagtggaccagctcaaatgctggtacctcccagaaatcttcccgggttcattctgggccacctcggtctcaacagccttgccttgcccgtggttctccctgacatggtccccaaggggtctttctggacatccgagagctgaccccatctctggtggacagcatcccaggggtccctaagcatgtaaggacaggtccagcggccaccatctgggccttccagggctcttccccaagcggtgtggcctcagggacctccacccaaccccatctcctcccttctctggctgccatcctcgggaggggacgcatccctcatcgggccacgttctctcaagcctcccgggcggtgcacgtgtcctttctttttcccttagaacttcctggtcctgggccaggcacaggggctcaggcccgtaatcccagcacttggggaggccgagaagggcagatcatgaggtcaggatttcaagaccagcctggncaatatggtgaaaccccatctctactaaagatacaaaaattcccaggtgtgggggggccgcctgt

SEQ ID NO: 723644 - DNA, 158 bp, Homo sapiens
gctagatggtagagtagggacagagagtcatcagcggtcggcttaaattttaaaaacgcagaatgggttcatccatctctccggtgatgggtctgagggcaaacaataaaaacaatggttttagaaaagggaattaaacacacacgaggggtaccgag

SEQ ID NO: 723645 - DNA, 230 bp, Homo sapiens
ccagctagtggtagtgagcagagcggatctcagtgtcaagagaacaaaaagaaaagcaaatactgtatgtacttactatgataagtgggagctaaacagtgggtacacatgaacacaaagatgaaaaccagtagacactggggtactccaaaactggggacgggacgacatcgggtataacggaactggaaacacctgccgtgtagtggtactagtgcgtcagatacacc

SEQ ID NO: 723646 - DNA, 389 bp, Homo sapiens
ccctggactatgtgttatggtccatgacaggataagcacagaacttgagagtaagcatttagaatattttatagcaatttgacatagtaattttatgtgttgaatctaattataaaaaaagggcttgggccaggggtggtggctcacacttgcaattcccagcacttagggaggctgaggcgggaggattgcttgagcccaggagtttgagagcaacctgggaccctgtctctacaaaaaataagaattagccaggcatgatggtgctcacctgtggtcccagctactggggaggctgaggtggaaggattgcttgagcctcggaggtttgagcctacagtgagctgtgatcatgccactgcactccagcctaagtgaggccctgtctc

SEQ ID NO: 723647 - DNA, 332 bp, Homo sapiens
  misc_feature (129)..(129): n is a, c, g, or t
  misc_feature (134)..(134): n is a, c, g, or t
  misc_feature (168)..(168): n is a, c, g, or t
  misc_feature (224)..(224): n is a, c, g, or t
  misc_feature (303)..(303): n is a, c, g, or t
ctccccacctgcatctgatcccgctggttcacttcctcaaacgataccctctcaaggagacctaccctacttgctgcaacatgcccgccaccacccagaatcccctgctccctgcaagttcccaaactnttgtnaccttttaacgtccttccttaagcttatcctgtntccctcactagagtgcaggctcctccagcaggacacagcccctaaccactgctttnctaactgctgcagggtgcctagcacacagcaggcacttttttcaggtgtgccagggtccagctacagctggtatggttncccagaggcagctgggggtgtgggggatt

SEQ ID NO: 723648 - DNA, 230 bp, Homo sapiens
acaatcagactggacgaagttgttgcacacgccgagtgtcatacgccgcaagtcgcagtggacgaagttgttgcgcaacaacttcgtccatcctgatctgatttgaagaagtgtgtggttcttcggcgtgtgctgcacacgccgaatctccacacaccacacgccgaatctccacactgcacacgccgagagcccagaccccttggtgcaccaggtcctgatggacgaag

SEQ ID NO: 723649 - DNA, 93 bp, Homo sapiens
gtgcaaatgccaaccaagattcatcgaacaggccacatcggacagtgttcacccgagccatcgaggcatgcgatctccactggcaggatagcc

SEQ ID NO: 723650 - DNA, 447 bp, Homo sapiens
tcctcgagacggattttttctgtgtttgccaggttggaatgcagtggcactggtctcaggttaaatgggaactcccacctcctggattaaaaccattcttcctgattcgcgcttgcaaggtatgtgggaatattaggcgcccacccacacaggcgtagcttaattggttttgcgatatatatagaaagaacaagtgggggcgcgggcgatcgtgggggggaggtggtgcgtggaggggtgacgcgagataaggaccggcgtcgcgtaggatgagagactgggtggagacggaagtggcggctcggaagggcgagagagaaataagaggaatatcggggggaggtggagaggggggaaggacgagcggtcgggtggagggggcaggggaggcaaacacgggacgacgagatgggtggagaaaggacggggcgagacagagaggggggg

SEQ ID NO: 723651 - DNA, 271 bp, Homo sapiens
ctttgaccatcaaaatgtaactctgtgttatgctgtttttgcactgctgggaggtgactgtatcatgggggtggttccctccatgctgttctcatgatagtgagtgagttctcatgaaatctgatggttttagaagtgttttggtagttcctctcttgctcacttcttctcctctgcctgccaccatgtaagacatgcctgcttccccttctgccatgactgtaactttcctgaggcctccccaaacatgtggaactgtgagtcaattaaa

SEQ ID NO: 723652 - DNA, 123 bp, Homo sapiens
  misc_feature (1)..(1): n is a, c, g, or t
  misc_feature (24)..(24): n is a, c, g, or t
ntacccaacccacgaagggcacgntgtgtcgcttctccccgcggaaagtgacaacgacgtgccttcgtcgctggtttcaggcctcagcgttcgccggcgaggtattcgtcgagggagagcggg

SEQ ID NO: 723653 - DNA, 248 bp, Homo sapiens
cgactagtcccaaccatactccactttttgtcgcttgtcagtctttaatcgtgggagggccttacgcacgcgcgcacgtacacacactcaggctttagatcttgttgaaagctgcgatgtcgacactctgtacgtgctcctcaaacttggtgatctccttcttcagcaagtctgtccccaccttgacgtgctccaccacacactgaatctgtagctttcggataccgtagcccacgggcaccagctcg

SEQ ID NO: 723654 - DNA, 349 bp, Homo sapiens
  misc_feature (12)..(12): n is a, c, g, or t
ctgagcgatcgntgcggagaacgagatgccggtgcccgtgggtccctacggcagtcccagcccagctgcttcgaccgcgtgaagatgggcttcgtcatgggttgcgcagtgggtatggcggccggggcgctgttcggcaccttctcctgtctcaggatcggaatgcggggtcgggagctaatgggcggcattgggaaaaccatgatgcagagtggcggcacgtttggcactttcatggccattggaatgggcatacgatgctaattagggctaggatgccctgcaatacctaaacttccccatccatttcgacccttgtacaataataaagttgttttcttctcgttaa

SEQ ID NO: 723655 - DNA, 142 bp, Homo sapiens
tgtcacactgaaggcctttcattgagtcagaggatctactgaggagattcttccatctctaacagatacatacgtactcagatatttctagaaactaagaaaatgccaggcttcagtgcctgaccgaggcttcagtgcctgc

SEQ ID NO: 723656 - DNA, 337 bp, Homo sapiens
gtcgacttgtgttttttttgttgacgacaggttcttactctgtcatccaggctggagtgcagtggcacaatcatagctcactataacgctcaaacttctaggctcaagtgatcctcccgcctcagcctcccacatagccaccacacccagctcatttttgttgtttttttgtagagactgggtctcactatgttgcccaggatggtctcaaagtcctggcctcaagtgatcctcccacctcagcctcccaaaccactgggattacaggtatgagccaccatgcctggtccaatttttaatcttttatactacattttttaactgtaccttttctatg

SEQ ID NO: 723657 - DNA, 309 bp, Homo sapiens
aaccatcacatgctctctgtatagtctacgaaaaacagagctaaaatcgatcattgaatactcttcagtcagccacatagccctcgtcagaaacagagattctcatctcaaatgcccctgaagcatcatcggagcattcatactcataatcgcccacgggcgttacatcctcattactattctgcctagcaaacacaacctacgaacgcagtcacatgtcgcatcataatcctctcatcaaggacttcaccctctactcccactaatagctcacagatgacttctagcaagcctcgtctacccgagcgc

SEQ ID NO: 723658 - DNA, 386 bp, Homo sapiens
  misc_feature (102)..(102): n is a, c, g, or t
  misc_feature (359)..(359): n is a, c, g, or t
  misc_feature (383)..(383): n is a, c, g, or t
  misc_feature (386)..(386): n is a, c, g, or t
ctaacccttttgtctccctgccctgagcataacccataagaatcaagatatttctgtttttatctgccccctcaaaaacagcctcatgaggcccaggtgtgngtgtcacgccctctaatccccagcactttgggaggctgaggtgggtggatcacgaggtcaggagatcaagaccatccctggctaacacggtgaaaccccgtctctactgaaaatacaaaaaattcgctgggcgtggtggcgggtgcctgtagtcctagctactcgggaggctgaggcaggagaatggcgtgaacccaggaggcagagcttgcagtgagccgagatcgcgccactgcactccagcctgggtgacagangtaggctccgtctcaaaaactatnttn

SEQ ID NO: 723659 - DNA, 271 bp, Homo sapiens
  misc_feature (189)..(189): n is a, c, g, or t
catcgccaaccacctgtagcgtgtacgtcatcccaacgctacgcatgttatctgatgcactaatggcaggacaacacagcaacctcatctcgccttaacgcaggcacacctgcttgcacacttttctattattttctccactatcgatttacccattcaactttgcagcggggtgtcttgtgttgtacngtcacgcgatgctatttaacttagcactccggaagggaatgtgagccgcgttcctctccgacataggttcaccataggggcg

SEQ ID NO: 723660 - DNA, 361 bp, Homo sapiens
cgatgtagagatgccccagtgagacagacttgtaaattaacaatgcttacccaaattccattattagacattgagtctgacaactgataggggattgagtgtgtaactaccatatgaagctagaaaatgcacaaacgatattccttatctgtaatttaaatacttaaaatttgcaattgtcagatcttgattaaactggttgtcttatttctgctcatcattaacggaaaaaaaatcagcatttctatctttgaaatctaagtgatttgaggattttaaaactgaattttatctgctataccagtcatttgagaaagtgtgattccaatgtaaagcatttagaaaggacaaaagtataatt

SEQ ID NO: 723661 - DNA, 385 bp, Homo sapiens
ggttgattgaacagctcaggatcgatcctactgctacgattgtgaggtttctccttccttacatttaatatgctcatttttacgctcttcacaatgtagtgcttccacgtacttcattaaccatgtctgaattacgttcagggcccctcttcttcttgctcctgtatccaagtagcaatctatgtatagctttgtccacagcttcaaaagcctttagtgctctgtcaacatcatcttgatctttgtcaatatgcaccaagatagattagctgccgaatacctctttttgatttcttcatctgttacttcacgatctatctgaacaacctcaaatgggttcagattgaagtaagaggaaccaggacgggtcagtctatccatctca

SEQ ID NO: 723662 - DNA, 362 bp, Homo sapiens
  misc_feature (1)..(1): n is a, c, g, or t
naaagcattccgtgttgagaggacacacacaggctcaatggagttgggtgtcatgatgaggtagcagtgtctgccatgggcgtagcaggaagtgatggcatgatctatagctgtgagcttggccctctttttcccgcttcctgccctgaccccctagggtgactcatccattcctgtaagtgaagatgtttgtgaaattgacttccaaactcacttagctggtcccgcccctcctctgagctgcagaaacccccatccaggtgtcctcttgaccctgcccatcttgccaccccttgatagccatgggctttgcttagaatgtcaatcattctctcaattcacacttattaggcacctattat

SEQ ID NO: 723663 - DNA, 386 bp, Homo sapiens
  misc_feature (27)..(27): n is a, c, g, or t
  misc_feature (146)..(146): n is a, c, g, or t
aaaggttagtggaagaaatattttttnattttagagtttattgtggtattggttatttttttttagtataggggtgttgtaggtggtagagtgaatgttttttattatgtggtttaatttttttggtttggttatttttttttttngaaatagtgtgtatgggttattttggagtgtaggtgatttgtttatttattgaagtagatttttgtttttttttatttttataggaatagaggaagaaaggttagatgtgtgtttagttttttattttttaattttttggtggggaggggtgtatttaaatatttattatatttttgtttttgagtgtttgttagagagaaagagaattattaaggaaaataatattatttaaatttgta

SEQ ID NO: 723664 - DNA, 166 bp, Homo sapiens
cccatagagagcctatatcattactatacagatatgtctgtgagaatcaagccatctcattataatcttgtctacctccattctgaagagggaggttaaggtgtcccttagtcctctgggagtagaagatccatttgtctttgtgtagagcaagcacgttttccac

SEQ ID NO: 723665 - DNA, 159 bp, Homo sapiens
ccccttttgggctttttggggggggggaaaaaccccccttttttggttgggcccggggtttttccccaaggcctttttttgcccggggttttttttggggcccttcccgtttcgcctttttcgcccggggggaaaaaaaaaaacttttggggcccctga

SEQ ID NO: 723666 - DNA, 709 bp, Homo sapiens
agtagctgggaagtggtttggtttagacgtaccgggaatagcatctgtcggcagagcctagatgtggggacaggctcatgagtgcaagacgtctaggtgatgatacctcagtgcactaccgcaaaaggaggagcaaacacagacagaggacgcaagaacgagaacagaacagaggagcacaaggggactgacaacgacgcggaccaacacaagaagcaccacagagagcacgacgaaaagacacagagggggacgaatcgacggtagaacactagggaaacaacgactggctgcaccgacgcacacacacatagaaaaccgaccagaggaccccggaaacggaccgcacgaaaaagaaggaaaaacaagaacaacagacaggcagagcgacaaagaacgagaaaaagcgaacaaacgagaaccgcacgacagatccgggaagatgccggaggtaacaacacccaacgtaaagaatcgagcagcatacagaacagcgcccaagaccacagcaaagaggccaggaaccggagaccagaagagaaaagcagcgacactcggacagacaggcgccaccatgccgaaaaacaacagaggaccaaggaaaagaaggcaccgacgaagacggaagagacacagagcaaacaaacaagaagagaagcgagagaaaaagacacacacaaggggcgactggaaaggagagaggaaacaa

SEQ ID NO: 723667 - DNA, 1783 bp, Homo sapiens
  misc_feature (13)..(13): n is a, c, g, or t
  misc_feature (16)..(16): n is a, c, g, or t
  misc_feature (18)..(18): n is a, c, g, or t
  misc_feature (20)..(20): n is a, c, g, or t
  misc_feature (24)..(25): n is a, c, g, or t
  misc_feature (28)..(28): n is a, c, g, or t
  misc_feature (30)..(30): n is a, c, g, or t
  misc_feature (41)..(41): n is a, c, g, or t
  misc_feature (1352)..(1352): n is a, c, g, or t
agacatacggcanggncntntccnntgntnttccggccgancccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaaagacaagcctccagggccttcagcttgtacgccaacatcgaacatcctcagacccctactttgatgtggagcctgcttcaggtgcgaagcaggctcctggagtccatgatccctatcaagatggtcaactttcccccagaaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttgcatcacctataatatccacctccacgccctcttctacctcttctggctgttggtgggtggactgtccacactgcgcatggtagcagtgttggtgtctcggaccgtgggccccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagcaccctggctgccctactacatgctcttcctgctctatctgcattttgcctaccacaaagtggtagaggggatcctggacacactggangggccccaacatcccgcccatccagagggtccccagagacatccctgccatgctccctgctgctcggtttcccaccaccgtcctcaacgccacagccaaagctgttgcggtgaccctgcagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctgg

SEQ ID NO: 723668 - DNA, 980 bp, Homo sapiens
ctcaagcactgtttttattccaaagactgccatccagggccatgcagcaaacaagcaacagggaaatatcccactatgcaatcctattttgagatgatatttaggatgagagaacatgcattagttacctaccagcttgacaggaatggatttccaaatctgacacaccatagcctgaattctcaccagtttgctcctggaaaggcccgctcatgcatgagcccctgccactcttctaaataagcttccaggcattacctgcatgctgtgttcctgtggtgggatggcagtaatctctgctaagataaacgggagcttctgtggataaagcataaacgcagtgaagtgtgtgtggctggaagatttaatgcctctacagtgcttagatacaagttgagcttggaattccagaggtagagcactgctgattggagacatattaagtaaaatgtactgtggaaatgagataaaacctttattcttgctaatgattgtcattgtatgtattcaggtgtccaacaaaggattttagaataaagtgtgcctttaaagtttcccaccttcttaaagctcccaatgaattgcaaagggcctgtttggaatggactgtattaaatctacttcaaatgaaaacctttacactgagtgaaatatggttcaacaattcttaacacaaggcctttacacttgtgtagcccattttggtttggcctatcttgtcactagaatgctgtctgagcttggattatttatgccctaagatttacttaaaattgaagggagtatttccattcatcaacactagttttgatagatgcttaaaaggtgcagtgaggttgatgatcctgaatacacaaattattgatcaccacatcaagttggatttccctaaagatgtatggctttttgaccttgtgatttacactaatgattatgtcttaataaaagtcataaagctaaatactttatacgtgtattaa

SEQ ID NO: 723669 - DNA, 158 bp, Homo sapiens
ccccccccgggggggggggattttccccccgggggggggggaatttttgggggaaatttttttggggcccccccccttcccccccaaccaaaaataggggggttttttttttttttggggttttccccccctttttgggaaaaagggttttttttgga

SEQ ID NO: 723670 - DNA, 742 bp, Homo sapiens
  misc_feature (3)..(3): n is a, c, g, or t
  misc_feature (72)..(72): n is a, c, g, or t
  misc_feature (95)..(95): n is a, c, g, or t
  misc_feature (112)..(112): n is a, c, g, or t
  misc_feature (116)..(116): n is a, c, g, or t
  misc_feature (123)..(123): n is a, c, g, or t
  misc_feature (134)..(134): n is a, c, g, or t
  misc_feature (142)..(142): n is a, c, g, or t
  misc_feature (187)..(187): n is a, c, g, or t
  misc_feature (217)..(217): n is a, c, g, or t
  misc_feature (255)..(255): n is a, c, g, or t
  misc_feature (281)..(281): n is a, c, g, or t
  misc_feature (299)..(299): n is a, c, g, or t
  misc_feature (364)..(364): n is a, c, g, or t
  misc_feature (367)..(367): n is a, c, g, or t
  misc_feature (404)..(404): n is a, c, g, or t
  misc_feature (424)..(424): n is a, c, g, or t
  misc_feature (446)..(446): n is a, c, g, or t
  misc_feature (466)..(466): n is a, c, g, or t
  misc_feature (473)..(473): n is a, c, g, or t
  misc_feature (495)..(495): n is a, c, g, or t
  misc_feature (532)..(532): n is a, c, g, or t
  misc_feature (552)..(552): n is a, c, g, or t
  misc_feature (554)..(554): n is a, c, g, or t
  misc_feature (558)..(558): n is a, c, g, or t
  misc_feature (608)..(608): n is a, c, g, or t
  misc_feature (617)..(617): n is a, c, g, or t
  misc_feature (634)..(634): n is a, c, g, or t
  misc_feature (662)..(662): n is a, c, g, or t
  misc_feature (705)..(705): n is a, c, g, or t
ccngttccacctccaccccacgaggcctggaccatggacgccagatggtgggcagtggtggtgctggctgcnttccccatccctaggggcaggtngggagactcccgaagancctncggaatnatggaaccagntatagttnttccaatttgtagtgaatgcatgctggactatgccacttatatgntacctggctacctcctggtgcagatacttnaggcggaagaactacctggagaccggtaagggcctctnctttcccctggtgaaagcttattatntttggcaatgagcccaangcctactaataaggttcccctggcgccccgaacaaaggcggcagagaccaccccgatgtggcagnccntaaaactgctcttctgtaccacagggctccaggtgtnttatctgacttgagggtgtnctgacaggaaagagtgatgacncgcagctatgagggccacanccacatnaccgggtgagcgctttacggantcgcagttcctggtgctaatgaaccgagtgctggcantgattgtggctggcctctcntntgtnctctgcaagcagccccggcatggggcaaccatgtaacggtactcctttgncaacctgtncaatgtgcttagcagcnggtgccaatacgaagctcttaaattcgncagcttccccacccaggtgctggacaaggcctctaaggtgatncctgtcaagctgatgggaaagcttgtgtctcagcgca

SEQ ID NO: 723671 - DNA, 1540 bp, Homo sapiens
  misc_feature (13)..(13): n is a, c, g, or t
  misc_feature (16)..(16): n is a, c, g, or t
  misc_feature (18)..(18): n is a, c, g, or t
  misc_feature (20)..(20): n is a, c, g, or t
  misc_feature (24)..(25): n is a, c, g, or t
  misc_feature (28)..(28): n is a, c, g, or t
  misc_feature (30)..(30): n is a, c, g, or t
  misc_feature (41)..(41): n is a, c, g, or t
  misc_feature (970)..(970): n is a, c, g, or t
  misc_feature (976)..(976): n is a, c, g, or t
  misc_feature (1078)..(1078): n is a, c, g, or t
  misc_feature (1197)..(1197): n is a, c, g, or t
  misc_feature (1213)..(1213): n is a, c, g, or t
  misc_feature (1218)..(1218): n is a, c, g, or t
  misc_feature (1227)..(1227): n is a, c, g, or t
agacatacggcanggncntntccnntgntnttccggccgancccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaaagacaagcctccagggccttcagcttgtacgccaacatcgaacatcctcagacccctactttgatgtggagcctgcttcaggtgcgaagcaggctcctggagtccatgatccctatcaagatggtcaactttcccccagaaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttgcatcacctataatatccacctccacgccctcttctacctcttctggctgttggtgggtggactgtccacactgcgcatggtagcagtgttggtgtctcggaccgtgggccccacanagcggntgctcctctgtggcaccctggctgccctactacatgctcttcctgctctatctgcattttgcctaccacaaagtggtagaggggatcctggacacactggangggccccaacatcccgcccatccagagggtccccagagacatccctgccatgctccctgctgctcggtttcccaccaccgtcctcaacgccacagccaaagctgttgcggtgaccctgnagtcacactgaccccnctganattcttggncagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctgg

SEQ ID NO: 723672 - DNA, 1548 bp, Homo sapiens
  misc_feature (13)..(13): n is a, c, g, or t
  misc_feature (16)..(16): n is a, c, g, or t
  misc_feature (18)..(18): n is a, c, g, or t
  misc_feature (20)..(20): n is a, c, g, or t
  misc_feature (24)..(25): n is a, c, g, or t
  misc_feature (28)..(28): n is a, c, g, or t
  misc_feature (30)..(30): n is a, c, g, or t
  misc_feature (41)..(41): n is a, c, g, or t
  misc_feature (1086)..(1086): n is a, c, g, or t
  misc_feature (1205)..(1205): n is a, c, g, or t
  misc_feature (1221)..(1221): n is a, c, g, or t
  misc_feature (1226)..(1226): n is a, c, g, or t
  misc_feature (1235)..(1235): n is a, c, g, or t
agacatacggcanggncntntccnntgntnttccggccgancccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaaagacaagcctccagggccttcagcttgtacgccaacatcgaacatcctcagacccctactttgatgtggagcctgcttcaggtgcgaagcaggctcctggagtccatgatccctatcaagatggtcaactttcccccagaaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttgcatcacctataatatccacctccacgccctcttctacctcttctggctgttggtgggtggactgtccacactgcgcatggtagcagtgttggtgtctcggaccgtgggccccacacaggcgaagctagctcctctgtggcatgcaccctggctgccctactacatgctcttcctgctctatctgcattttgcctaccacaaagtggtagaggggatcctggacacactggangggccccaacatcccgcccatccagagggtccccagagacatccctgccatgctccctgctgctcggtttcccaccaccgtcctcaacgccacagccaaagctgttgcggtgaccctgnagtcacactgaccccnctganattcttggncagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctgg

SEQ ID NO: 723673 - DNA, 559 bp, Homo sapiens
ctcaagcactgtttttattccaaagactgccatccagggccatgcagcaaacaagcaacagggaaatatcccactatgcaatcctattttgagatgatatttaggatgagagaacatgcattagttacctaccagcttgacaggaatggatttccaaatctgacacaccatagcctgaattctcaccagtttgctcctggaaaggcccgctcatgcatgagcccctgccactcttctaaataagcttccaggcattacctgcatgctgtgttcctgtggtgggatggcagtaatctctgctaagataaacgggagcttctgtggataaagcataaacgcagtgaagtgtgtgtggctggaagatttaatgcctctacagtgcttagatacaagttgagcttggaattccagaggcacggaagccaatgacttgggcaaatgcccctaattcaggatcaactcagatgaccaggtttcccctacctagagtgctacttattgcagtgaaaacttttcttctttccaaaaacctttaattaaacgtttaataactccctga

SEQ ID NO: 723674 - DNA, 235 bp, Homo sapiens
gatcttatgtgctttgggacggggacgggccattaactcgtatcagtgttgtagcctcgtgtgggcgtggtgatagtgcaggtccccattaatgcccttaggtgctcccagaattccatcatggtaggaacgcggtaggacctgcctcagacaactcgcgcagaatctacgcgggccaccagcagtgttccactaaagctcacctcctgtcctcagtaatccgtcccaagcacag

SEQ ID NO: 723675 - DNA, 115 bp, Homo sapiens
  misc_feature (3)..(3): n is a, c, g, or t
ttngtgcactgcagcggccctcttgtacgctgtgtggtcgttcttcacactgcccttcatgttgcttcacctcgtccagctactggtcgcaactatgtgggatcgacattgtgcc

SEQ ID NO: 723676 - DNA, 468 bp, Homo sapiens
accttacattagcttgtggacgtgggtgcgcctaaatggttacggcaggtgcctcatggtatagaaatgaacgtcgctggggctgcgagacactaagcaaagagagtggagggcaaaaacaagcgagtcattcttctggttgagaagaagaatatttttgcaagtaagagtgaagagtgaaaatcctggattcatataacaattaagccatcgaagtatcgcaactctttataccttctatgcgtctgttacctttcccgcaaaatgaaggatatgactcagttactaggtctgtagccagtgacactgggctgtacaagtgtaaagatgattagcatcctctggaacctgaacaattctgcagctaaacttcataataacacaagcctacatgtgcttataagtttgtgtgaagccaaagctatatgagaaagtggttacccagccctatccctggctctaatggca

SEQ ID NO: 723677 - DNA, 522 bp, Homo sapiens
ctggccttgcacttaatcctcttactttagctgcctggagttgttgggtgagtcaccagacaggacaaagacagaaaatgttctttaaacataaaaatattgtggggtggatacttttgtgagctaaattgctaaatgagtatgttggtttttatctttccccaccccatgctatttaaagaccattcttaagcatctgtttaatgctctgctgacagcagccgtacccacactgaggggcatgctgtcactggttgaacagatagtgagcctgggtcaataaaaagaaccaccagaatttgggtacttaattaacaaagcaaacaaaaaccctaggacagtaagcctccacagatctctgcagtcagaagctcctagaggcagaagaaaagaagcacagagtctggagttccctgaacaaaagatgccatggagcaggggaagttgtccttgtggattgtgtgtctcccatttaggtttaccctgagtgggtgaaataaatgtggcttaattgttaaaaaa

SEQ ID NO: 723678 - DNA, 894 bp, Homo sapiens
catatagttgaaagcttaataaagcacttgaatcgattgaatatgttcagacattcacaggatgaagaactagatatgagcaagaagaaagacagacaacatcagaaactgaacagtgtaccatctatattgcgtagtaaccagatttcgcagagcatgctgagaatgccttggaagaggatgacgacatgtggtttaactgaagatgaacgacaagagcgaaggaaaagcagttgtggcaccaggtggaaaaacctaagccagaagatgattttccagataagttatgaccaagtttagtggagactaaagaaagccagacacagaaagtgaagacaaggaaaaccttcccaaaaggacatctcctggggggcttcaaatttactttctcccactctgccagtgcttgctaatggaacaaacagtaaatctgtagtggctcagataccaccagcaaacttctaatggatcctcttccaaaagcacaaagcttgcctacgtcagtaacagccaccaaggggaacgttggggtcggcttagtggattatccagatgatgaacgaggcagatgaatgacgcaaagactcgtcccccagggaacaaggacctcgtctggggctcataaaactatgtactccagggggcacccctcaaaccagggtgggtctgtacaaagcgtggcactggtacaagcggaggctgaacaaatcctggagtcagaaaggcctctctcaagggaacttagtagagcatatatcaaggaggtaggcacacgacacccaataacgccagcagcagtgagcctaaaaaaaaatagcggccccggacgtgtgcgacaaacctcacaggggcgccacaggggcaacacacctcgcgcaccgcaccggcgaaacc

SEQ ID NO: 723679 - DNA, 1582 bp, Homo sapiens
  misc_feature (13)..(13): n is a, c, g, or t
  misc_feature (16)..(16): n is a, c, g, or t
  misc_feature (18)..(18): n is a, c, g, or t
  misc_feature (20)..(20): n is a, c, g, or t
  misc_feature (24)..(25): n is a, c, g, or t
  misc_feature (28)..(28): n is a, c, g, or t
  misc_feature (30)..(30): n is a, c, g, or t
  misc_feature (41)..(41): n is a, c, g, or t
  misc_feature (1120)..(1120): n is a, c, g, or t
  misc_feature (1239)..(1239): n is a, c, g, or t
  misc_feature (1255)..(1255): n is a, c, g, or t
  misc_feature (1260)..(1260): n is a, c, g, or t
  misc_feature (1269)..(1269): n is a, c, g, or t
agacatacggcanggncntntccnntgntnttccggccgancccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcatcagaatcgttggggccaaggcgggcccttggggcggaaacaacaaacgaacaaaaaaggcccctccaaagggggccttcagcttgtacgccaacatcgaacatcctcagacccctactttgatgtggagcctgcttcaggtgcgaagcaggctcctggagtccatgatccctatcaagatggtcaactttcccccagaaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttgcatcacctataatatccacctccacgccctcttctacctcttctggctgttggtgggtggactgtccacactgcgcatggtagcagtgttggtgtctcggaccgtgggccccacacaggcgaagctagctcctctgtggcatgcaccctggctgccctactacatgctcttcctgctctatctgcattttgcctaccacaaagtggtagaggggatcctggacacactggangggccccaacatcccgcccatccagagggtccccagagacatccctgccatgctccctgctgctcggtttcccaccaccgtcctcaacgccacagccaaagctgttgcggtgaccctgnagtcacactgaccccnctganattcttggncagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctgg

SEQ ID NO: 723680 - DNA, 445 bp, Homo sapiens
cgcacccggcccattaagtggatttttaatctcacacgagctcaaggcacagctgaagaccttttaaattctgtgaaagatagtggatattcatagctagtttttaattccagacccttaatttctcttatctgtaagtcagccttgttgacttctgtctaacatttagcacctttacaaaattattcaagtcagtaaatatatatataaaaaacctatttggctttgtttcaagatttgctcatttaacctttaataatcctctttaaaatggggatgatgatgtaacagaatccctgtaacttacaaagtactatatgtagacgagggggaggaattcaacaacaatgcctgtcataaatcaggcagtgcattgggatacttttttgtgggttttcattaaccaggtagttcacatcattcagcactcaaatgtcataaatca

SEQ ID NO: 723681 - DNA, 1184 bp, Homo sapiens
  misc_feature (371)..(371): n is a, c, g, or t
  misc_feature (403)..(403): n is a, c, g, or t
  misc_feature (419)..(419): n is a, c, g, or t
ctcaagcactgtttttattccaaagactgccatccagggccatgcagcaaacaagcaacagggaaatatcccactatgcaatcctattttgagatgatatttaggatgagagaacatgcattagttacctaccagcttgacaggaatggatttccaaatctgacacaccatagcctgaattctcaccagtttgctcctggaaaggcccgctcatggtaagctccttagagtttgttagtagtggggaagccttgagtttcaggagaacgtgtttggatggcattttaagaagccattccatttttggtagagtagaaaaagtctgcatctgagtctgtagtacagtctgttctctggatgaacacaatgtncgctctcacatttttctggatatttatttcgncaaatcagcagcatgncatgagcccctgccactcttctaaataagcttccaggcattacctgcatgctgtgttcctgtggtgggatggcagtaatctctgctaagataaacgggagcttctgtggataaagcataaacgcagtgaagtgtgtgtggctggaagatttaatgcctctacagtgcttagatacaagttgagcttggaattccagaggtagagcactgctgattggagacatattaagtaaaatgtactgtggaaatgagataaaacctttattcttgctaatgattgtcattgtatgtattcaggtgtccaacaaaggattttagaataaagtgtgcctttaaagtttcccaccttcttaaagctcccaatgaattgcaaagggcctgtttggaatggactgtattaaatctacttcaaatgaaaacctttacactgagtgaaatatggttcaacaattcttaacacaaggcctttacacttgtgtagcccattttggtttggcctatcttgtcactagaatgctgtctgagcttggattatttatgccctaagatttacttaaaattgaagggagtatttccattcatcaacactagttttgatagatgcttaaaaggtgcagtgaggttgatgatcctgaatacacaaattattgatcaccacatcaagttggatttccctaaagatgtatggctttttgaccttgtgatttacactaatgattatgtcttaataaaagtcataaagctaaatactttatacgtgtattaa

SEQ ID NO: 723682 - DNA, 578 bp, Homo sapiens
ggaaggtcttgccagcacgaggaggaacctgagcgagaccaaaatcgcgctatgcgctgacgcaaatgatccagacaggagagcgggctaaactcccagtaccgtggaaatactccaaatgttgcaagagcacattcacactctactcattcaggaccaaggccatgcacagcatcttactcctgaggacttactgctcagtcatatttttgtagacgaactgtgagacttaagtaactccagtgaaggcagccttagatatgcttaacactaatgaggacaatattgttgcatacttctacaaaaaagaaaccaacaggaacattcctgatggagccaacgtgtaactagatgacttagctaatgatctgcatatgtaattgagtggctatcattgaaccaaggcctctacctagtgtgtgcgcagggcacggctataaagtccaactatgtataaacaattgtgacggttgatgttacgtgttcactaaccatcaagttgttacaactcttttacagagttagtgttaccagctgaacaccaaggtatcgtgtaactacactccgtttgctttttc

SEQ ID NO: 723683 - DNA, 1388 bp, Homo sapiens
  misc_feature (926)..(926): n is a, c, g, or t
  misc_feature (1045)..(1045): n is a, c, g, or t
  misc_feature (1061)..(1061): n is a, c, g, or t
  misc_feature (1066)..(1066): n is a, c, g, or t
  misc_feature (1075)..(1075): n is a, c, g, or t
aaggcggagtctcgctctgtcgcccaggctggagtgcagtggtgcgatctcggctcactacaagctccgcctcccgggttcacgccattctcctgccttagcctctggagtacctgggactacaggtgcccaccaccacgcctggctaagtttttgtatttttagcagagatgggagccctcaagggacatggcaactacagcggcgccggcgggcggcgcccgaaatggagctggcccggaatggggagggttcgaagaaaacatccgatcagatgtggcaggctgggaaaaagacaagcctccagggccttcagcttgtacgccaacatcgaacatcctcagacccctactttgatgtggagcctgcttcaggtgcgaagcaggctcctggagtccatgatccctatcaagatggtcaactttcccccagaaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttgcatcacctataatatccacctccacgccctcttctacctcttctggctgttggtgggtggactgtccacactgcgcatggtagcagtgttggtgtctcggaccgtgggccccacacaggcgaagctagctcctctgtggcatgcaccctggctgccctactacatgctcttcctgctctatctgcattttgcctaccacaaagtggtagaggggatcctggacacactggangggccccaacatcccgcccatccagagggtccccagagacatccctgccatgctccctgctgctcggtttcccaccaccgtcctcaacgccacagccaaagctgttgcggtgaccctgnagtcacactgaccccnctganattcttggncagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctgg

SEQ ID NO: 723684 - DNA, 527 bp, Homo sapiens
tgtctaggtgttagtgtgctcatgctatggggttcacgcttctagtttatttctatgacgagaactagacagcgtttttatgcacacgcgcgtgcacacacacacacacgcacacagcagttttacgtactttttttttttgggagagggagtctggctctgtggcccaggcgggagtgcaagggcgcaatcagtgcagacctccattttcgggttacaggcgattctcctccctgggcctccggagataggggggataacgggcagatgcggttctcccagtaagtttgggtattttaagtacgaagggggtttcacaaggtgggccgaggcgggtctccaagtcgggacctcggggtgatccacggcctgggctttctcatagggcggggacataacgggcttgagccaccaggcggggccccattctattttttggtcactatgatggggactattctagaagcctaatatagggggaatcatacgggattggtcctttggggaagggttaatttcattcatca

SEQ ID NO: 723685 - DNA, 110 bp, Homo sapiens
tcccgagttgtgctgtcgcaaggccaaaaatcacattcgtctttctctctcctactcctcatctaccattctcctcaccaaagaccctgggaccagacacaacctggcga

SEQ ID NO: 723686 - DNA, 81 bp, Homo sapiens
gcgggcggacccgagcccccagcccgctggcgccgctgcccgccaggccccgggggcggcggccaagatgtccgtgcctat

SEQ ID NO: 723687 - DNA, 166 bp, Homo sapiens
ttgctgctcgatgagaagtgacagaaccatggaaatggagtttgaagacggtgaagtttctaagggtgcagcgagagtatcacggaagcgtttccacactgcaccgataattttggcttcaataataagacatcagtcatccagtgatttaaaaggttggcggccg

SEQ ID NO: 723688 - DNA, 153 bp, Homo sapiens
cctcctcccttcccatgcttgtaaccagctttggggcttgcacctccgcaaagtaaggttggcccttggagtgccatgtttgggtctccggccagggcctagggctagaccatgcacccaatgggtgcacaattaattacaggtctacaaaaa

SEQ ID NO: 723689 - DNA, 124 bp, Homo sapiens
tggatgctattgtcctaatgatggtaaaagggtagcttactggttgtctccgattcaggttaaatgaggaggtctgcggctaggagtcaataaagtctgtaagtgaccagcgcaaagcgccggt

SEQ ID NO: 723690 - DNA, 492 bp, Homo sapiens
cgagggtgggttccaccacagagcaccccggtgggcgggaaacagtggcatcatagacctaactactcttttaagactggggagttaattcttctggtctatagttactatagcagaagtcacggtggtcaaaactctcatcaagtgaatgcagacaaaattagtctatcccggtgattacgggataaattatccgcagggtgtgtgtgtgtgtgtgtgtgtgtgtgtgtgtgtgtgtgtgtgagggaggaggggagcctcccagaggggactggggtaaatctgagtttctaagccacaagtggaattagaggggcgggggagatctaagtgcttcttctagaggggaaacgcgtgagaaacccagctcccggccgaggtcgctaaaacccaaggggtgaccaggcatcggggccaagcctgtaatcccagcactagaggagggcgaggggggaggcacacgtgagcctggaagtgggataccagtctaag

SEQ ID NO: 723691 - DNA, 126 bp, Homo sapiens
  misc_feature (74)..(75): n is a, c, g, or t
cattgcaccatggttgtctcggagtccttcacctgacctttttagtcagctcagatctttttgtagtttgagannggacctattcaaggagctatcagggttaaaagctgccacttgcccaaagct

SEQ ID NO: 723692 - DNA, 1484 bp, Homo sapiens
  misc_feature (168)..(168): n is a, c, g, or t
gcagtcgcaagagcctctatggtgaagttggatgtggcgtaggaaatgcgccccatgatgggagcatatcctggaagtaccagcgataatgtggctcaggagctctatacttgcgagcgatagagacacgagtcgacctggatttagcaatgtacggggtggacgctngcacgaatcatgggacaggcaatcgctgtcacctgacctcgaggcaaggaaggcatgactcattttgacgtttgcatatcagtacgacttgggaaaagaatagtcgacttcaccccctcgtcgtagatctagcgaagtgtacccatgagaaggcagcttgatgccgggtagttgcgtgtggtaccggcagatcgagcacggtgccgttgacatggaaaagccctgtccgttgaacatcacgcggctctaccgttcccatagtaggcctacttcatgacgcttcgtagggatcttggtgacccttgcttgcacctagggaattttcgtagcacattgttgccagaggcacccaagtagtcaattcgcatgggcccattatatgcgagaacggcggccgccatgtgtgctggttttcgcttggggccaagcccttggggcggagggggaaacggttgtctttaggacagggggccctaatcgtggccgccgggtttacccccaaacctattgcccttttggtgccattcctgcacattgtgtggggccagggttcctgccctgttagatcgttgtgacactaacaccggaacccgtgagtccccggtaattatgagaggcgggtcaaccggtctcacaaaagaggcacccgtttgtgaaagaacgcggaatcgggtgcggtcggacactttctgtgggtctgggtggctgaacgcccgagttggtccttggtcggcggattgttgggacacccccgaatgggtttgccaacgttcggttattaatcgccaaaaccgcgggggtgtgttggcccctgtggttgggtttaaacgggtacacaaacgggaagctccggaacaggcccaactgtccctggcatagattatggttcccccgggagatgtctgcacaacacagtggtgaaccacttgttggcgccaaattttcccgtgcaccgaaaaatattgtgctctgaatgatgtactgatgtgcattgcacagttagcggtcacacccagggtgttggcattccccccccggggggtaacagtgaacggcccccacatatcgcccgggttgttggaaatgtgtggaggggcccggccgcccggggtaccacaaaggtgggcctacgggtaatgtgagttaatctcagccccccgagagctacacggatatgctccaacgatggcggttttttggacattagggacgaaacctccggggcgggcattgtaattaccacacttccgcctgtgtgcaggacggaattctggtacaaacagcccaactttggtggtcacgacaaaacgtttaaa

SEQ ID NO: 723693 - DNA, 463 bp, Homo sapiens
aaaagaccaagaatagccgggagtggtggctcaagcctgtgatccaagtactttttgagaggtggagacaggaggatcatgtgagcccaacagttcaagaacaacctgggcaacatagtgagaccctgtttctacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagactctgtctcacaaaaaaaaaatgtgtgggtgccaagactcaagaccgtgggagctggtcgggcacagtggctgacgtctataatctcagcactttgggaggccaaggcgggtggatcgcctgaggtcaggtgttcaggaccagcctgggtgacagagcgagactccatcccccccc

SEQ ID NO: 723694 - DNA, 161 bp, Homo sapiens
aagaagggagccacaccaggcaaagcataggtagcaactcctgataagaagggtgctgccatcccagtcaagggggcaaagaatgacaagaatgccaagaaggaagacagtaatgaagaggaggatgatgacagtgaggaggatgaggaggatgacgagga

SEQ ID NO: 723695 - DNA, 260 bp, Homo sapiens
  misc_feature (23)..(23): n is a, c, g, or t
  misc_feature (74)..(74): n is a, c, g, or t
  misc_feature (180)..(180): n is a, c, g, or t
  misc_feature (182)..(182): n is a, c, g, or t
  misc_feature (212)..(212): n is a, c, g, or t
  misc_feature (252)..(252): n is a, c, g, or t
gaggaggaactgagcagctcctntgaggaggaaggagaggaggaccgggatgcagatgaagagggagaaggagntgaggacaccccaacttcagatcctgggtcctgcctaacagcccgaaacccgtatgcctgctcggggaggatgagtgctgagccccacctggtaccacgtcccccncngcagctttgcttctgggctgagctggaggngtcttccctttgcccccctgattgtgaataaagattgtcngctttgta

SEQ ID NO: 723696 - DNA, 377 bp, Homo sapiens
ctttctagctcttctctctgactttcactgtgttgacctaatgttatgatgcttgcctttgtagacacgatatgacggctcacagtaatggaggcagcatacttaaatcaacaggagattggcttgtctttcccagaagcatcttcttatctctctttagtccaaagatgacttttccctgtgtgtccctgagtcagtcactggtagaggggatgaacgtgccgagattttcatagattgatcctgtgtgagtagaatggatgcttagaagccactcagtattcaccacgatatctctattaccagaggcgaagaattacacggatacttggcaggacatttgccttataggctaatcaccaaagtcctaaggcctg

SEQ ID NO: 723697 - DNA, 316 bp, Homo sapiens
tctgaacttaggggggagtgcagtggcgtggtctcagcttaccaccacatcagtctcctgggctgaagcaattctcctgcctctcgagtagatgggattacaggcacccgccaccatgcccggctaattttttatttttagtagagacagggtttcaccatgttgggcagggtggtctccatctcctgacctcgtgatctgcccgcctctgcctctgaaagtaccgcgattacaggcataagccaccgcgcctggccctgatttccatttcttttatttctagtcacttacattcatgcctaagttcagagccagg

SEQ ID NO: 723698 - DNA, 657 bp, Homo sapiens
gccggggcgcggtgctcacgctgtaatcccaatctcaggaaggctaagaggcgggaggataagctggagcccaggagtcgagacctgctgggacataatagcgagaccccgttcctccagaacaatggacacaaaacacacccaatcgggaccaacacacacaaaccctaactcataaaacacaaaaatctgttggcggacacccgcggacccaagaaaaaagttttaaaaaccacatatgttgggggcacacgccgccccacataatgtcacaagtgatacaccggtggccaccagcgcgggtcccacagaggactcccgggggcaccagaaacaaagcgcgatgagcatctaccgcacagaaaaaaaaaaaacaccggcccgcggggcaacacaacgcgcgggctccttggacaaacaacaccccaagtgaggaacctacggagaggacaacagacgggggggggctcacaatcacaaaggggggttcccaagggcgcaccgtcgaaataacaaaaataggccccgtagggcgggtgagcacaaccgtcccacgacgagcgcagagcctgcaccgccgtacggcagacgaaggcagagcacggcatcaggggtcacacggtcgaagcacaccggagccacacaggcaggcaccgg

SEQ ID NO: 723699 - DNA, 348 bp, Homo sapiens
  misc_feature (5)..(5): n is a, c, g, or t
ttcgngccggggcactgacgtatcattgcataacagaagactgctgatttcggggagggagcacatacaagtttcctgatagctcctattttcgtttccttttttttttttcccttggaaaaagtctccctcggtggcccaggtgggagtgcaggggggcaatctcagctcccggaaacctcggcctccggggctcaagcaatttcccgggttcagcctcccaagtagcggggataacagggggcacacaaccaggcccagctaatttttaaaatatatttttagcaagagagggggttccactaatgttgggccgaggcgggtttcgaaactcgggaatctcgaggt

SEQ ID NO: 723700 - DNA, 751 bp, Homo sapiens
aagcggctgtacggcccgggattttgggcatggggagctgctggctgtgtggcggtcaggaggccgggcagggtctgagggaccgacggacgcacgggcgtgcggcctgggagccattgagcgcggcccttgggcccgggggcgcgggccggggtgggcttcccacggcacgacatggagacctgtgtgttgcgatgtgctcccttgggctcggcttggaccgcgatggtgctgtggccctggcctcctaatcggtggctgctgtctggtggcggtagctggtgggtggctgctctcccccctgcccgcgactcggatcacccccacccctcccctgccgggccagtgccgggcggcgttgttggcgggggccccggtggaggcccggcctggtgcggcgcccgccatgaatgggctgtcgctgatgtgagctctgctgcctcttctgctgcccggcctgccccgagccgcatcgctgccaagctcggcttccgtgcctgcggagtgccgatctactcccttggtgcctgagcccgagcctggggccttggttggggccaggggccggccccttgggggagcctgagagcctcctcgggcgcaacccggggggcgcctggaatgcttgaccctttgacgggagcggttgacgaacttaccaggtacaggccatgccgcgaaggcttggaggaccatcagagggtctttacaccgaagcaaggaggcgcccgggggcaacccgagttctcca

SEQ ID NO: 723701 - DNA, 170 bp, Homo sapiens
agcaaatgaaatccccgtttgggtccctttttaagcttgtacccccccccccagacttataattttaaatgtattttcctttgtttaagctgctgcttcctctgtttcattggattgggccagttatcaggggcttttgggttcaaagtaataaagaattcccaaactga

SEQ ID NO: 723702 - DNA, 1989 bp, Homo sapiens
  misc_feature (112)..(112): n is a, c, g, or t
  misc_feature (117)..(117): n is a, c, g, or t
  misc_feature (1854)..(1854): n is a, c, g, or t
  misc_feature (1870)..(1870): n is a, c, g, or t
  misc_feature (1876)..(1876): n is a, c, g, or t
  misc_feature (1887)..(1887): n is a, c, g, or t
  misc_feature (1911)..(1911): n is a, c, g, or t
  misc_feature (1919)..(1919): n is a, c, g, or t
  misc_feature (1923)..(1923): n is a, c, g, or t
  misc_feature (1935)..(1935): n is a, c, g, or t
  misc_feature (1939)..(1939): n is a, c, g, or t
  misc_feature (1942)..(1943): n is a, c, g, or t
catacctcacagaccacttatcacctcgatcagccgatctcaaggccctaccgccaggtgagcttcccggacgacgacgaggagatcgtgcgcatcaacccccgggagaagntctgnatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccaattgagaaacactaaggttatggtgaataaaaccatagggagcttcttccccccaacccctggctattttatattaatggggagaggggatttttaaatgtcataaatttgaagagtggtgggttgcattttcttcatgggtttatgtttttcgtttcnttttgggactcaattncacatnaccaaattccntcattatacttgggggaaaaaacnaagggccntttntaaaacccttcnatgnccnnaaagtggtctttttttcttgccaactttccaagaccccagactttg

SEQ ID NO: 723703 - DNA, 388 bp, Homo sapiens
cacagtattcccatagcaacaaacaactagaccatagaaatgtctattgggaggtgtctcgtagaagcaagacatacctagcaccacatactgcccggaaagtcctcctattccagtgtccatgtagacctccagtccttaatgtcaccatgcttgtggacaatgcatccaaataaggatacccctcagggctcagatagacattgcaattttgcatagctatccagattcccttagctatgtctatcttgactgtcttaccccctctatcggggtcacttgcaatagttaatcaaaggttgaacactgcgtaggaaagggagatgatccagagacatgtggcaccaggcatggcttccccttggcctctctgtacactgccccagga

SEQ ID NO: 723704 - DNA, 1940 bp, Homo sapiens
  misc_feature (112)..(112): n is a, c, g, or t
  misc_feature (117)..(117): n is a, c, g, or t
catacctcacagaccacttatcacctcgatcagccgatctcaaggccctaccgccaggtgagcttcccggacgacgacgaggagatcgtgcgcatcaacccccgggagaagntctgnatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccaattgagaaacactaaggttatggtgaataaaaccatagggagcttcttccccccaacccctggctattttatattaatggggagaggggatttttaaatgtcataaatttgaagagtggtgggttgcattttcttcatgggtttatgttttcttcatgggtttatgttttcgtttcattttggactcaatttcacatcaccaaattcctcatatggccttgttttttcccacaagtataaatgag

SEQ ID NO: 723705 - DNA, 770 bp, Homo sapiens
  misc_feature (635)..(635): n is a, c, g, or t
  misc_feature (651)..(651): n is a, c, g, or t
  misc_feature (657)..(657): n is a, c, g, or t
  misc_feature (668)..(668): n is a, c, g, or t
  misc_feature (692)..(692): n is a, c, g, or t
  misc_feature (700)..(700): n is a, c, g, or t
  misc_feature (704)..(704): n is a, c, g, or t
  misc_feature (716)..(716): n is a, c, g, or t
  misc_feature (720)..(720): n is a, c, g, or t
  misc_feature (723)..(724): n is a, c, g, or t
ggacggatatgatgtgacacagatggttttggttggggctatggagtgcacagagtggtgagaatgcaagtaggctttggcccaactatggaaggaagctgagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccaattgagaaacactaaggttatggtgaataaaaccatagggagcttcttccccccaacccctggctattttatattaatggggagaggggatttttaaatgtcataaatttgaagagtggtgggttgcattttcttcatgggtttatgtttttcgtttcnttttgggactcaattncacatnaccaaattccntcattatacttgggggaaaaaacnaagggccntttntaaaacccttcnatgnccnnaaagtggtctttttttcttgccaactttccaagaccccagactttg

SEQ ID NO: 723706 - DNA, 847 bp, Homo sapiens
ccaggacttgaactgccatgtcctctgaagaaggaaagctcttcgtgggagggctcaagtttaacaccgacgagtcaggcactggtaagaccacttcaggctagtttcggacctatctctgaggtgtgtgcgttgtcaaggaccgggtagactctagcgtgtccaggggttgtggtttcatcaccttcaccaacccagaggcatgcttcagttgccatgaagagccatgaacggagagtctctggtatggtcgtctacgcatccgtgttggattcatgctaggcaagtctgtctcggggaaccagaggacggtggctttggggcccatgggcgttggtcgcagctactctagaggtggtgcgggaccagggctatgggagtcggcacggtatttattgacagtctgacctggaggggtatggatatggatatggacgttccagagactattatggccgaaaccagggtggtcctgatccgctactcatggaggaaacttacatgagactgagtcatgacggagcatgaaatgagacatgcacatattatcgatactcatacggaataatttctgatccaggatcgtgcttccgaaatggctgtagtttataaaggtttttggagctgcactgaaggcatcttatttctatagtatatcaacctttagtttttagaattgacctgccaatgtagctgaagaccttttagacagttccatcttgttgggtaaccttttttctgtctatttatacgacagattatgggacggttgtagaacctgagtattggcttgttaccagttttgagttgagctcttaggttattggaggctagcataatggtctgg

SEQ ID NO: 723707 - DNA, 382 bp, Homo sapiens
cgacattaggaggttcgaactccggcctcggtatcacctgcctggcctgaaagtgctagtggatagatcattaacagaattatttagtttatgttttgagcagttttatatacattactgatgttttacgcatttcaagaagtgattgcagtccaggcttgtgtatttgctccctcaggtcctcctttgccttttgaagtctcagcagtcctgttgttcgtgcagtgtgatcttactatgtcgttcacaattgatgcactattttattttatttggttttgttttatttttgagacggtgtctcagttagtcgcccaggctggagtccagtggtgcactttcggctcactgccacctccgcctcccagatacaagcaattta

SEQ ID NO: 723708 - DNA, 259 bp, Homo sapiens
gaaggatccccataggtggacagctgagtctaggtgttgaagcccagtgctcccatgcaagccattggtcttgctggtttcagcacgggaaggcctgggagccctaggagctggggaaaggcgcattgccgggtcctgggtgattccccagccccagatccccagctgtcatcactggggcaaggcgacattaaactggtccctgtgggtcaggtctgagtggggcaggcactcccctccccattgctcccacaggggc

SEQ ID NO: 723709 - DNA, 349 bp, Homo sapiens
acagactagaggaaggactggggacgacgagaacagggcagctggcaaggtctgagcattgggagtgggtctggacctcgtgacattactccatctgctaccccacgcttccttaggctcccaccctctggctagcttgagaggaaggacgatggtcaaggtacatgtctcttctcctctgactctgggaatgagcatttttctcactcccaccaggctgacctctccttcatcaggcagtgtatcccatatgccaaaatcagcaggacagtcagacatcaacacactccccaaggctgaaaactcagagctggcacgtcagtcaccatggtcagtaaatgtttttagg

SEQ ID NO: 723710 - DNA, 142 bp, Homo sapiens
ttgttgtcacatgagcaggcgctcgccagctagctctggccttcttttcccatgggtaaagcaaatagaaatgcatgatgataattcatgtgcggtatgtgggaggaggaaataggggacatctggaaaaaaatcttggcat

SEQ ID NO: 723711 - DNA, 381 bp, Homo sapiens
gatttttttagatggcaggctgaattaaacactatcgtgagttatctggggtagagactttttctccaacagtctttgaaaatgtcatagagcagagcctctcggactgcttctcgaaagaataaaagatggtcttatagaacccaaggagatcttggcagcgcttggcgcagctcacatgaacctgtgaggccagcctagctgcctgccagatatgaatgcctctcagaccctgcctgaccccaaaccaaggtgaactccacttgaagcaatattgggagcccaatactggcaggaggggaacacagccagagacactgtgcccactgccatgtccagcacccaagtgcatatcaggctgcaccttccctgctcagtccc

SEQ ID NO: 723712 - DNA, 1322 bp, Homo sapiens
ctctgccggccgttgttgggtgttttttcgtggcttacacggggtggttggtgtggacgtgtggtgttgttgtgtcggggccgagcggccttttgtccgccctcctcttgcttcgttgggggccgtggcacagcgtttgtgttgtccgcccacccgtggtccacaggcgcccatttgttgcgcccctctattggcttgggggaaccgcgcggcagttttttgggttgttttggggagaaagtgtgtgggtaacgggttctcgccgcggcctgtggtgcgcacggcactcttttttggcggccgcgggttgctaaatgctggcgttgaaaggaaagtgtttggggagaccccgtaaatggggaggggttaaccaaaaagtcctgccggcccccggtggtatgaggttctttttaaggccccattgtcccgaggtggaccccccccccctcgggtggaattttaagagtttttaaagggacaataatgttattagtgaggaattggggatgtccagtgtgccccaaggtggagcgcccctttatagcccgggaccccccggtacttttagcgctgggcctctatttcttaggtgagtgtcgcccgatatagggatatttttggttgtgcccaaactcttgtagaagattgataatatggatattgggcccaaaaagtgaaggtgcttctcggagtgtagggagactctgggagccctctttcctccgaggattttatatgtgttagtccccctcgagtaggtgagagtttgtgtttagatatgtcttgtgtggagaacccgcaagagaagggttcctttttttgtgttgttaaggatttttcacgggagaaaaaccttgggggttaaagtcttgagaacccactctcttttgagaaaggtaatttgtctcttccccttgccacgggtccaccccctaatcacgtccctgtgagaaaggtgggtttcttcttaatggagaagcgctttggttttgccttctcctaccaaaacacatgcgttaatgtcccttaaagggaatgtgttatgagggttatcctgttggagatttcttcttggttgttcttggtctttacaccacggaaaccttggtcttaatggacccttaatacctttgtttaggatgaggagtcttttgtgtcccctggaccagtagtcttgacacgtatttctccccttcttgtcccctatgtaagccccacgttgcctgtatcttgagaccacgtttgagctcttttttgtaatatacgcttataaccctgttatttttgtgcttataataacgagatgccaggaccccttgtga

SEQ ID NO: 723713 - DNA, 775 bp, Homo sapiens
  misc_feature (548)..(548): n is a, c, g, or t
  misc_feature (775)..(775): n is a, c, g, or t
aagaagcaggtacaggcagacatgcagccaggctccagggcctggacaggtgctgccatgccctgtgacaggaggaccccgagccccctgggcccggtgggaggggccatggtgctgcctgtccaacatgtcagcctgaggtgcggctgaggctggctccagcagctggtgtttgtgaccctgtggcattccgttggggagccttgtgatggccaccgtgtctctgacccttcgtccattgtgagcggtcccaccgagggaggctttgaggctgccatcgctgaaaaccattggacacaccatggggactaaatgttacagtttgggtcactggaacttataccatttggacaatgactcgtggtggactggtgggaggccccccacaatcccggcgttggggtgtgaggcaacggtggccgtttttcagaggggtgccacggtggattaccactggtaaccgtttgggccgaagggccacggtgggggcaagccggaaaccatttactcccgtgggaacgcagcattttctccgcttttccggacanacacgcccgcgcgggtttgtcggaatgtttcccccccgggcgggaaaacccttagggccctttgggtagggacgggtgaggccctattaggatatcatgccagaatgtcggcccttcgcggaagcccgggtgggcattaaaaatggcctcctggcttggcattaaaatgcggtttgggcaccgaccgcgagaatgtgcggaagccaaaacggcccaaaacgtgatan

SEQ ID NO: 723714 - DNA, 684 bp, Homo sapiens
  misc_feature (203)..(203): n is a, c, g, or t
cacatgtcactgatggtcaaattccacaagtcctttcttcatactgttgtggacaatctcagctgggtcattatgggcaggtggttcaaccagccagcgggagccctcctgatatcgtggatttgtacatgtgaatcttgtcaggggtcaagttcctccagtgacctgtactaccgacttactgctagagcaggagatcttgncacgtgatgaactccgtcgattgaattttttgtagtcagtagatgcctattagaaaaaatcggtctacgtaacctgtgcgtttcaggttttcagattactttagtaatccttcttgcggaatctagaggcgtgctgtgcttgaattctgatcgtctgttcgtccaaggggatcaaagtggcaactcattatataccccgatggacacgtggatgattcttggcttagacattattcgatctgacgtcgtataacgttgggtcgacgtgacgatgacatagccctgcaccttggccagagtgtccacagggcgagataggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaa

SEQ ID NO: 723715 - DNA, 455 bp, Homo sapiens
  misc_feature (368)..(368): n is a, c, g, or t
  misc_feature (377)..(377): n is a, c, g, or t
agcatgcctgcagtgagactgtagagtagagcatcaggctgggagggaggtcacatatcgctgtgagcaactgccgcacggtgtgcccggtatggtgcggtcacctacatcaacgaggtgaccacggagatccgggttgctgactccacgaggaagccggtcctactggacaagaataagagccttcaggtggctctgacatccaaacagcagagtctggagactgccatgtcgtttgacgacaggaaagcatgatgcgatgtgaggaacggattcctaatgaggaaagtggctgttttcttcagcaacacacccacaagagcatccccacagctcagagaggctgtgctcaagctctcagatgcggngatcacccncttgttccttacaaggcaggaagaccggcagctcatcaacgcttttgcagacaataacacagcagtggggcatgcgct

SEQ ID NO: 723716 - DNA, 578 bp, Homo sapiens
aggatgtacttcgccgagagtcgtctgggttatcctgcttcaacagtgcttggactggaacccggcgctacgttccaccacccctggccggccgtcccatagaccatggccctccgatcacctcttcaccgcaccctcgtgactgccccaagtgtttctcgccgccgattccagaggaccgagcagaacagcgacgacacgccgccgcctcctcacttagtcgcccagcgcatgacgactcgtgtcaacccacgcagtgcagcgcacagaacataccaaccaggacatcaagaaggctgccaagacaagccgccagaatacaaagctagggaggcctacaagcgaacgtcaacaaagagtacaccagatcccaatgtcgtagacataccgagaggcgacggcggagtgaaaggaagggctcaagcaaggaaacacacgccacaacaaaacaagacgaacaaccaacaaccacaatgcagggaagacggggaaccaaggccggaagaaaacaagaacgaaagcaggcagaaagcgacgaagaatggaccaaaaaccacccacacagagacataaggcac

SEQ ID NO: 723717 - DNA, 321 bp, Homo sapiens
aaaaaaaaaaagccccccggtgtggaccccccccaagtttcttcctccctgtcccctgagggcacactgaccgtggaggcccccatgcccaagttagccacccagtccaaagagatccccatcccagtcccctttaagttgggggcccagtttgggggcccaaaaattgcaaaatccaatgagaatccccccaagtaaaaccttagcccggatgcccccccctcctgcccccacgggatgtgcctccccccccccctgtgtgtttttttaaaacatttattttttgtttttttcaaaaaaagttcaaaacacccccctgta

SEQ ID NO: 723718 - DNA, 295 bp, Homo sapiens
  misc_feature (247)..(247): n is a, c, g, or t
gaatcagctcgtaccctctataagggccaatctgtttcaatattcttagaaagtgtagtctgtatatcatgtagtactgagagtttgaggaaaaataaatgttgatcagcagaccacgtatttcaaaattctgaatcttctgggcacaggggttgtaactcatgccttccaaaggggacgagtgcaggtgggacggggccatgatatggaggaaatggtgtaaactgaatgtatttctttattggcntgttattcctgtataacactctattatcttggcctatatccgaggggt

SEQ ID NO: 723719 - DNA, 411 bp, Homo sapiens
gccagtatggagtgagtgctgcatcttggctcactgcaagctctgcctcccgggctcacgccattcttctgcctcaggctccgagatagctgggggtacaggtgcccgccaccacgcctggctaattttttgtgtttttagtagagacagagttttaccatgtaagccaggatggtctcgatctcctggcctcatgatccacctgcttcagactcccagagtgctgggattacaggcgtgggtcactgcccccaagagcaagtaccttttaaacattcgagacatttagttgccatcctcaaacccgtttgggtgtgtggagagaatgttgggtcgtgacatggttgttagttctctaaagatgtcagccatcactcatcactgtgtgatgggcacacattatgaggggga

SEQ ID NO: 723720 - DNA, 106 bp, Homo sapiens
  misc_feature (11)..(12): n is a, c, g, or t
  misc_feature (39)..(39): n is a, c, g, or t
cctgcccccannctcccagcctatccccccaacagggcntgctgggccacccgcagtccatggcttggctgtggctccagctctgtagtccctgctcctgctggca

SEQ ID NO: 723721 - DNA, 232 bp, Homo sapiens
  misc_feature (232)..(232): n is a, c, g, or t
ccaggtcctatacagaaggcagtgcaagacattgtaggggctctctgaacagtacacgatgtgggacggagcgatccaatggtagaaagaacgtcgtataagatcggcccattattgttctaaggtagacattattgaggagaagggccatcaaaagcgtagagaatgtgctaagacaagacgagaggttccacacaccaaataagtcaacatctgttctcctgtcgagcgn

SEQ ID NO: 723722 - DNA, 404 bp, Homo sapiens
  misc_feature (15)..(16): n is a, c, g, or t
  misc_feature (135)..(135): n is a, c, g, or t
  misc_feature (320)..(320): n is a, c, g, or t
aaccatccacaacannagctcaccagcagtgttgtccatctggaacataactaaaaaccaggaattatgcaaaaagttccctgagtaggcaaaatagatgttattttaaattcatgcacctaaagctcataaganctcaaggttttagtatttatataatcaacatttcccacttaatggcagtaatccattacctgaaaatcagatgttctacattttaaaagctgaccagaaactatttcccattatttggaatggaaaaaaatataatgtgttacacatcagctttaaaccaacaaatttcttaaaaagtaactaanacacagaaaagtgtgtatatgtaagtaacggaactaccattattgttatggtaaaatgatcaaaccatgtttgctgatcatcta

SEQ ID NO: 723723 - DNA, 260 bp, Homo sapiens
ttttttagagacaggatctcactgtgcgcccaggctgaagtgcagtggcacagtcacggctcactgtaacttcaaactcttgggctcaagtgatcctctggccttggcctctcaaagtgctgggatgacaggcatgagccactgtaccaagctgacatatttttgtttgtttgttctcttttcttttcttttttttttttttgagactctgtctctaaaaatacataaataaaaacaagtacaaataaaaagggaaaaat

SEQ ID NO: 723724 - DNA, 470 bp, Homo sapiens
gggaatggagatcttgtttcttatcttgacagcatgggaaatatataaagccagcttgatattacttgtgatttaaacaacatttgttgccatcaaaatgaccttgtcacagtatgtttcacatgtaagtgctgttttgcctcataattgtaggttgaatttattagaaagcattattaagtttgcagcaaaagctaatttccaaagctattcagtgtttgaaaatagtttgagggtgattctcctcatccataacgaattcagcctcctgagtagctggggctacaggcgtctgccaccatgcccagctacttttttgtatttttagtagatacggggtttcaccgtgttaagccaggatggtcttgatgtcctggacctcgtgatccaccgggcctaggcctcccaaaagtgctgggattaccgggcgtaccacccacggcccggccccactctgaagtaatcttaag

SEQ ID NO: 723725 - DNA, 656 bp, Homo sapiens
actggggcaccaccccaggttttgggcaacccccccgcccgttttccaagccgggggtccttccctcatccaacaggtgggtattgaccccggcactgagattgacccccaggccaggttcccggaaaaggccggaatggactgggtcccaaggacccccttcatttgggccacaatgggctcgttatggcccaggtgcgcaaaagctttttcagttcttgcgggtagagccacacaactcactggcaaaagcagttgggcgtttcagcctcatgctgcatggcctggtgacccccagcctcccttagttgttaagcctcccttgcccaggggtgggatggcattaaaggccagcatacagccctaggttggggcagggtcacggctggcctttacctgctcaggcccccatttttggggtgtttgggggtcagggagcagggagccctgcccgtggtttacagcgtgtggtagtcaaaaggtttagctgggcccagggcaggtattgcgcctgcttgggttttcccacgcctggagcatgcccctgagattgtgaccccccttgaggggaattttccaggtccctttttccctcaaatttggatctttttgtttttgaaaaacattgagaaattcaattaaaggcttttggaata

SEQ ID NO: 723726 - DNA, 909 bp, Homo sapiens
gcaggggtcctctctatctagctccaggctctcgcctgcgcccactctctgcgtccgctgtctagccgaccgatggccgggcctcctgtcgcgccccgctgctcctggctgggcatcctggccggggtcgcttgcgtgagccccgcgggcgggtccgatgtctcggaagccgacgcgcctggtgggaggcccccgtggtaccgccagagtggatgacgcgcgtgtgcgtgagtgcactcggactttgccgtgggcgcaatgcaacgaaacaccagctagcgactatggtactcactagtgcgcgacgcttggtaggtggtgtcgcagctcgcgacaagccaaagtcggtccctgtgggggtgatgctacctttcttgggaccgtgtagcatggagcgctgatcatagtgtaccataggacaccagctcatcttggagaaagtgtcccgttccactgaccatgagcaacttcctgtaataaggacaggcattcttgatacatgttcacatggatcgtaccagctgttgcactatggacacgcggccaccaaatggaacccttgtccgaagattgcacccttgttgcagagaccgaggctaaggcggtctagttaccgggcgccgtgctgctgctagccactactcaagcttttatatggagtgtacctcgtaccatggccatggtgtaattgaaataagtgggaaattgcgagggagctatatggatagggacttaaaagcactaagggaaagtcaggaacgtaccaagataatgagaacaaataaactgggatttatatacacagtgattgactaaatgataaggtatagagacactacttaatgaatttaagattatgaaaacacaaggttaagagatagaacacgaagcggagaaaagtctaatgaa

SEQ ID NO: 723727 - DNA, 1102 bp, Homo sapiens
ggccagaatccccggctaaatgctccttgattcttaacccacagaaatgtgtaagaactatgtgactcctgacatggtggaaacaacaacaacagcaacaacaacaacagcaacaacaacaacaacttaaatgctgaggagtgaaagtgcctggtagaagtagcctcttaccctatgctaatggatttcttcaacagggggaaataaaactctcttaaatgttacatctttttgtttctaagaatagacagaaacaatactgctctgaattacacttcggatgactaagccaagtgcttactctcttcagtaatattatctctgtggtttgcagcaacactcttacattgtatgtaaagaggggtagcagccatggcattctcaaaagaaagaaaatgcaatatgaagatcatcagtcttggtgccaataccataacaggttgtaggggactggagctggtctgagagccttaggatagcaccaaggtgtggccttggccagataccttcagttgtcctaggaccttattctgatcccatgtgacagctagacctccatgaatggaaactgaatgaaacaaagccaacattcccaaacacccaagggtgatgggggattgacaaagtcctccccagcaaactctcctctgagtctagtcaacctggaagcacactactcactcttacctggggaacagaggcctggtgttcatcgtgccttcggaacaaaacaacatctgcaggacaagaaaggccttagaattgaggtcaagagtcataaggattggaacttaccttatgagatcccggacagatcccagaaatgacacaggattcccttcacgtggccacttgagaacggagagaaaccacatgatgagacagttggtgaaccttcctggtccaggggaattctccatgggaaccacgcggagagtacactctggcactgtaggagcccaagacaggcatggtggtcatgttacgaacccacgttgggatactgctggcccacaacagttcacctactttatgcctcggtgctagccccagcgatgctagaaggtggtctccaccatagtgtcgccgcatgtaatcagag

SEQ ID NO: 723728 - DNA, 600 bp, Homo sapiens
aggaattcggcacgagggaaagtctggcctgttctagaagcagcctgtgcaataccacactggtgctctacgctgacgcgtaggagctgaataggagatgtgggaagctccccagtcaccgggaatcactccagattgtgcaaacccagaggcacacgctggtcactcggaccaatgccagggctggctgactgactgctaggactttctcacagactttcttctctagacgcactgaaggcctcacggagccatgtggtggcggacttgaatatgctcaggactgcagtggacagcctgtgtgcgtactactgcaagatatatgccaccgagaacagtctggactcagacacggggttactcgatgacctgacgaatgatccgcatatgttcgctggtgcagtggctgagatacacagattggtctcaatgaattgagtgtacattgcgccgaattatagtcccagttgttattgcccaatgagtggtcctttcccatgctgtccataaccacccagtatgtggcccctcttgacctattgtacctcctgcacaacaaggccattgcatatctactccccggttacttaatttccatct

SEQ ID NO: 723729 - DNA, 173 bp, Homo sapiens
cacatttgggtgacaagtaaggataggcatatatgtattaagaatgtctctggcagcacctaagagtagaaagaattttcctgttaaatgggtacctcaaggacagctgtctccttgtaaaaggcagaggaattactaaacttttgggggaataaaacgaacctcaatattta

SEQ ID NO: 723730 - DNA, 965 bp, Homo sapiens
agcggaaagggtacagaagccctgggaaggacgggccgggctctggggccgagcccttgtggtccgggccatggatgtgcgccggctgaaggtgaacgaacttcgcgaagagctgcccgcgccgtggtcctgtacacgtcgaggccgtcaaggtccggagtgttgcctgagcggacatgcagggggcggtggaggccgaagagccgtgacgacgagcgggacgctcagacgccgatcgcacgaaccggggcgacccgggcacgatcgaacgaggagatgccagtggtacgaagtacttaaccacggcaggaacccggagttctagcggagtacccgcaaggatcagtctaacatcacagacaagatcggacgtcacgagctgacagagcagggagaccatcgtgggacatcttggtaggacccgacgatgccatgggcctacttcgtcaccaagactactgaagagatcgaggaaggaaagtagagacggcgacaacggaggaccacgcgcatcgcaaagacgtttgcgcatactctcagcccttgaaacaggacttactactaagtccttcggatggcactagaccacgcgccgagggagtttcgccaagaagtctgagacatgaaggcgctttattcgtagggaaaaacacggcgcgacaggagtggttactttttgagactacctggaaggacgggcttatgtgatgcggttggcctgcgctcgttcacgtccatgacccttgctatgacttgtacatggaagggtactgataagaatgtgaacctcttcacattgaagttatcccccttgagtttgtcctttttggactatcccttaattaaaacgtgtcggatccattcccattttccagagcgctggacctccgttgcaatcggtcagttacgtgggcaatccttcctgtgttcccgaatttgcacggaggcatttgtcaatacgcagt

SEQ ID NO: 723731 - DNA, 325 bp, Homo sapiens
ttcacagggtgaagttctctctctactctttggtgaacagtgttactaacagacatgaaaaatatcgttgtataaaccaaaacatcctaagtccactttgcggcagtttacacctcaagcgttaacctctttttgtgagaaacttgaccgcacagagatttggtacgaagttcacagaaaaaagtaatctgccacctgaggtgtatacaacttggggatccgtgcacgttaacgattactaggactatgcagaaaccagagagtttaagaaaaccgcattggacacaaaccaaccacccccaaatcccactcctcccctcccctc

SEQ ID NO: 723732 - DNA, 171 bp, Homo sapiens
cgctcctatacacctatagcacactgagctggctgacccttatatccattctcgtagtctctaacacgccctatgcgccaggcgcgattcgtgcagatgcacacacctgacatggcgcgttgtagactataagagttccgcggccgaacgacataggctatggacatggtc

SEQ ID NO: 723733 - DNA, 640 bp, Homo sapiens
cgcaacgcctgacgctcagactactgactgacttttacgaagccgccttgtagacataaggcgcagccgatcgccctgcgtgacctgcacgtggattacacgctgggaccgagctacgtgctagtcagactggatatcagcctggcactgatctctgggatcaccgactgacgtgagcgacgacggcgtcagcgtaccgtcgtcctcacgacctctgaaccgacagacgccaacggctatacatgacagcatagctgtgacacgccggtatggagttaccagagtcgactgacacatctcgggatgacgtgacacatgcgtgcctagcgctagatgattcgccaagagcctgagcttagagatgcactgactagcgctgcaaacgcgttaatgaatgaacccatgagagagagttattacagtaacacacctagtaggccactgaagagattgcacatgagaaagcgacagagctgagcagacaggtgcctaaagacatggcagacaactaggtgcctattgatgttgcattcgaacgatgtgtgactcgaaacaagaacttgtgagccgtataggagcattgaagacatgcagactcgcttattacctggcatagtctagaacactgtactacgtgctg

SEQ ID NO: 723734 - DNA, 656 bp, Homo sapiens
  misc_feature (14)..(14): n is a, c, g, or t
cggcacagtggttncgctacgttagcaggatgctctgatctcctgaccttgtgatccacccgcctggctcccaaagtgctgggattacaggtgtgagccaccacgcccagcctatacctatatattttaatttaagatgggggtcttgctctatcaccaaggctggagtgcagtggcataattatacctcactgcagcctggaactcccaggctcaggagatcctctcacctcagcctcccaagtaactggcactacatacaggtcaggtgtgcaccacagcgcctggctcaaatcataattttttttttgagacagacttttgctcttgttgcccaggctggagtgcaatgatgccacctcggctcactgcaacctctgcctcctgggttcaagcgattctccagcgttagcctccctagtagctgggattacaggcatgtgccatcagtcctggctaatttttttgtatttttagtagagacagggtttcactatgttggtcaggctggtctcgaactcctgacctcagatgatctgtctaccttggcctcccaaagtgctgggattacaggcgtgagccacctcactaggccttacttctttttcctttttgtgttttgtgagacggagtcttgcatctcgctctgtcgctca

SEQ ID NO: 723735 - DNA, 816 bp, Homo sapiens
tctagcgagatccttcaagcaatcactatgtccccagcacgaaggtgtgtcccttccttcatatgagtgacatggaatcatggtatcaaaagtcatctaaaagcgctaaaggaggcacgcattcgtcacccgttggcacatagcgggtttcgtgggcgaacttgttgcggtatgtgattatataaactgaagagcagcggtgaaatacgtatatgtgtccatgtcattcgtgatccacatgcgtgtggcagtccaaggcttgtcgtaggagcaatgactgttggtatgggctattccatgtatcgggaattctgggcaaaactaagccttagaagcagagcaggctgtctatggtctagtcggaggagccttgcttccagtgtaaatgtcttatattaaaacgttacctattctcgtggcaccatacactaatctgtatgggtacgcatggtaaccatggccatgccgagctattggcttcctttcttgcaggcttgatatgcttggtgaccgacttatagtgactaagtttactcaactaggtcatcacaggaagtcacgcttagctttcatacatgtgatctacaatgcagtggatggtgttgcacatgcccacccctctcaactttttccgatgaacttagtcttcaacagaccaataccggcaatcctgacaggactccctgttgctgacgaaggcgcgcaaataggatgtagctacagaggcctatagcccagttaatcacctttgtctgcggttcgtggaggcggccggacacacggcccacaggtcgcaaactgtgagcccaaaaaata

SEQ ID NO: 723736 - DNA, 882 bp, Homo sapiens
ccttcttccgagcctctcctctggccgccgcgcgggaagagggcgagatggcagatgagatggccaaggtcaggtcgctcggctggtggcgacacgatcttggggaagcatcatccgcagggaaataccagccaaaatcatttgggaggatgacggtgccttgctttccaatgaacattccccctcaaagcaccaacacatcttcgcgtggtgatcacccaagaacacatatatcccaagatttcgtgttggcacgaagatgaatgatgaacagtcttctggggcacaacctccacttgatctggtgggccaacgaccactggtgctggctgactctggggccctgaaacttacaggggtcaatccggacatgtgcgtcgtctagcacatgaaaaggtcacagattgggctgcgcacaagtcctgtcctaatcacgggtccatctccagtgtcctgtgggacgtgtcggcaaaattgcattggggcctcccggggttacagccacggttcgagggcgataatttcctctttctttagcggcaacgtggatctcaacgttcagggccactttcccagggtcatgttccacgcggttcaccccacaacttttattttcggggccgtggtggttaccttggcgacgacggactctccacacacgaacaaactacagttttcaaacaacccggcaacttccagttatttcacacaccgaacgactggctcggccgtgggcttattcacaacacagcacagcacaagccaccacacacatacaccacacacctcatgtttccgacgccacccgggcccccccgaagaaagcacttctctcacacaaaccctccgcactgggggcgaccaccacacccggtcgagcca

SEQ ID NO: 723737 - DNA, 856 bp, Homo sapiens
tcgtcgtgatctctacacctccctcgcggttccaacgtgtttaatggccctccctaactctgtcctcccctccattcccaggggtcctcctggcttcccctcctggaaatcgtgcacctctgaatgctggcaggtcatttacacccccaccggggcccaagccccccgccatggatctataaactaaggcttcgccccgcacagaactcccctgggcaacgccacccccacaatgggaaaatgtcccaccactgatccaccaagcgtaaatccgaatctcccaagactccccccctgtgccagcaagacccaccacccccgccacaagtgggccaaggatacgacacgacaccttcgtccgaagaagacatttattgccgccccgaacacactcggaaaagctcagtcacatccctggccactcagaagtatgcccatccaacccccatgagaaacccgtctcaccccccggtagacattggccagtccgttataaagtccggaaacccaaccggctgctggagaggaagtggagaaaataaggaacacctgtacacccgcttggtgggactgtagaactaggatcacacccatgtggaagtccaaatgctggtgatactcctcagggatctagtactaggatacccgttgaccccgcccatccccttgctgcggtataaaccccaaggcattgtaaaacaagctgctgtaaaggcgacacacacaaagaatactgtggcaccaatcaccactagccaagacttgggacccacccccaaagtcccaccaagatagactaggttaaaaaaatgtggcacaaaaaccccccgggaaactaagccgccctaacaaatga

SEQ ID NO: 723738 - DNA, 864 bp, Homo sapiens
caaaattttaggattttttttttttcttcattacagattcgtcttttttttttttcttataaaagccgtaacccagtcagacaatttcaccttcatttaggcccctgtccgggtttactttaacggggagctttggcctggcctggtgctatttaactggtaaaggctagagcaccaaagtttctggccttctggattatagagaaatatgtttcacctctgattaccctgtctggtagtaattcttgatgatagccagtgaggttctaaaagttggcagtatttctcccttgatgggaatgtgttgagtgagggtaagggaaagaatatcttattcttttatgatgggggcaattgggctaaggtgcattttaaaattccctctactaaatgggtgtttccagagatagggaaaattttttttggcacagttttactcccacttggggaacgggatgctgtaggtggaaccatttatagcctcagatcgatctttcctaactaaaatttttaaagcctcttgtgtgacctcctcttacacaagattctctggtttagagaatcagatcacagatacctctcagggtgtggcaataataaatccgttctacaatagttgtagaaatgtcttagtggtactgcgggaatttccctaaatatccatagttaggaagccaggtcttatgggcatctgctgcgggccgccgacagcagggaaagacgccccccaccccccaccacaccacccaaccggcgcttgacgaccttgcaggacctgcacaaggtcacgtcgcgcgatcactcctaggacgcttgaccatatttcacgtgtttgatatatatccccccgcacgtactactccc

SEQ ID NO: 723739 - DNA, 251 bp, Homo sapiens
atcatccatccagccctcatccagctggagtcaggcctgcaatcagcaatgaaaagtttttattttcttcacggttagaagagggacagcctcttcacggttctgcacctctatcccattaatctggataatgcggtctccctcatcggatgcgcccatccgttggctgcaatgctggttagggtcaatctcactgtatataaatccctatgtcgtcttcatcgtccgtccagcgcaccaggaattcgccg

SEQ ID NO: 723740 - DNA, 848 bp, Homo sapiens
  misc_feature (17)..(17): n is a, c, g, or t
  misc_feature (26)..(26): n is a, c, g, or t
tcattggttggtccccntgatggtanggctatagtcgaccaggcccccgagatgatcatggtgtacgcaaaagcatcacagtgattacttcggacgcttgtgaactggagcgatgtgcaatgcactttcacttgtggcaaaaatttcgtggacttgagcattgaagagtacattcgggtttacaatgctgtctgggagtatatttattgatgaatattcaggagaatcattatatctgtgaaaaatctcaagagtgtcttaaagttgactggagagtaaaggactcctacatgaaaagaataaaaggaacggcatgtagtagatctctactgggaatggagaacccctacctcaattggtacatgtaatgcgaagtgatgggacattctctatatgaaaccagagaatctatgcaggattgaatattagatcggaaatggaccaagatatcaatattgatacaaatgatatcatgtgagcagattaaaagtgacaagaaaaagaatataaaaggaaggtataacagaaaatggctgaagaatcagtggggaataatgaacatgggagaagaaagaggatggaaagggatgatgtcgcagtttggaagtaagtaacagggtaaagtggaaagacatagaagagggagaataggacacataaggtggagcgacaacgtcagagaaaaggaagagaacacgacagagagaccagcaccagaacacactggagaaaaaagtacgaaaacaagcaaaaagaaagaaccaagacgccaccaaaagactcgagaaaaaagcgtaagagactcggagaaacgacagacaacacggaaccaaagggaaagacagaaa

SEQ ID NO: 723741 - DNA, 181 bp, Homo sapiens
attgaaaagttaccccaggtttggctaaagtgacataggggccaaaggagtgatggggaaaaagggtttgggctggcctcccctggctctttaagctcccctttggttaaaaactgggttttttgggcagttttttttaaaaagttggagtaaaaaaagggttaaaaaggaaaggccaata

SEQ ID NO: 723742 - DNA, 84 bp, Homo sapiens
cccacgcggaaggcaactgcctgagaggcgcggcgtcgcagcgcgcccagagctgaggaagccggcgccagttcgcggggctcc

SEQ ID NO: 723743 - DNA, 691 bp, Homo sapiens
tatgctgtgtcctttgcttccgagactcgcgtccaaggagatgctctcccgcggtctgtgctgctgcaatttagagtcctgttcccttctctccagttctccagtcccgttaccaaggagaggggagcaaactggttttgggcaagggctttggccattcatgtcaatgctggttgtgggtttttcaaggtgccatagccacccccaaatatgtttgtttaaagcgtggggttttgtaatctctgccacccgttgtcaatgggagtcttgtaaagttgccgaagggtaggttcatctccaggttctcgggattcccatccgtccttggcgatgcctgccagcagtgggtgggcagcctgagctccatcgggctcgcctgcacagcactgcgagtatcgttctatgatgcatccctgtgactacagccgtgacgacatgtcctacagagttaccatatgtggtcctctgcacttacactggaatggctatccattttagttgcgttatgtaatttagatcacgcggaagtgtgctgaatgttttgcagtgtgtaggggtttgagcaccgttgttcattcgtccttccgttgttatcctcccgattccctctgcatgaagtgattctgttgacaataatgtatagagcgcgatctcttcagctggtttatctgcagaaatttctctggtaact

SEQ ID NO: 723744 - DNA, 482 bp, Homo sapiens
tctagaggatctcccgtgtgtgtacatgcagagagcagctgggtttcccgcccagccggccaggtgaaggaagaggcacgtgctcctcagagcagccggagggaggggggaggtcggaggtcgtggaggtggttgtgtatcttactgttctgaaggggcaagtgtgtttgttggtttgtagtgtatcttgttttactgatcggagcatcaactacttgacctgttgtaggcagctatcttacagacgcatgattgtaagagtaggaaggggtgggtgtcagggatcacttgggatctttgaacatttgaaaaaattacacctggcagctgcgtttaaagccttcccccatcgttgtattgcagagttgagctggcaggggaaggggcttgagagggtgggggctgaaacccctccccgggaggattgcccatctgggtcttccatcttagaacttgttacatgacagataagatactcactg

SEQ ID NO: 723745 - DNA, 160 bp, Homo sapiens
tttgggggtaaaaaccccccccccaaaaagtgggacagcccggggcctttttttaaaggaccccgggtttttttaattggggcccggaaacccaactggaatcaaaccccgccttttaattgttttttttaactttttaaataaaacctttgttccgtta

SEQ ID NO: 723746 - DNA, 563 bp, Homo sapiens
ctccacctcccagccgcctgccttggcctcccaaagtgccgagattgcagcctctgcctggccgccaccccatctgggaagtgaggagcgtctctgcctggccgcccatcgtctgggatgtgaggagcccctctgcctggctgcccagtctggaaagtgaggagcgtctctgcccgggcgccatcccatctaggaagtgaggagcgcctcttcccagccgcatcccatcgaggaagtgaggagcgcctctgcccgaccacccatcgtctgagatgtgaggagcgcctctgcgcacagatcggcccgtcgtgggatgtgaggagcgccttctgcgctggccgcggatcccatcatgggaggtgaggagcgtcgtctgacccatgcacgctcccgatcgtgaggaagctgagggaggacgccgtctggcccgcgccgcctgcctccgatcatgggcaacgctgagagacgcgtcatccggaccacggcgaggcaacacgattccagggaggaaagggtgaggggagatcagccacacccggcctggggcagccgaacccgagggg

SEQ ID NO: 723747 - DNA, 338 bp, Homo sapiens
tcatagctggatacgggtgtggtaggctcacacctataatcccagcactttgggaggccaaggtgggcagtcacctgaggtcaggtctttgagaccagcctgaccaacatggtgaaaccccgtctctactaaaaatacaaaaattagcttggcatggtggcgggtacctgtaatcccagctgcttgggagtgtgaggcaggagaatcgcttgaaccggggagaccgaggttgcagtgagctgaaaccgtgccattgcactccagcttaggcaacaagagtgaaactctgtctcaatcaatccatcaatcaatcaataaaatagaggtcatgctgacta

SEQ ID NO: 723748 - DNA, 241 bp, Homo sapiens
  misc_feature (51)..(51): n is a, c, g, or t
tcgacggtaccaacacacaccaggccagaacttagcaactgaggctgctanctgagaagtacgcactgttcttggcttcatggagaccatgctccatttctggtgttgaagtctttgagagaacaggatcatgggctgagatggcaacctcctccccatgccatctgcagagcctgaagaggaaaacacaaatacaagttgaggccatcttctttcccctagggccctaaacctctaagcc

SEQ ID NO: 723749 - DNA, 318 bp, Homo sapiens
tttgactctctgggtaatatagaagtgaattgcttaggctgggcacagtggctcatgcctgtaatcctaacactttgggaggcccaagtggatgaatcacttgaggccagtgtcaagaccagcctggccaaaatggtgaaccctgtctctactaaaaatacaaaaattagccaggtgtggtggcgtgtgcctgtggtcccagctactcgggaggctgaggacagagaatagcctgaaccgggaaggcagaggctgcagtgagccgagattgcaccactgcaccactccagcttgaacaacagagcgagaatccatctc

SEQ ID NO: 723750 - DNA, 150 bp, Homo sapiens
gagtcggcccctgtttgtgtcgtaagataatcggaggtaatatgacattatcaataaaacgatgacacatggtggggctatgcatctagccctgcagcaacactgtgaaagtccattgtcatcctcccatgaaggcaagctgttcgtagg

SEQ ID NO: 723751 - DNA, 1308 bp, Homo sapiens
ggacggctgctgcgcccgcggctccccagtgccccgagtgccccgcgggtccccgtcgtagcgggaagtgggacccaggccctaggcagaacccaggcgccgcgcccgggacgcccgcggaagagagccgactcccgtcccacgtcccatttcgcccctcgtgtccggagtccccgtggccagatctaaccatgagctaccctggctatccgcccgcccccaggtggctacccaccagctgcaccagagtggtggtccctggggtaggtgcttgccgtactcctccgtccgctccagtcgatgcccccacatcgggctggataacggtggtcacctagtgcggaggacagattacaaccagagatctatctctcgtgggcatggcggacaatagtgtctgggacagtttggcaggatgccagacgatgccgcaaagcgtgtacccttgggtgcccctgtgggctggtttagccaaacaaaagggaccacactggccgtggatggaggctaggggcccacgatactgaccgaagtccaaaccttgtccccgtccgcatatgggacatggtatctcgaactaacctattggaggcataaaacacaaccgctccagcgaatggccactccacgtatttccggtcaaatattcccaaggggagcctcgcttgtggcccgagggcgatagcccccattaggtctcgctccccctggcatgaagcgagagtcactcaaagaggaccgctaactcggtagggaacgtgaactcaggtaaagagttacacgatgcgtcaaggtcgtccaggatggcaagagtcctcatgagagcaaagaagaggacacagatgacgagaaataaagccaaggaaaaccacggggagccgggagcaggggaaaccacagcggagaggacgcccaagacccaggccaggaagcacacggagcgccgagtcacactagatggttccccgggtattaaccccccaagcgacaagtgcagagggcaccggagaacaaacgaaaaaaagagaaaacagacagaaaaagaggactaaactgggtgacgtgggaattgtgtccgagcgagagggtgagaaatcaaaatatcaagaaggagtaaggaagaatggtcatcgaatggacacgaagtggagaaacatgaggagaagtggtgagcggaaaacagatctaaaattatcgaacgacgagtggaggcgaagagcaaatacgccggagagcaaaagatcgaacaaagatgagagaggatatatgcaaaaatgtgcgcgccgatctcgtgtcgcgaatgaaaaa

SEQ ID NO: 723752 - DNA, 1308 bp, Homo sapiens
gagtccgcgccccgcactccatggagcagctgctgcgcgccgagctgctgcaccgctacccgtgcgggccttctggcggccccgtgctgccggctgcatcagctgacgggcctgagcctacgacacggacgcagggcccagtgttcgtcaaagtcaacctgcgaggactgcagtgcccggcagatgttggaagggggaggtggccaggccttggatggccctccgagatgcacgggcctgcgtgctgtggtgcctgaggcccatgaagtgtcatcgacctgcctgggaggtggggcccagccttatgtgatggagcaatttgaacgatgaacgagcttgagcagtcaagcatcaaaacttggacgagcaagatggcacgcatttgcatctttacaactcagcaagctcagggagcacggtcgcaccgcgaggcgcgagaaacacaggtggtgcccgaaagcaaggtgaaggcgtgctgacgccctcagatactggtggcacaaaggtacgggcattccacaactggatggacgctgacttgcgtggcttccaatcccgcaaaggtggcactgagtgggcagggacttgaccttgggcccagacaccgtatataacgccccccgagaccacccggggaatccaagaggcccgcacagctatgggcaccccatccaataggaggaacaggtgacctaattgcattgacaccgaagaaggggcacggagaacacaacatgggaaccacgcgagaatcaccacagggttcgacatgaatacaccctggggaaatcatagagtatctattggaagcggccctaaaagaaggacatagagagcaacccagacagaatatggcatccccacgagagaggggacatccatcgatagcgcacacgagcagaaacacaccgtttggcgccttgactatggcaccgaacagataggcaggagcccaaacataacttatatacatcaacgcacgcggaggctgttaccaattatcccttaatatcgggcacaacattaaccagaagacagatattaaggacaccatggcgacaacctcgcgcccatattgagcagggatgaaggaggcagagaggggtcaccacccaacagaaaatccagtttatccttattaacgccacggagccattacaccaacacccgagcacaacagatgtacctgcccatagacgggaccaacactgagcgataatcaaacacacagcaggcgactgagatttagatccaaacaccacagcatgtttaagacataacatcttataagccactcttgagaaaaca

SEQ ID NO: 723753 - DNA, 407 bp, Homo sapiens
  misc_feature (24)..(24): n is a, c, g, or t
  misc_feature (205)..(205): n is a, c, g, or t
  misc_feature (210)..(210): n is a, c, g, or t
  misc_feature (404)..(404): n is a, c, g, or t
gtgtgtgggccccacccaaggtcncctgccttggttaagtttaaatggtccagcctccataattgtgccagaagacttcccttaaatgccctgcaatcattaagttcctccctgtcctggcccaggcatggtgcctcatgcccataatccccagcactttgaggggctgacgtgggtagatgacttgaggtcaggagttcgaganccagncctgccaacgtggccaaaacccatctgtactaaaaatacaaaaattagctggcatgatggtgtgcgctggtagcttcagctattcgagaggctgaggcaggagacttacttgaacccaggaggtagaggttgcagtgagccaagattgtgtcacttcacttcagcctgggtgacagagaagggctctgtctaanata

SEQ ID NO: 723754 - DNA, 141 bp, Homo sapiens
caaaaggaacaccatttttaattctgaaaagtagcataatgtcaagccataagccatgggtccaccaatccatacggcttgtttccaagccagccatcccttctgtggttcttttcgccaacccgaatagtagtagtaggc

SEQ ID NO: 723755 - DNA, 300 bp, Homo sapiens
cccagcacttattacttgtatcaccattccacatacccatattggccacctcaagatgaaaacagataagtcccctcaatgtttactggctctactcccctaatattaaacataaaaccacattggaaatatagaaattcaaatagaagttacataaacctgtcataaatcgtatactaaaaactatttgtgggacagcatggatcacaaatggtctactgtgtaaatcttagaatgaggcagacaaaagttggaaggccggtttattttcccctccttctcctgcttcagattcgtctc

SEQ ID NO: 723756 - DNA, 828 bp, Homo sapiens
tactcgctgacatgggacccacttaatgatatgatacagtgttgaaaaatgatggtgttattcagaccacatgtgaaacactcgtactccaattggttagcggtccccaagaatgaaacatatagccaaccagtgcaacatgaagaaagtagcaacaaggctattcctcccgcagaacgctgacattcagagactccctctggagagtgaatctcagatcagtgaaaccagagtgcaatgaatgaaagaagaggatatagaacttgggatgacgattccagaagttcacatctgagatcatatataaactaagacacatggagagaaacttacgaagaacatattaatggctcattcgagaatcatttaggtggtcaaggctacaccggaccacgggattagttttcgtgcaagcacaaaagagctacgttcagtcagttgttcgctccatgacttgttgcgttcacagtcagtaactaaaacttgcatgttcacaggtagaaagttctcctaccgattgaagtcacgtgagactatgaaacgatctggatttggcgctggggaccagatgttcaagattggattagggtcgtttattacagcaatcacaagtattccgaagaacaagaaagcctaggagactactgtcgagctcatgacttcccgcaatccttaaacttacgactgcaccagatatcctacatgagtattaacgtgagccatgcggtaagtggccggaactttcacccttgtggcaacgtgtccgctactaggtattaaacccctgtttccacagctcgtgttcacaccggactggtttaatgcctc

SEQ ID NO: 723757 - DNA, 543 bp, Homo sapiens
aggactcgaacggctcaacggaactttgaaatattcagaaaactatgctataaacagatgtgctgacatccaggatttgttgttccatttatagaacacaggcagagcaaatttagcataattcataagggccctaggattttcagaatagtaaatgagcattggcttcaacttaaagtcaccagctgtataagcccctaacaagagagtcagcctgtcctttttttttttttgaaacaaaatctcactctgtcacccgggctgaagtgcagtggcccgatctcagctcactgcaaccccgtgcctcctgggctcaagtgattctggggcctcagcctcccgagtagctggaactacaagattgcgccaccacgcctggctaattttggtgttttaagtagagatggggtttctccatgttgcccaggctggtctcgaactcctgacctcaggtgatctgtgatctgccctcctcggcctcccaaagtgctgggattacagttgtgacccaccgcacccagttgaaacaagttccgttgaagc

SEQ ID NO: 723758 - DNA, 142 bp, Homo sapiens
  misc_feature (2)..(2): n is a, c, g, or t
cntcttggtgtggcgcgtggggtcttaaacgaatatttccacaatgtctgtgaactggacctggtgttcaacttccacaatgagcctcgcaaagagccacacaaagagccacgcaaagggccgcacgatgagccgcaccaag

SEQ ID NO: 723759 - DNA, 651 bp, Homo sapiens
aacctaatatcacccacgttccaccggacatgacatatgataccaccaatacaacacaatgaaccatgaacatacacatacaccaagaaaagaacaacagggaacaaaaaaagaagacacacgcgagaagaagagacagccagcacgagcacagacaacaagaaaacgaagacaagaaggaaacaaaaaaacagcgacacaaacaggagggaaacaaggaaaaaacaagaaagaaaagaaaaaaacaaaaagaacaacaaaacaaaaaaaaacaacaaaaacaaaaccacaaagaaaagagacgaacaaaaaggcaacaccagacaacaaaaaaagacacaaccaggaagagaaccagagaggaaagcacaggagaaaaaaaaaacacaaagaaaaaaaagagagaaaagaaaaaacaagaaaagcaaacaaaagagtgaagaagagggaacgcacaacaggagaaaaaaagaccaaacagaaaaacgaaaaaaacaagacaaagagaccacaccaacgagagaagccacggacaaagcaaagcacacacgcgacagacaacatgatcgacacgaaacaaacagagaacaaagagaagacacgccacaaaagcgacgagaagacgcaaaaacaacgagaagaagaccaaac

SEQ ID NO: 723760 - DNA, 352 bp, Homo sapiens
gtggaatgaaacagttcagagaggatatgggaaagggaaaaaaaaaaaccaaaatgtgatttccaacgagattagagattggttcttaatctacatggtcatgttacccatttgatagcatctatctcaggggtataatgtaatctcttggccaggattcatgaaagttaagattggctttgataggaaacgttatgcggaaatatggactctagagagggtgggcggtatataaaagcagcagagcaatttgcatttctaatacaccctgcttgagactgatgtcattagtgtaggtcaggccacggctggtggaggctactcaaaatacgtgggtgaccaataacccaga

SEQ ID NO: 723761 - DNA, 139 bp, Homo sapiens
gtgaagctgtgatagtgtaactggaaagctagtttggtgaaattcctttattattttttgtgaacatgctgatctttcccggacaatgaactgaagggtaatttactggactctcgtgtacagcttcatcaactttaac

SEQ ID NO: 723762 - DNA, 1085 bp, Homo sapiens
cgccaaggccacaatcgaggtaatccaacagtacagcagagacaggctcatctatactggaagtactgcaagcaacatgcccagcagcagcaagaccaagcctgtgctacagctctctaagagcgcaactgagtagtataggcgtggtgagaccccacactacatatagctcaaaactagacccacctacagtccagggacatgtgttaaaggctgctggggaagaatatggagaagggtcagcacctgggtatcctcttacacgcaaagaacgtgatcgacaaaagcagaagagcatgtccctattgagccagcagcccttctatatcgctggtgctaccatgtctgaaagggcaggatagaacaacgcgagggactccttacctccctctacagccaggtgcaaccagattgtgaataattggcgagatgaccagtacttagatgatagcaaaccaaagcagcatatgcatgaggcactcaaactgcggctcaacctaggtgagggggcatgtaagacacggagcagacgcagcacccagcagaccacagagagtgagaccaatgctccatcctgggagatcatcaaacagaaggcacatgtcgacaatgcagacccagcaaatgagctcattcaaataaagtgataggaacatgcgaagagacagagcccatacaaaaggagaccatagagcctagcagaccatgaccaagacaccacgcaaagggaagcaatggagggaacacaagccgggcataacatagaccccatgagcaaggaagaggcagaagaagacgaaggaagaagacagccagacgaaacaggacatggacaaaaggatacagccaagcatgaagacacaaatgacccaacgacgaagaacccgaaagatgcacaccaccgtggtgtaaacccacacagagagatccccgaggagcgaaaaccaaagggaacacacaagaaagagaggacacagaaaaacaaaccagaaaacaaaggagggacaacgggtacaccacaaaacaaaaaaaatgcgcccagggaccactaaagagaagaaaaacaaaaaagaacaaacacatag

SEQ ID NO: 723763 - DNA, 317 bp, Homo sapiens
  misc_feature (5)..(5): n is a, c, g, or t
  misc_feature (102)..(102): n is a, c, g, or t
  misc_feature (232)..(232): n is a, c, g, or t
  misc_feature (234)..(234): n is a, c, g, or t
  misc_feature (308)..(308): n is a, c, g, or t
cagangagaccgtctcaaaaaaaaaaaaaaaataccatctcccaccggtcagaatagctattatcaaaaatacaacacatgctatcaaggctgcagataaanaaaacccataccccgttggtgagaatgtaaattagttcagccactgtggaaagcagtttggagatttctcaaagaacttaaaacagagttaccatttgacccagcaattccataactgggtatatcccanantgaaaataaattattataccaatatggacacatgcactcatatactcatcactgcagtactcacagtaggcagngtcgtggga

SEQ ID NO: 723764 - DNA, 818 bp, Homo sapiens
gcttccccgatggccactgcgtgagctggatgcggctgtccattcctgtgaccatctcattgacaatggacatcggctccatagtcgtgacccactctgcgtcgcgttctacaggcatgtgggatggcggcactggcgctgagagtgggcggatgaacgggtgcggaaactgctcaagccctgagattctccaagactctacagacttgagtaccgttgttgatgacagtcgcagaagctacgctgtggaatctatgacactactacaacaagacgccacgagctgagtggatgatgacttcctagggggtgctgagtttgttccctaggacagatgtgtccagccaggtactgacttcatcgcccttgatgctgaagcctgtgaaagacctggtggatcggggcagaccaatcacgtgtctcaagctcaggaattaaaggacaatcgtgtagtagccatggaggtagagggcagaaacctagataagaaggacttcctggaaacatcagatccatttcttggagttcttccgtccagagtgatgggaaatgggctacctggtgtacggatctgagggtcatcaacgaaccaaagctgacactcctacgatggaaagcgtctctcatgtgcccggttcagcatttgtgtggttgggaaccccaagaaacatccattcaggtgctactgcgccgattatgacagtgaccgggtcacaatgacttctcatcgggtcaccttccacaccaggttggcccaagttgcaggcaagtccggttggcctttgcatggattcatccctggaagcagcgtacacagg

SEQ ID NO: 723765 - DNA, 193 bp, Homo sapiens
agtgcagtgccatgatctagctcgctgtaaccccaaaactctgggctcaagtgatcctcacacctcagcctcccgagttactgggttacaggcatatgccatcatgcccggggaatttttgtatttttggtagagacaaggtttcgccatgttgaccaggctggtctcgaactcctgggattgggctatcaaa

SEQ ID NO: 723766 - DNA, 644 bp, Homo sapiens
catcaatttagcaccaaaataatgatatatacgtagccagtatagtggaggtacaagtagtggtaacatggatacatgtaaatatattcgtgtctgtatatgcagtaggggactggcaagtattcagacagatttgaacatctgtattcctttaattacatttcattagataattattataatcttaaaaattacaagttaaattatagtcaaatctaaagttattacacaacttacattatttttatatttctttaggccatctgaaggaggaacattaaatggtgagtccgtatggtagatttaatttgaaaattaaaggtcataattaaagcatttaccatattatcgtaggtaagacatgttagacttcaagttttaaaaagccagggaagttgaaagacttcgctcatctttaatatagataatttagacacatgacccacctataaattattttgccctcttttctgttaccactccccagcacccaaacccagagtactgttaatacactaggctctctggctgtggcctccatcgtaaataacacagtggcttactttatgtgggttgtggtataacataagcagagtcatgcagttataactgttaagagattcatcactattaactgtattagg

SEQ ID NO: 723767 - DNA, 198 bp, Homo sapiens
ccctgtctgattgaccctggacagtgattgagcctctctgccttagtttcccctgctgtgaaatgggtataacggcagacatccacctcctaacgttgtgagcattgactggagtactggggctgaagtgctaggcacgaggccagtgtaggtgagcgaaggggtccttggacttgggctcagcattcctcgcaacag

SEQ ID NO: 723768 - DNA, 1051 bp, Homo sapiens
  misc_feature (614)..(614): n is a, c, g, or t
  misc_feature (696)..(696): n is a, c, g, or t
tgtgtcgaacgtcagccagctgtatgtgatctgcgcgctgctcgtagcagcccacttgttgagatcaggtccctgtcatgtgtcgtcaggtgtaggctccgtcggtgcggtcgcagtgtgacacgcttgtggcggcagagcgtgtccgtctgtgtgaggctggccacggtttctgtctcggccctcgaacccatgatgtcttgtcgtttctcgtgatgtgccgttgggacaacttccctccatggggtaggcacaacttggggctctctgtgggggcttttcaccctgcgacacagttgttcaagagcaacacaccattggcggggaagataacacgacgccacttccttttagggagtaaacagatgtgtgcgataggaaagggcgggtaagcaccgccacctgtgggttgatcgccgtggctgcccagtttgttgtggccacgaaaccatcgggcgtgtttaacagtgtttacagtcggtgtgatggtcagtcacactacgaagggatatccccacgcgttgtgtatcaatcaatttccaggcattaattaacaaacgggtgtggaacacgatagcgctgcgtctgcagacatagtggtattgtcataattnattgtgtggcacgcgactgctttactcggtaggctaggtatgtttgtttcaagggagtccctctttttggcccgcgggcgtntctagcaaaaatataaggtggaagtacgtgatcttctctgctctcatcataaatgtttacgtcgcatgacacccaccgtaggcgtgtcaatatgtgtaataacagccgaaagtttcatgaatatttccccccacattttctataattattccacttctcttggaaatatcttgctcaaatatgaacatatatttgtgaacaaacgtctcaacaacaccacaacatgaagaatgtcatatcaggtatatattattcatccaaatcattttcttgaccccattctttattaatatattgcaccccccgctcttttaaaaaaaagtacaattcaaaattttgtccctaaacataacaa

SEQ ID NO: 723769 - DNA, 407 bp, Homo sapiens
  misc_feature (153)..(153): n is a, c, g, or t
  misc_feature (156)..(157): n is a, c, g, or t
  misc_feature (226)..(226): n is a, c, g, or t
gcggcacgagggtcttagttactgaacaattagaaaaaggacatatagctctaacgtttcccccctggaattctccactctttgttattattattattatttttcttgagatggagtctcgctctggcctgggtgaaacagtgagactcccgntcnnaaaaaaaaaaaaaagtttgaaaggcattgtctgatttgagaaaccttttcctgtaaacgctgggggggnatctcgtactatcgctgaccggttagtgtaaaaagcaacagtcttcccctaaagaaggtggcagaagtccctccctttcctcagcaagtgaggagggtctagggccctcagaaggttttggaagaagtcacttgctacccaaaagagtctatctggggattgtaagagtaaggatagattt

SEQ ID NO: 723770 - DNA, 1087 bp, Homo sapiens
  misc_feature (410)..(410): n is a, c, g, or t
  misc_feature (412)..(412): n is a, c, g, or t
  misc_feature (442)..(442): n is a, c, g, or t
  misc_feature (448)..(448): n is a, c, g, or t
  misc_feature (450)..(450): n is a, c, g, or t
  misc_feature (462)..(464): n is a, c, g, or t
  misc_feature (514)..(514): n is a, c, g, or t
  misc_feature (547)..(547): n is a, c, g, or t
  misc_feature (565)..(568): n is a, c, g, or t
  misc_feature (585)..(585): n is a, c, g, or t
tgagagtgatgggaggtctccttgcgttggatgctgtgttccagatcatcctcccgtggtaattgaccccgtgaagtacacccagaccttcacccttcatgccaaccgtgctgtcacttacatctataactgggcctacggctatgggtgggcagccacgattatcctgatcggctgtgccttcttcttctgctgctccccaactacgaagatgaccttctgggcaatgccaagcccaggtacttctacacatctgcctaacttgggaatgaatgtgggagaaaatcgctgctgctgagatggactccagaagaagaaactgtttctccaggcgatttgaacccatttttggcagtgttcatattattaaactagtcaaaaatgctaaaataattggggagaaaatattntnaagtagtgtatagtttcatgttatctttantatgtngngaagtgtgtctnnncactaattacctatatatgccaatatttccttatatctatccataacatntaactacattgtgaagagaatatgccgtgaaanttaacacttataaggtannnntgaggttccaagattantaatctgatcaagttctgtatttccaaatagaatggactcggtctgtaaaggggctaaggcagaagaggaagatcaggtacaacaagtggttattgacaaacattctaaggagaatgcaaaacaacggttattttcaaggcttcgaactatttaaggaagcacaaatcatttccctacatgcatatcatccgtgagactcctcattaatatcctgaatcattcatttagctaaggttcatgttgactcgatatgtccatctaggaaggtcacaattctggtccaaacctgttgcctagtggtaggtctcccttaagtgggactaatagatgaaattctccttaaggcccataggtagggggggcaaggctcttaaaatcgggtggtcgcgtttttgtcaccccgctcaccgtgacagccgggcatcacaaacagaccgtggcggaaacaagctgcacacaacaaagaaaggtaggctgcaaagggtgagaatacctcggggg

SEQ ID NO: 723771 - DNA, 205 bp, Homo sapiens
gaagggatgaaagattgcctcaagctttgccccaaacggacaatgtagagatccttccacattcttacctacgtggaggtgctagaggtagagtaggatatttagctaactatgagaaacagtatccagattactaattcacgaagccacgagaaccttatagccaactagacacactacagggaggaaggtcccgtcaaggttt

SEQ ID NO: 723772 - DNA, 165 bp, Homo sapiens
tgaggatattagggcagtcgcccaggtatccattaacagaaactcaggtaatcagattgtggactatccctacattggagtctcgtactctactgaaagtaacgggagtacattattggtccatgggacaccacagattaggagttgggagacttcctctgtcaa

SEQ ID NO: 723773 - DNA, 359 bp, Homo sapiens
ctaggggaatatgacagaaaagcatcccataggctttaataaactttttaaaatatataaaactgaaaattaatagccatttaccctgaaagagttttggggggactttgtcacttgcatagtaaaagcatgggcctcattgttcagaagattagctttaggtcctattttcaaaaacgaaatgggaggataagctggaaaactgtagttttttttgcagaaaaaaaaggcccacaataaaaaaggttttgaaggaatcccggaaaacaaatttataaaaaaaaaaactatatgggcaggaatttttaacccattgacttgaaataataaaatttacaagaaagcaaataaagccttta

SEQ ID NO: 723774 - DNA, 1079 bp, Homo sapiens
  misc_feature (24)..(24): n is a, c, g, or t
  misc_feature (50)..(51): n is a, c, g, or t
  misc_feature (53)..(53): n is a, c, g, or t
  misc_feature (107)..(107): n is a, c, g, or t
  misc_feature (118)..(118): n is a, c, g, or t
  misc_feature (143)..(143): n is a, c, g, or t
acactgacccagatcacagctggnctggacccagtggggagaatccagannangacccggaggaccctccgtgggcacctggcaaagatctatgccatgcactgggngaccgactcanggctgctggtcagcgcctcccaggntgggaagctcatcatctgggacagctacaccaccaacaaggtccacgccatcccgctgcgctcctcctgggtaatgacctgtgcgcgtacgcgccctcagggaactttgtggcctagtggaggggttaggacaacatactagctaccatactacagcctcaagacccgcgcagggcaacgtacagggtacagccggagagactagcactggacacactgggtacctagtacgtgtagccgcttcctggatgacaaccaagatacatcaccagctctggggataccaactggtgccctgaggagacattgagacaggccagcagacagagggtaaagctggacacaggtggagatgtgatagtcccctgaaccctggaccccgatggccgacacgtcaggcgtacagagcggcacgatgatgcctactatcaagacggatagcggacgctgcgggaatacactgatgccgaccagacccccatcggacaagaatccgacatcaaggccaggggacaaacaaccaacaaaggcaagcctaaaacaaccggcactgacgaagccaccgagcgccactacgaccgcgggccagaacagcacccacatgactccatgacaaatcacaggggaacaccaatgagcactcaaagacagagaacgcagcgacgcgagtcacaagccaacgcacacaccagaatgacgaaggcgccaagacagagccacccgtcaccacacgaaatcaccgcggcacaagcagccagcagtggcagaccctggaaccaaccacgcagggacacagaccccacggaggaccgcgagctcaacacctcaagaagaaaaacaccagccaccgcgcggaaatacacaaacatctgcacgaatggctgagcacgtgcaacaacgaacagcaggcaccaccaaacccacccaacagaagac

SEQ ID NO: 723775 - DNA, 166 bp, Homo sapiens
cgaatacgcctaatagacctagcccagatagcagaccatagagtactaagagtagacatcagtactactacccggaattgcccatggaggcagatgagggtttaatgagcagagaaaacagtcatgcacaatcatacccagagaatttactccagaatgtgccctg

SEQ ID NO: 723776 - DNA, 449 bp, Homo sapiens
  misc_feature (1)..(1): n is a, c, g, or t
  misc_feature (67)..(68): n is a, c, g, or t
  misc_feature (85)..(85): n is a, c, g, or t
  misc_feature (93)..(93): n is a, c, g, or t
  misc_feature (121)..(121): n is a, c, g, or t
  misc_feature (207)..(207): n is a, c, g, or t
  misc_feature (368)..(368): n is a, c, g, or t
  misc_feature (388)..(388): n is a, c, g, or t
  misc_feature (395)..(395): n is a, c, g, or t
naattttccagagtcccttttggcgatcttggctgaggaagagttgctcgaagagctctgtgtctcnnactggagtgacccacangtctttgnaaagagccgtgctgggatcgaccctgcngaagaaatggagttgctgttggaaaactactaccgattggctgacgatctctccactgcagctcgtgagcttagggtgctgcttgntgattcacaaagtcttattttccttattctggaccagccccgaaacgtgctgatgaggttgaatctacagctgaccatgggaaccttctctctttcgctctttggactaatgggagttgcttttggactgaatttggaatcttcccttgacgaggaccatngaattttttggctgcttccnggaattntgttcatgggaagtggcctcctctggaggcgcctgctttcattccttgggcgac

SEQ ID NO: 723777 - DNA, 286 bp, Homo sapiens
accacgccaccggagaaggcagactattttacattagacaatcagttcatcaattattgcattatccagtcacatccagacaatctgtaaattacacttctgctgggtaatgttgcaaggctggccatagctgctaccttggagcactttgcagggagcccttctggccatgcttcagctgtgtttctcttcctgctttgttgggtttgagctcaggagggaaacccagaaggagagggcagtcacttattgttccctctccgtgcgtgtggaccatacgactgcg

SEQ ID NO: 723778 - DNA, 127 bp, Homo sapiens
gttctcttgtgtatcccatgtgccagagaagaggcctctggtatgaagtgaccatcacatttggaaagtgatcaaccactgttccttctatggggctcttgcccttagtgtctatggctgtgaacac

SEQ ID NO: 723779 - DNA, 1074 bp, Homo sapiens
gagggctcccttgactacctttgtacctcttctttgaacacgtgacgcttgtgaccacatttatcataattagtacataaccagctgcatgagtggccttgaggacgaaccccgcagggagcaagcagtacagtggcattcccagggggaccagcagcgtacccaaggagaaccgagtgcatgaagcagtatcagtcgtctgggcatcatgcgtagggatgtcgcatgtgcgtcactgttgccaactccttcccagccagccaggtttgcgtggagggccaggctgggtgtcctcgacaggacgtgagggctagcaccccaagttccaaaacgccgtgagaagagagaagtggagggggaggcgagttctgtgaattaaaggctcccatcaggtcactggattaggaactagaaaagactggatggatatgtctacacatacacataatagtcacctgacaataacatacacacaagagtgcagaatacagacaacacatagatacagagaagcgcaggctggaccgcctagcaacagtagggacttgttggggccgggggacaaaccgttggtgcgggcgctgctcagcgcttggggttaatctgcaaacacatgggaggggggcgcattggcctggtgggagccccgaattggacgcggttggtgaaccgcgaaaccggtggagaacgccctgggcgaaaggcctttgggttatccaaaaccaaccacccttctggggttaggcactcgcggttaggcaaaagagccacgagccccgaacgccaagcgaaagagacccccccacataggctcaccgtggacggaacctccgtcctgtggtccccttgtccatgttgttggaaaggaccggccaccgtgtgcggacggcattttgggtgacaaaccacagggggggcccccccacttaaacatggggaccccatcattgaaaaaacctccaccccaatgggtgaagggtcccatcaaacaagttttcccacttatcccttttactggcctcattatattttacacattggtgcaacgtttgtttacccagctttcatacttcc

SEQ ID NO: 723780 - DNA, 344 bp, Homo sapiens
  misc_feature (340)..(340): n is a, c, g, or t
aagaggtctttattgcccaccagccaccaacagtttcccagccacagacagggtcctctgggtctctgtaacccactctcaggaccatgagatgcagctacagtccagctgtctcctcccaggggatcaaggtgcgtctggggcatctgatgcagcagaaggccctcacagggactgagcagcacttgggtggaggaggacaggagagggctcctcttggcacatattagggaggtcacccctgaggagtagggtgggatggaagggactcttaagtggggatggtaccaattggcaaaaagttatcattgaggatgaccgatgattaaagggacaattnacac

SEQ ID NO: 723781 - DNA, 84 bp, Homo sapiens
  misc_feature (60)..(60): n is a, c, g, or t
gctgtgtaaagctgcctttgcaagcacttcacatgattcactgaacagagcagacagaancccctgcccttctgtcgtcttctc

SEQ ID NO: 723782 - DNA, 173 bp, Homo sapiens
gatcactacgagcctttttatatgagcactttaatatacgctattggagctggaattacccgcggctgctggcagccagcactgtgcggtgcgaatggagtggcgtggaaggatttaacagtggactcattccaattacagggcctcgcaaagaagtcctgtatatgttattt

SEQ ID NO: 723783 - DNA, 822 bp, Homo sapiens
tatcacaacagaagtaaaatgttgcttggtcacctggtgtcttttattaaaaatttactccccccatttctcacagaaaataacagtcgggagtcattgtcacaatatattagaattgttagcaaccagattcatgtaaggactaagtggctcctcatgaattgctttaagactctgtactgctcattttacactccatcctctctgtagttggctgggtagtggagggggtaagctgaactcatagttctctgacaataactggaaaggtttttctcttaaaataacaatggaatgggtataatggggattgaaaactcaaaccttggacactaagatagagaagatggagtgtatgtagaagggctgttaaaaattgtcaaactttggtggctattattggtggaggctcaacacttgtgagggttaatcaccataattttcccatttgtcctgcattttgatctctgaaaagaaagctggctttgcccatttcttaattaaaaaaacttgttgtaaatccagtgggtctaatgggatctatatgaagttacgccatgttttgtatgcccttctcccaacaaaatactgtataacctagttgtgctggtagtagtttaatctcccacccatcttcgtaaggctaatgaaattggtgagtcccccattatatctctatttaatcatgttccatctgaagggtattccttaacccgcgaatcattttcttcaacagaaggggtgggaaatacttcaccttgttggataaagagtcttctagacaaaaacaaaaaacttggggctggcaaattccaccattgg

SEQ ID NO: 723784 - DNA, 848 bp, Homo sapiens
  misc_feature (17)..(17): n is a, c, g, or t
  misc_feature (45)..(45): n is a, c, g, or t
  misc_feature (60)..(60): n is a, c, g, or t
  misc_feature (64)..(64): n is a, c, g, or t
  misc_feature (68)..(68): n is a, c, g, or t
  misc_feature (71)..(71): n is a, c, g, or t
  misc_feature (74)..(74): n is a, c, g, or t
  misc_feature (114)..(115): n is a, c, g, or t
  misc_feature (120)..(120): n is a, c, g, or t
  misc_feature (127)..(127): n is a, c, g, or t
  misc_feature (144)..(144): n is a, c, g, or t
  misc_feature (163)..(165): n is a, c, g, or t
  misc_feature (208)..(208): n is a, c, g, or t
  misc_feature (244)..(244): n is a, c, g, or t
  misc_feature (248)..(249): n is a, c, g, or t
  misc_feature (279)..(279): n is a, c, g, or t
  misc_feature (292)..(292): n is a, c, g, or t
  misc_feature (294)..(294): n is a, c, g, or t
  misc_feature (306)..(306): n is a, c, g, or t
  misc_feature (321)..(321): n is a, c, g, or t
  misc_feature (331)..(331): n is a, c, g, or t
  misc_feature (340)..(341): n is a, c, g, or t
  misc_feature (343)..(343): n is a, c, g, or t
  misc_feature (357)..(357): n is a, c, g, or t
  misc_feature (360)..(360): n is a, c, g, or t
  misc_feature (396)..(396): n is a, c, g, or t
  misc_feature (398)..(398): n is a, c, g, or t
  misc_feature (400)..(400): n is a, c, g, or t
  misc_feature (415)..(415): n is a, c, g, or t
  misc_feature (420)..(420): n is a, c, g, or t
  misc_feature (422)..(422): n is a, c, g, or t
  misc_feature (425)..(425): n is a, c, g, or t
  misc_feature (470)..(470): n is a, c, g, or t
  misc_feature (696)..(697): n is a, c, g, or t
  misc_feature (699)..(699): n is a, c, g, or t
  misc_feature (702)..(702): n is a, c, g, or t
  misc_feature (708)..(708): n is a, c, g, or t
  misc_feature (774)..(774): n is a, c, g, or t
  misc_feature (822)..(822): n is a, c, g, or t
gtcgcgccgcccgcccnctctgcgtgccgccgcctgccatggganttcatgtggaaaccntctncccnggnggngggcgcaccttccccaggcgcggccagacctgcgtggtgnnctacnccggggngcttgaagatggatagntatttgattcctcccgggnnngctgcaatccgctgtgtggagttgtgatggctaggcataggcnggtggtggtacgcgttgctggggagaaggggttgcncagnngagtgtgtggtcagagagccaaactgtctntgtctcctgattntncctatggtgccnctgggcacccgaggnatcttcccanctcatgccnntntcgtcttcgatttngancttcttttactggaatgacaggaatggcctcctccntntnttttttttttttttnttttntnttngtgggatctggtgcctccagtcttgtgcacatgaatccatatggngcttttcctgatgttccactccactttgtatagacatctgcccatgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaannanatngtcaantattaacagcacaagtggtaggttaacattagaataggaattggtgttggggggggggtttgcaanaatattttattttaattttttggatgaaatttttatctattatatatnaaacattcttgctgctgcgctgcaaa

SEQ ID NO: 723785 - DNA, 251 bp, Homo sapiens
acgacgagagggacaaggtgagcaacttgtcagttgtcctcctggagtcctatgagctgacctgtgatcagtctcagattagggagactgcacctgcatcacgtgatctctctcacattcgactgtaggcactgatcattggatatgctcgccgttctcagccgctgaggactggagaggagggctgtaacgccttcagtcagtctctggggatgaaactcttaaatgctattgaaacttctaaaactagg

SEQ ID NO: 723786 - DNA, 882 bp, Homo sapiens
[303 bp omitted]tgggagtgctagaagcaaggaagcagcaagtctgggcacattccagaggccacgaggggttttaggccctggaccctggcatgttccaagactctttttatattatgtcagactagcaagccctgcctcagcttttccccaacatggaatgctattctaaaagcacccatgtattctttttttttttttttttggggaagggagttcccctctgtggcccaggctaaaggtgcagggtggtgtctggctcctaaaacctcctgcctccggggtccaggtgattctcctgactcatcctccaagtggctggacacacgggtgccaggcaccgtgccgcttattttggattccgcagacgggcgtctctgtggcccggccgttcaaatcctgactcggtgggtttccccttacccccagggggattcgggttaccgtgacgcgccccgtttgttgactgctgtttgttcacgcgcctctgggtggacacgcgttccggtttagatgcgtgttttcgaaagggtgtacccgtttcggaaggttcgtgggacatgccctcactcatctgcgttgcgtcactgg

SEQ ID NO: 723787 - DNA, 728 bp, Homo sapiens
agcgggctggggccgcatcttggcaagaggcgaagcggcagcggttcctgtcaagggggcagcagtgtccagacgctgctgtgtgctccctgttccccagacccatacccctcatccccagatggagccggacgtgcggagcgcgccccaccaccgaccatcaccactggtgctcgttggcagacagcgtgtctgcacaaagagcaggaaaggctccttgttatctcgacatgtttgtggaacatgacccgcaactcggacttgacgggctctattagcagcttgttccaaacgctcactgaacactggacaaacaagcatacgtttcgttgaacacagagacgtgtcagatatgtctaccagcctatggacgcaactgtatatggtactgatcactaccaaaaacagcaacatttagaagatttggagaccctaaggctcttctcaagagtgatccctgactattgccgagccttagaagagaatgaaatatctgagcacatgttttgatttgattcatgcttttgatgaacttgtcgcactgggatagcgggagaatgttaacttggcacagatcagaaccttcaaagacatggattctcatgaggacgacggtgtgcagagccgtcagagagactcaagaaccgtgaagctaaggctgagatgcgtcgtaaagcaaaggactcacaacaggcccgaagagatgcagagagacacgggacaaacag

SEQ ID NO: 723788 - DNA, 421 bp, Homo sapiens
tttcggcacgagaccataagggcgtcatacagcttgattatgtcccgaacctggatatttactcattgatgcctgacagttaatctactgctagatgaagcaatatcgctgctatgcgtgtgttgcctaatagcatgtcacaatgctcactagaacggtgattgactacgatagcttgtgtgcatagcacccacatctatgtaacaacgcttagtaagcctaagtggatgctggaagtgactggcactgtatcgtagcatcagtatgtagacctcgcgcaacgatgcatattattttagaagtgatgatagattgagctactgaccgttcttcattgaggatagatgattgtatgccatagactacatagacatgtcggagtcagcacgtactcttgtatacaggcttgtagttaccgtgc

SEQ ID NO: 723789 - DNA, 372 bp, Homo sapiens
ccagctggctgcttcctcaaggtgcatgtttgtgtgacttccggaattaggggttgagtgatggatgtgctagtgtattagccagagctggggagagtgccacaagaagctgcaccaccagtgacctggaggcagtgcgattgtgtctagtgctttcctcagtgaccagcagggagcgattggggtgtctctaagctgagaagaagactcagtttccagtaatcatccctgctggagtgtggagcatggaggcagggaggccagtgaggaggctgtggccatgtgtccatagttaggaccatgaaggacattattgctaatgcagtgtccacgggaagcactgtgaagggggttatggaccgaggatggcag

SEQ ID NO: 723790 - DNA, 237 bp, Homo sapiens
cgatgcccaattgtgcttcaaactccgtgcgctttgcgaaagtgcggaatttcctgaagggagaaaggtggacaactctgcgggaaccggccgggttgcaacgggggagtactggagagcgctaccagggcgaagcaaatgatataaacatagtccaaacgtgttaagccacccatgattcgagcgtgagatgtagtgtcatgctgctcagggggaccgtgcttatagaaaaaaaaa

SEQ ID NO: 723791 - DNA, 287 bp, Homo sapiens
gatagaccagtctgatcttcacggcaccctcacctgtgacaccaatgatccaccccaatcgcagacttcacacagtattctcccccacgccgtcctatgaccaaatggcccctgccagtgtgtgggccacagcagcagcgtatgtgtgacaagcaacgtacgcgccccagcggacatgcaagtgctgcttacgccaagctcacgctcccattctctatagcccaatgccatgtcccagatcgctcttgccaacatggggactccatctacgacgtctgaccctgcat

SEQ ID NO: 723792 - DNA, 1049 bp, Homo sapiens
agaagtatgtcgacgtgcgaatgttgactgagtgacaagcatactctgaaccgaccgaattgtgacagcaggctgcgtttacaagctagtatctagtgttgagttgactcctagaaacgactactcgagtgaccaaagtagaagctgcgcagtggctagtgtccctctgttaccagtgaattgggcgaacacggcctcacattgctatgctaagtcatgtcgttgagactgacaggtagagaacgattgatcggccggtctggtaaatagctgctgtatggccctacattctattatgtctgtttatgctgccatggtagatggtggtgcctggcaagactcgctctgtgtggtttgagaggttgtactcgaaagctactcccaaccatgtctgaagctcgcgtatctgcattgttctcgctgaagtaatagacgaaacagaaaaagtttgacgcgtggaatgctacctcataagcagctggtccaagaaagtgcctgtctggagcatggctaggctcgagctgatggtcatgccccagtagaacgcgtcataaaaagggctaacacttgcatttcactattatcccgtaagtacccttgtccaacccctaatgtcgtataactcacgatggcatgggacagaaagcaggatgctctagaaacatggtgaagcttttccaagtgttcggtcgagtataaatgattttaaggtcagttacataacgacttgagtttgcattgcatacagcgatatgcattctggtcaataatcccttaacagagagagaaaacgggagcacacttgttctcgatggagaatccaacgtaatctggtttttccttatatttgcagtgtagtgcaagtagtacagagttgatagaattttgtagaaatacagtaatctgtgacataaatggaaaacaagaatttgaggcacattaatttgtggtcaacatgacattttgagaagcacattgaaaaaagtttaaattgagaaatacccctctaaggaagggggcggggccggacaacataggaagacatttcc

SEQ ID NO: 723793 - DNA, 117 bp, Homo sapiens
caggtcgacactacccatgtgtgtgtcttcatgctataaatacgtttctggaaatgtgttggtagaaacagatttcttttcttttgttcggtgggtcaatggagtgacatttcacta

SEQ ID NO: 723794 - DNA, 544 bp, Homo sapiens
tttgttataaagagtttattataaaaaatcacattttttgaatgacaaggacacatagaacctttccacatgtggaagctttgtctactgattccaagagtcccactatatgtatgggggcttatgtaggagcgcttatttttaatgccagcaaacttttgattggaaagcaccgtacacttttctttttaaggataagtcttttgccaagatagatattataagcttttaaatttcaaaaaagtgagaatttccacatctcgaatcttacaccaagagggaattagcagagtatatactaattggaaaaacatttttatgaaagaacaggtttttagaaggcaaactctatgcttaagaaagtgatcagctctctaattatgccattaactatgagattgagatcggacgtttccacatccacttaggtgggttaaggtagccaataggctagtgatacctttgcgagcaagtgcgaaacaagccaaggttatcgcaactgctagtagcggattcctgcattcttgtggaatcactagattta

SEQ ID NO: 723795 - DNA, 149 bp, Homo sapiens
cgtatgtgaactgctccgtaggctatcgagcggtccagcacatgcacatctaccccattgtcatcttcatccactacaagtagcgccaagcacatcaaggagcagagagaccccatctaccttagggacaaggtgactcagaggcattc

SEQ ID NO: 723796 - DNA, 341 bp, Homo sapiens
  misc_feature (1)..(1): n is a, c, g, or t
ngtcgaactcgcaatctaaataaagttctctgtatatatgtagtgctattacagcccgctcgttcaggttctttgtcaatcacaacagtagtaaacgactataaaaataatattaaatccatttcccctcaattgatatattccttctgggtgagatttccaaatccttggggtgtctggttaggcttttggtcggtgggtgctacagaaggaaagccagaggttaaagaaaaatgcttggcttttttccaattggcaactgcaagaataaaagttactgcactgaaaatgagtacaagcaccctcgaggaggaaaaaaatcttatcaccgagaagaaaat

SEQ ID NO: 723797 - DNA, 297 bp, Homo sapiens
gcccagaatctgtgatattcagcacagcggatccaatgcatctggggcttcagcagatcagtcgcaatcctaacgagaacatatgactgtgctgacatcgtacacgtgtgtgtggtatcctttgcctggaaactggaatgctgaaggaaatgaacagtgttagaattttcatctagtatcacagaactgctctggctcttacctgtataaaatgttgacgccatcatcgaagtaaaaatgttacttaaacttgctttcttgtaaaatggtaaaaaaaagaccttgttgttttgaaga

SEQ ID NO: 723798 - DNA, 929 bp, Homo sapiens
  misc_feature (18)..(18): n is a, c, g, or t
  misc_feature (20)..(20): n is a, c, g, or t
  misc_feature (24)..(24): n is a, c, g, or t
  misc_feature (27)..(27): n is a, c, g, or t
  misc_feature (29)..(29): n is a, c, g, or t
  misc_feature (31)..(31): n is a, c, g, or t
  misc_feature (33)..(33): n is a, c, g, or t
  misc_feature (39)..(39): n is a, c, g, or t
  misc_feature (837)..(837): n is a, c, g, or t
  misc_feature (863)..(863): n is a, c, g, or t
  misc_feature (906)..(906): n is a, c, g, or t
aacattacggctaggtanangctnggntngntngagccnaggcgtctcccgcgtccgcgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctgggagaagagctcgcctggccaccgggccacgggcccacagacccagcacgtatctcccatgcgccaagttggagcccccagccaagaagccagccacaccagcagaggatgacgaggatgatgacattgacctgtatggcagtgacaatgaggaggaggacaaggaggcggcacagctgcgggaggagcggctacggcagtacgcggagaagaaggccaagaagcctgcactggtggccaaagtcctccatcctgctggatgtcaagccttgggatgattgagacggacatggcccagctggaggcctgtgtgcgctctatccagctggacgggctggtctggggggcttccaagctggtgcccgtgggctacggtatccggaagcaanagattcagtttgtggtggaggacaanaaggtgggaacaaactagatggaggaggagatcaccaagtttnaagagaacgtgcaaagtgtcgat

SEQ ID NO: 723799 - DNA, 670 bp, Homo sapiens
  misc_feature (632)..(632): n is a, c, g, or t
tgatgtcttagatttgtctctaatccgttttgatttaattttttttagatggcaagagatagaggtctagttttattcctctgaatatggatattcagtttttgtaacacaatttgttgaagagactcccccattatattgaggcaggaaaatagagtctggaggcagaaaacataagaccacttcacacttcacctttccatagggcatgggccataaataactttgtaactttatttcatcctctccatttacatagggcatactagggggtatttaaactcccatggagtgtattttcattttcaataaatcacttcatgccttccttgctttgtgcgttttgtccaattctttgttaaagacgtcaaggacctggacacctacaactggtaacgtatattttggccagccaggaggaagaagtaagcccaaagtttgggattcatttttctctctttcctttctgctccatacaagagctttctcttttcatttccaacttggaacacttggtgggcagcacctaaacgtggaggcaactgcaggtttctggctgtggcctgtgaaactaatgggtttccgtgcagaagatgctgactgccacctcctggtttgcttaaagaacctgngtctttttcaattttttttcctttatttctcaagctct

SEQ ID NO: 723800 - DNA, 196 bp, Homo sapiens
gagacccggtaaagcccctcggcctgccccacatcgtcaacggcccggctccgacatcacaggagcaggaaggcccgtcaccgcacatgtgaaccacgactaacagtgcgaagggagtccatccagcagacagcggagcagcggttgtaccagagaacgtatacaggccctgaagaccgtctaacggatgctcatc

SEQ ID NO: 723801 - DNA, 877 bp, Homo sapiens
  misc_feature (18)..(18): n is a, c, g, or t
  misc_feature (20)..(20): n is a, c, g, or t
  misc_feature (24)..(24): n is a, c, g, or t
  misc_feature (27)..(27): n is a, c, g, or t
  misc_feature (29)..(29): n is a, c, g, or t
  misc_feature (31)..(31): n is a, c, g, or t
  misc_feature (33)..(33): n is a, c, g, or t
  misc_feature (39)..(39): n is a, c, g, or t
aacattacggctaggtanangctnggntngntngagccnaggcgtctcccgcgtccgcgattcctcctccttggtcgccgcgtccttggctggcgttgtgtgatgtcctgtggcccccgccggaaggagtctgggcgctgacagagacgcccgaggtggccgggatgggctgggctggcccgggctgcgccagaagctcgcgccgttatgggactgatgtgcacaatgtgctgccagcgctgggcttagtgggcctgtgggccaagtgctggcacttgtgtggctgatgctgcagagagtgctgtgtggctgacgtgagtgccacgtggcctggcttggagtggcgtcctgcgggacgggggctgcctgtggatgcactgtctcacggctgcatccctggtcgtggaatgcccctcggccaggctgctggtggcctaagtgcctgtgtttgcttgcctgtctccgtgggagaccagacatctgccccagctgtttctctggcctgcagaccttcgtacaccacgtctttgtcaatgcaccagttacttgcacgcatcagctgagcacggacggggataggcacggacgcaacacttttggaacttagacgctacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccgaagaggactcaaatccttggtgagctcggcccggcctccggggcccgtggaccggtgagcctgtccgtgcgctgatggacctttttctgtcgactcg

SEQ ID NO: 723802 - DNA, 393 bp, Homo sapiens
tgatgtcttagatttgtctctaatccgttttgatttaattttttttagatggcaagagatagaggtctagttttattcctctgaatatggatattcagtttttgtaacacaatttgttgaagagactcccccattatattgaggcaggaaaatagagtctggaggcagaaaacataagaccacttcacacttcacctttccatagggcatgggccataaataactttgtaactttatttcatcctctccatttacatagggcatactagggggtatttaaactccctaaaattctgtaatggggcctttgagcccctacgcttgggctttttcccacactgtggagtgtattttcattttcaataaatcacttcatgccttcaaaaaaaaaaa

SEQ ID NO: 723803 - DNA, 558 bp, Homo sapiens
tgatcgcaaaaacagcagctaggacacccgtcgtttggtgtatatacatcaattctggcctcaattcatctgctgatatcaatcttcttcgaacaggtataggtggtgaagcaagtggtgtcgtgccttatgctcacattggcaggagcactagcagctgtctttccttcagtttcactatctgtttgggcaactcgatagagaacttgcaggatcagaagctttttcagccggcaggacttctggatgtaactcggcttcatcatctagtacgtcgtaaacattagatgcagcaaatacttcaacctgactgaaatctgccaaattgggaagctctggtatctgctgagagtaaggaactagtgtgagtaatgaggcccattcggcatccactgggcgatgcacagaaggaccaggagcctgtgagggctgtgatcttggcaggccctgcaggaggatgggcaccaattccagcctgattgttgtcctgtggtgactgtaaggtccgatcatatctaagatgattgatctcaatgagaggctgggccttggagggga

SEQ ID NO: 723804 - DNA, 540 bp, Homo sapiens
taggcaggctcacccaggcaagagtgcagtggcacaatcacagcttactgcagcctcgatctccctggctccagccatcctcccatctcatttttaaatttttgtatcgacaaggtctccctatgttgcccaggctggtctcaaactcatgagctcaagcgatcctcctgcctcagcctctcagagtgctgggattacaggtgtgaggctgaggcaggagaatctcatgaggccagcctaggcaacatagtaagaccctatctctccaaaacaaaaaccaaaattacctgggcatggtggcataaatctgtagtcttagctacccaggaggctgaatcaagaggattgcttgagcccaggagtttgaggttacaatgagctgtgatctgtgttccagcctggctgacagagcaagatcctgtcttccaaactaacaaacaaatcaaactttccaaaaacagaatggcctatatggactttgaaggcccttagaggcccggaaaaaagatttacttgaattttccaagggtcaaatgtttt

SEQ ID NO: 723805 - DNA, 414 bp, Homo sapiens
  misc_feature (76)..(76): n is a, c, g, or t
  misc_feature (129)..(129): n is a, c, g, or t
caggagctgagctgagtgacatgatgtgcatacactcagctagtgaagtgagagctatgtctaaaaacatatatanttggtatacgggcaagaacccaatttgaaggaaggtggagaatatactgtaantttgacttattttgtaatgatcatgatcagactcataatgttatctgctatttggtgtaatactggtatatctggtaaaattaatttgatgtgttctgatatggtttggatgtaagttccttgcaaatctcatgttgaaatgtaaccttcaacgttggaggtgggcctagtcagaggtctttgggtcatgggggtggatccctcatgaatgggttggtgctgtcctcatggtagtgagtgagttctcactgagttcatggcagatctggttgtttagaaaagcct

SEQ ID NO: 723806 - DNA, 906 bp, Homo sapiens
  misc_feature (814)..(814): n is a, c, g, or t
  misc_feature (840)..(840): n is a, c, g, or t
  misc_feature (883)..(883): n is a, c, g, or t
ctcagtcggtacctgctgctccctcttcacgacccggtctcggtctggctgtcgtgtacagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctgggagaagagctcgcctggccaccgggccacgggcccacagacccagcacgtatctcccatgcgccaagttggagcccccagccaagaagccagccacaccagcagaggatgacgaggatgatgacattgacctgtatggcagtgacaatgaggaggaggacaaggaggcggcacagctgcgggaggagcggctacggcagtacgcggagaagaaggccaagaagcctgcactggtggccaaagtcctccatcctgctggatgtcaagccttgggatgattgagacggacatggcccagctggaggcctgtgtgcgctctatccagctggacgggctggtctggggggcttccaagctggtgcccgtgggctacggtatccggaagcaanagattcagtttgtggtggaggacaanaaggtgggaacaaactagatggaggaggagatcaccaagtttnaagagaacgtgcaaagtgtcgat

SEQ ID NO: 723807 - DNA, 1275 bp, Homo sapiens
gcatttttacagtttattatgcgctgttgttctccctttgctctagggttaataacgcgtgcgttgggcacctgtgtgagagttcacaccgggatatcttgccgtgtgacacccccacagggtgttccccccaagattggagagcccacctttgtgaacccgtgaagtgcgcacttgggaatatccccacgtgttttttccttgttggaccccaggagtaccgggggataaaaagtgggcacccacagggttttcctactccccctagattgacacaaaggggcccgttttgaggccccaagggaagagcccacttttgaaacgctaagtggggccccccagggaaagcccttgaagaaaagttcaccccaaaggccccgaaaagaattgaggaaagcgcacagaaaggggaccacaaaggggggttcaaatcccccaacgaaattttcaagcgctggagggttcccctaaagtgcccctttcgagacccactgagaaaggccacaccctgttttgtaaaagattgtaagataaatcttttccacaggggccccaagagtttaaacccgaatttgaggggacccctaccacggagaggatatttttctggggacacacagtgggtaaattgagaaaattaattttccccccttcgggcccttggaatataagagattccacgagccttgcctgtaagaaaaggagaagaaaatttggagaccactcccaccacgaaaatagatagccctcgtgagggaaaagctttttgccacacacccccaacttacattcaccccacaagcttggttcaccacgaggtctcacaggagaggcacatctccacaggagaggaaatcgcccctggggagagatttctcctggctgtgttggaagcctccctctcctctcttggttgtgggtgtcttctctcctcacagggcccaccccacttgtaaaagagggctttgagttaaagcccacagccacaagtgtgtaagaattgtaagcactttgtgtccacacaccactcttataaaccacatttgagaaggacctctcaaaatttcgctatgcacaatttcttgtggcacgttttaaaaagttatagctgctaatagtaagttatctgggcacttctcacaataacttgaaatatggaaacacataatgcacccggggaacaggacaataacacttgcacctttataaaccacctgtattgtaagtggaaaaagccatgttttaaataaaactatttaaaattggccacccata

SEQ ID NO: 723808 - DNA, 233 bp, Homo sapiens
attattttatagatacatatcacagagctatttagaaaaacttctgaataactaacatagtggatgtaatgacaatattgtgcagtggcaccggaaaatgtattaattgtgaatgtacttaggtcttgtatcccagatactgtctcttgaagcagtgcacggactgaatgtttttctgtgtccagatctcatagtttgaagtcctaatttccaagtatcttgtatatataaat

SEQ ID NO: 723809 - DNA, 109 bp, Homo sapiens
ctacctaagctgataattataatgacagtgtaactatgcaggtgttaaacatttactatattcttacagacatctctgttcatatattcatttttaactccaggaaacc

SEQ ID NO: 723810 - DNA, 221 bp, Homo sapiens
tgttgggattacaggcgtgagccactgtgcctggcagaacagtgggttttgtaaggtgggaacaaagaaacagaacaatagaaagaaagctgattgggtaacatcaggttacttttttgtaagagttacagcataggaggacttccttgtcatgctggaatctcctgttttcaaaaaaaaaaaagaaacaggtctgttttgaggtctatctgcctcctaca

SEQ ID NO: 723811 - DNA, 464 bp, Homo sapiens
aatgtttccaagaagcagctcagcatgggagcctggcctttgagaaagcacagaacgtggcacgttggaggaaatcaaaagaaatctcgccattgccgggaatgggtaaatcactcaggccgcgtgggtccttggcagatggcagaggcggcttcccagtcccccacctggcactagagggacggggcgcgcacccaacggtggcacgcatcgccgaattttcctgaatgccgctgtggcacattcctggcctttgcagttattaggaaatgagaggatcttttttccttctactctcccctccccctgccttcgtttttcttccaggcatggaattatctactttagcagttcaaaagacattccattcccatgacaaagacagaaaggggtgatgttggcatactgtagccctctttctcatagggagacttgagcaataaatcataatgaatgagaaaaaa

SEQ ID NO: 723812 - DNA, 938 bp, Homo sapiens
cttcgccatgtgatgacaaaccttggagaagttctgcagcactaatatagccattgccatccttatcaaacacacggaatgcttctctaatgcaaaagatggagatggaactataacagcaaaggacgtggaatgtaaggaatctattgggcatgaaaaaaaagatcagaagacccgcgggcacctacacgccgacagccaagggacggaccgcgcacacccccagaaacacagcacaacgatcggcccgaacgcaacacagacacacgcaaccacccaacactactacgcagacacccccgcccggcgaccgcacaccacacacaacaaaccgcgcccacaaacaccaccccccaccacacaacacacaaacacacacgcacaaccaggacggagcagcgaccgccaacgcgcacgcaccgccacgccacccgcagcaccagccgcgcgatgcacacgacgagcgcgccgacacccacccatcggacgaaccgcaggggagcccgagcagaggcgcacgccccaaccgacaaacgagacacccgccagagacacgcagcgacgaaacgacccagccgcgaccagccaccacagacacggcacgacacgaccgaacgcgagcgcgaagacacacgggcacgccaaagacgccggactaccggaaggaccggggcacgaacgaccgaccaccaaccgacgccgaagcggccccgacagcagcccccaccaccaagagacacaccagaggacagcacgacagagacaacaacgagcaacgacggagacgcaaacaacggacgagacacaccacccggacacaccaacccacccccacacccaccaccccgcgcacagaccacgcagcggcgcgcaagagcgccggacacgaagaccgcacaaaagaacgaacagaacgcaagaacccacgcgcacgacaa

SEQ ID NO: 723813 - DNA, 221 bp, Homo sapiens
aaaccctaacttacggagtagatacaacaagactaaaaataatagaaagatataagaaagactataaagtaataatagaagcaacatgtatatagacataaataagcccaactcgcacatgttccccagtggccatgtctgtgtcacaccatcattttttgttacctgagtgacctgagctgggcccatcatattctctgcctgcatccagaagatggctg

SEQ ID NO: 723814 - DNA, 160 bp, Homo sapiens
actgaagttccttgtctttgccttcatcttggctctcatggtttccatgattggagctgattcatctgaagagaaatttttgcgtagaattggaagattcggatatgggtatggaccttatcaggcagggtcagaagcaacactatactcacacccatat

SEQ ID NO: 723815 - DNA, 601 bp, Homo sapiens
  misc_feature (601)..(601): n is a, c, g, or t
gcatgcatgatcagcggtgtggctagcgcgcgggcgtgttgtcttcgcggttctggtcttctgcatcatgccgattcatcgtaacaccaacgtgcccgcgcctccgtgccgacgggtcctctccgagctcacccagcagctgcgcaggcaccggcagcccccccagtacatcgcgtgccgtgtcccggaccagctcatggccttcggcggctccagcgagcgtgcgcgctcctgagcctgcagatcggaagatcggcggcgcgcagaaccgctcctacagcaagctgctgtgcgtgcctgcttggccagagcgcctgcgcatcagcccggacagcgtctaccatcaaactatacgacatgaagcgcggcccattgtgggctggaaaaactccaccttcggctaagaggccgcagagacccacgtctgttctgcgcttgctcccacccccggaaccccgccgcaccgctgtgttctaaggcccgcccaccaaaacctcctgcgtgggagaaaataaaccggttaagagaactaaaaaaaaatataatataaataaaaaaaaaccgcggggcctatatttgggggggcgcgcgaaacaggttn

SEQ ID NO: 723816 - DNA, 991 bp, Homo sapiens
  misc_feature (5)..(5): n is a, c, g, or t
  misc_feature (63)..(63): n is a, c, g, or t
  misc_feature (65)..(65): n is a, c, g, or t
  misc_feature (85)..(85): n is a, c, g, or t
  misc_feature (234)..(234): n is a, c, g, or t
  misc_feature (267)..(267): n is a, c, g, or t
  misc_feature (307)..(307): n is a, c, g, or t
  misc_feature (354)..(354): n is a, c, g, or t
  misc_feature (414)..(414): n is a, c, g, or t
  misc_feature (458)..(458): n is a, c, g, or t
  misc_feature (822)..(822): n is a, c, g, or t
  misc_feature (922)..(922): n is a, c, g, or t
  misc_feature (924)..(924): n is a, c, g, or t
  misc_feature (927)..(927): n is a, c, g, or t
  misc_feature (929)..(930): n is a, c, g, or t
  misc_feature (952)..(952): n is a, c, g, or t
  misc_feature (954)..(954): n is a, c, g, or t
gaganaaaggaaaccacagagaaagttgcagtcgactcttttaagggaaattcagcagttctntnaaggggctcggaagagtgcnacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcanccatgaaaatgaaactgattcgtggacggtgangcaaataaataaaaacagtacatcaggaaccattaagganacagatgacattgatgatatttttgctttaatgggagtttagatgcncgcccatatgtgagacttctaagtgattaacaaggctagttcagtgttctaagtagaacngctaagatctggaagtaccacctggactcacagaggagctgctntagtgcagcattgcacaggagttcatttcagttcagtctacatttaaagtagcattgtgtcatttcatcaacaagtatttcttttttggcttcaactacatgtcaggtgttaatatgaaaaatctgccacagccctacccttgagaagcagatgtaatcccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagcncctgacatttatgttttcttgtttatatgttggaattgatcaacaaggtttgccactgcttgtattaccagggactggttacaaccattatttctcttcntngcntnncttatctcatattaaagtgagntnggagtctccaaaaacaagcccgagtatacaaaaaaag

SEQ ID NO: 723817 - DNA, 329 bp, Homo sapiens
aacatgtcagctgacgagcttcttgagcttatgtcaagttctgtagttttccatgtatatgcccagatgctcctagaacatgatcaaatgatgagctataatatctgatgattacatcataaattatgtttaatggttacagcaatgatcactggctatctttcgttcttgtgtttttcttttccgacaattcgggctatttgcggtgagttcagttcttcatgttcactgatttgggtctccaaattgagttacggctatgtttagagttgcgttacaatcaaatttggtttcaacctgttcctaatgaattttttcgaacctcaaag

SEQ ID NO: 723818 - DNA, 218 bp, Homo sapiens
ggaaagttgagcaatatgacgtgaagtcgtggaagcctgtggctacaaaaaatgttgacgccgtcaatgccgtcgagaaatggctgaatggcgagacgtcgaacgtactactgagcgcttgctaggagtggtaaaactagagcacccagctaaaagttgtaactaagcacgtgcttgacattatttgcgtttcggcttgttcttctattagactatgt

SEQ ID NO: 723819 - DNA, 156 bp, Homo sapiens
gggttcatttaattcatctactctacccagtcactgcatcagaggatctgattctgtccaacagcactatcatgcgccatctctcgggtgggacgtcagccctcgaccttgccagccctagctataagccacctgacaccacggtgtgtcaatcac

SEQ ID NO: 723820 - DNA, 452 bp, Homo sapiens
gctggaaagtcggccaagaaagacaaatgacccacgtgaagcaaatccggggggcaaggccaaaaagaagaagtggtccaaaggcaaagttcgggacaagctctaataacttagtcgttgtttgacaaagctaccgtatgataatacatctgtaaggaagttcccgaactatagaacttataaccccgagctgtggtcatctgtagagtactgaagattctgaggctcccgtggccagggcagcccttctaggcagcgtccttagtaaaggacttatcaacactggtttcaaatgcacagagctcaagtaagtttacaccacgataataccaaggtgtggagatgcgtccagctgctggtgaaggatgcactgaataggtccaaccagctgtacatttggaataatataatacacctttattaaatcagcaacatagaggacatgttgaaaa

SEQ ID NO: 723821 - DNA, 848 bp, Homo sapiens
gtgataaattcaagtacgctggccagtgtcatgtggtatatgtgctttggactgcgactcagatttgacagttgcgtgttgacaggtggtggctgaatctcacttcctctgctggtggcctcggtagcacagtgaagggttgttgatagggtagccaagtgagtcaaagtgatgggcccctgggctcattgggatgtagacgctactgggaattatcacctgctcgttccatggccaacatgggttggaatgaacctgcattaactgaactctggcatatcagtatcccccgtcttctcactcccctccccagcctcaccacaccatacaacacacaacacaatcataaatcacaacatatcgcgtacatatctactagtaccatgcacgaaccttcccctatctcagtatgcttgcaactacgtcacaacaagcacaaaagtagcaatactgattctaccgatctacgtctgccctatcaacatccacacatcccacacctcattacacatacacgaccaaagacactctcccacgacatcgtcagcccatcttcgacccgcttggggccgtaatccagtgagcctacgggaaccagggctcctggctcgctcacgagccataaccacacaccttcacccgaatacctatccacctccacttgactcgtcctcaactcccccacacccatgccaccacgctgaccacacctgcccacagtatcacccaaattctcacataacaatctgtcctcgaatccacacatcaccaatcaacccacacctacctccctcatcccacggtacactcaatatctatgtcaccacgcttctagtcttccacatccc

SEQ ID NO: 723822 - DNA, 106 bp, Homo sapiens
tgtgcagtacggtattgactgtgtgtgatgtggtggcttcagtgaacagaacagtgtggtgacatagtggccccaatggacaggagcatgtggtgacatgtgtatg

SEQ ID NO: 723823 - DNA, 768 bp, Homo sapiens
  misc_feature (3)..(3): n is a, c, g, or t
  misc_feature (138)..(138): n is a, c, g, or t
  misc_feature (165)..(165): n is a, c, g, or t
  misc_feature (185)..(185): n is a, c, g, or t
  misc_feature (193)..(193): n is a, c, g, or t
  misc_feature (235)..(236): n is a, c, g, or t
  misc_feature (243)..(243): n is a, c, g, or t
  misc_feature (255)..(255): n is a, c, g, or t
  misc_feature (268)..(268): n is a, c, g, or t
  misc_feature (624)..(624): n is a, c, g, or t
  misc_feature (642)..(642): n is a, c, g, or t
  misc_feature (658)..(658): n is a, c, g, or t
  misc_feature (673)..(673): n is a, c, g, or t
  misc_feature (680)..(680): n is a, c, g, or t
  misc_feature (697)..(697): n is a, c, g, or t
  misc_feature (752)..(752): n is a, c, g, or t
ccngcggggcgggctctgggttgcgttccccctctcgttctgcccttccccctctccctgttcccccgggctgcccggcgcctgctgagtctcccccccccctcgctcaccgctctgacccctgcccggccgcgcccnggctgcgggcgttgcctctgctgcccntctccggggccgtcggccgngccgcccnggcctctgctctccctccctccctcccggtgtgctggccccnncggcccnggcgtccttccnctcttgcctgccngcgccccaattgccgggactgtagtctgcctctggatgagctgggctgtagcttgccgtctccgaagccgggcaggttggacggggtagggtcccagagcccatggagttattgctgagaagatatgcaggggacacattccccaggggcagagtagaagccctgggcctggaatccccgggcgctctgtgaaggggcggggcagatggggactcctcgtggaagcccctgggaaaaaattaaccacggaagggcatagcctgcctgacgtcaacgctgggctcaccagctccttgctttgtatctccagttgctaagagaccttcagactgggatcaggtgggataaggaagcanggtttttgttaaaggagnaaaaggagtccatgangaatgatgacaaagngctgcanaccttcccaggtcccangacgactgaagaccactgcccgtgctcttaccctacgcatccctaaatcaggggngggggctggtctcggg

SEQ ID NO: 723824 - DNA, 364 bp, Homo sapiens
gcatggacaggagggagtctgatcttgcggaacactccatcgacattgcctaaagttgctcagggccaatccagcaaagcagtccgttttcccgttgggcgagatagagatgtatgtgttagatacagaagagttcttggatgagccaaggacaagctggggtgtcctatattgaacagacctcgatgaaaatcttgaattcaccccagtgccctctgtgggcaagggaaggtgaagattgagaagttaaaaaagcttttggccacttgagaggatcagggccgcaactcttgaagaagcaaagggctcagtgcattggggtcagcgctggtacagctgaaggatgccggccttgtgcaggtcc

SEQ ID NO: 723825 - DNA, 144 bp, Homo sapiens
ggctacttgacaacagtatcattacagctgtgttcctttcatagttgccatcttggccatgcaagaaaagaaaacaagcatttactctatgtcggggggcggttatcgcgtgctgcatcgatgcgtttgcggtacaccaccatc

SEQ ID NO: 723826 - DNA, 217 bp, Homo sapiens
gggtcatcggcggtcccatgtgcgttattacgctcataaagtggtaaatcgctgtcatttttgatatctataatttaacttgggagtaaaacctttccactgccattgcttacgccaagcagctataccaacttcatattcactgtctttgcgttgaataccataccaaatattatctgctaaaaaattacgcttagaataacgtatgttgctacta

SEQ ID NO: 723827 - DNA, 352 bp, Homo sapiens
cctcccctcccttcccctcctcttttccttctcttttccttccctgagacatgtctttctgtcatccaggtttgagtgctgtggtgagatcatagctcactgtaatctcaaactcctgggctcaagtgatcctcctgcctcagcctcctgagtagctgggactacaggtgtgtgccatcatgcttggcttattttttaaggttttttttttttttgaaacgggatctctctatattgctcaggctggtctcaaactcctgacctcaagtgatcttctggcttccagccaccagagtagctggggttacaggcacgagccactatgcctggcctcttcaattgttttatcttt

SEQ ID NO: 723828 - DNA, 319 bp, Homo sapiens
  misc_feature (308)..(308): n is a, c, g, or t
atgacgctctgggaccaccagggtgggacagagtcctaaacatgtggcacctacagcctgaggggtcgtgggacctgaggaaacagcagtgttgctgaggtccagtgtgtccgagttcctatcgggcaccgtgcagtaggctaggggcttcctcatagagggagtcttcatttaattacacgacagccccccgtggatatctgagtaaacaggatccgagaggaaagtggctcctaggccacagagggacgtcgcgccggagacccacctctgaatgaacttcttcaccacttccatccccgcgtcgngcgcgccgacg

SEQ ID NO: 723829 - DNA, 287 bp, Homo sapiens
gaactatgaaggaacaacacaatttttcacaagcacctctcatgtctgaatgggtcctcactgtctagagttaaattccaggctgatgacactgtcaggtcacatggccagcatgtgctatatggcctggctcaaggcctagagctctgaggtttgcatgagaagcatgacacactagccaaacgcagggagacttactctagtcttcctgatgtcattccctctacggttgtttttctccatagtccaaccataaggtgactagtatatccatttgtagaccatgt

SEQ ID NO: 723830 - DNA, 115 bp, Homo sapiens
tcctccagcttggagtagcctccctgctctatttctgccatgccacctctggccaagacaatctttccctggtttcttccagctcccagacactacattatacatcaccctggcc

SEQ ID NO: 723831 - DNA, 187 bp, Homo sapiens
cgaaatccgcgcattagctgcttcattcagaccgatgacgacctggcgatgagggcctcaatcgcgctcgatgcaccaattttttccagcaatcgcagggtatcttccgttagcggtcgacgatctccagtgtgcggtacggtgatgacgccttcaagccatagcgacaggcctggaacgtgttaat

SEQ ID NO: 723832 - DNA, 175 bp, Homo sapiens
tgccaggcaaacaataattttaatgattaaagcattttaacaaccccgtgaagaaacggaagcccactgaagtgaagggggtggacatgaccatataataaagggcaaggcaaatgtccaaccaccattgcctagaagtctgccgtgctttccccacagagaagagggcttctga

SEQ ID NO: 723833 - DNA, 875 bp, Homo sapiens
  misc_feature (306)..(306): n is a, c, g, or t
gggaaaacacccccgcgggtgaccgggaacatcgtagtggtggcgcccctccacgggaacagggcgtcgccacagagaattgtgtggggacaccccaggaagcggcgcccaacagagggttgcgccaagtgggaatgaaacaccggggagcaaaccaatggggaggaagaagaccacccagtgaggaacacaagcatgttgtccccccgacaacagttggcagagcacacagacgtccgccgctcacactcagtattgaggggacgtctctcgcccccgctctctagaggacgctgggcggcgggnggcgacagcagggcggcctcacgtctttgaggacgtcgcgcgcgcgcacgagaaaatcgccgccgccccacttagggaaccggtaccacacacggaggccgatgacgcttctctgaggaaggcctgcaccaccgcacgcggctttcgaacagataaatctccatgctactaccgcgccgcaacagcttgtgtagacaaaagaaaagcacaccgtccagggagggcgggacaaccatgggttacgcatgggtatccaccctccgctgcaaaacgacgggaggtaggcccgcacaatgagaggggggtacaaacacaccaagagggaatgtgttcctcgagccattagacacaacagaaaagtggtttttttattcaacctctcgcagtacacccaacttcttatatcacggtagtcccccccttgatagcccccactgtggtgcatgtccttcttgaacccgctttcctaaaaaaaaagcatcgctgtaaataccagtgccctcgacgtaccaccttttctgtcgcacctaaatcaacaacagctgccgccccgtcccatcataatacaa

SEQ ID NO: 723834 - DNA, 446 bp, Homo sapiens
  misc_feature (64)..(64): n is a, c, g, or t
  misc_feature (103)..(103): n is a, c, g, or t
  misc_feature (162)..(162): n is a, c, g, or t
  misc_feature (186)..(186): n is a, c, g, or t
  misc_feature (280)..(280): n is a, c, g, or t
  misc_feature (295)..(295): n is a, c, g, or t
  misc_feature (369)..(369): n is a, c, g, or t
  misc_feature (400)..(400): n is a, c, g, or t
aggtgatctagaggatcccggagagcatccttacaccagacgtgatacagctccttctggggcnggcatccggggccaggctagaaacagaatctaatgcctngtagagccccacacatgccaggccccttcctctgagtcttggcctaggcggttcccacngtctggaataccaggctcccttcnggctcattcagattagaattatagaacccagctcagatgtgacttccagagagggtccaggcattcaaacccactctctgccatgtcacttagngttctgtgcctcagngtccccacttagaatataggctcatgtggcaggttggtggtgagggttaaatgagataatacatgcactatacngatctcacagcctgctccgggtgtgcacccngtcaatgacagtcactgataaacacttgaggaaacacagaggatca

SEQ ID NO: 723835 - DNA, 271 bp, Homo sapiens
  misc_feature (157)..(157): n is a, c, g, or t
  misc_feature (159)..(159): n is a, c, g, or t
aggtaagatatactgagagtttaaaatccagtagagccccaaccaatgatgaagccctaatgaggataaagactgaagaggtgatagcacaaatacggaatatggatcaaacagaaccagcaaaagctagaacagtttggacagttttaaccgccananctggtgtttcaaaaataaaggatcaagaataacaaccgggaggaaaaaggcagctgaaatgacctgaagattactgctgctatcacccactggctttgactgaacagcaact

SEQ ID NO: 723836 - DNA, 362 bp, Homo sapiens
aacactttggaaggccaagatgggagaatcacttgagaggccaccctgggccacataaggagacctccatctctacaaaaaatttaaaacttagctggacatggtggcacaggcctgtagtccaagccactcaggaggcagaggtgggaggatcccttgagccaagaagctcaaggttgcagtaagctgtgatcacaccactgcactccagcctgggtgacagagaccttgtccccccttcccaaaaaaaaaaaaaggtatcaatgaatgttctgcataggaaactttcatctcacctgctcctaggcaagaatagcaatcatctctgggcagaattccttcaataaatatttactgagtaa

SEQ ID NO: 723837 - DNA, 1171 bp, Homo sapiens
tttttttttttccattctcctttccaaagccagggccaggcgctcctgtggtgttacgggtgtgcttaaacacattcaggtgtgtgccattcccttcacatgtgcatgtgttcgttccccaccccttcctttcccaggggcttctctgggctccaggcgtttcctcgtgggaccctcgtgcagattacagccgtgtgtgcgtggacccccagccagggtgtgagggcctcatttcgtgctcgtgtctttccccagtgtgccttcagttttcccccaaaagcgtgcttttcagcgttcctttcatagtatagggggccttcccatgtgggggccaaggaactcccctttataggatttcaattcttttccctctttggggcacgttgtgggctttgtgagttccccacagggaattcagggtgtgaagacattgacaaaaaagcctcagtgtgagcggaatgtgacagcagcgtgggtgtggggtggctgtgggagaagaggctgcagggagaaggcagtcccccccaggggggcgcctaagccgggggaatcacgtgcaattttcctcgtgagatcccgattgggacaaccaggcccgggtttgaccattcccttcccattccattcggcattggtgtccaagcggggggctgtccactgcggggggctgcctccccatcgggtcctaacagttctaagactgggactggagttcctgggaggtgtggggagggggggcgtgttccacttctagaacaaattcctcagcagcttgagcccgagagagaatggccaagcagggaagttccgaaggacccgacaatgtgggcgggctggcccggggagcgacatcagccgctgtactctggtcaccagaagcgtccgacacaccgtgagctcccacagctgacagacggggagcccccgggcaggttacgcgggaccacaaggccggagcccaatacgtgagagagcgcaaacaacataggggggagaaaaaccacaggccgaacactataggcggaagggcttcacaaaaagcattaggagagacaagaggcgaagcaaagagggcaaacaacgcggaagcgacgaatatagagaaacgaccagcggcgagactgtctcctctgcctccgtgccccgccttgttcctttccacataacagga

SEQ ID NO: 723838 - DNA, 124 bp, Homo sapiens
cctgatagaacagcagcttcagtctatggtaaataaacccagactaacacacatgcagacaaacagcactggtgaattggttgaaacttaaatgttttattgatcaaatttaaacattattcag

SEQ ID NO: 723839 - DNA, 128 bp, Homo sapiens
ctcagtctgtgctcccctaagtcagccagacgcaagtgctaacacacttttccagtttccttctgtactgaacagtcatgggccattcaacgcctccgggccattcaacgcctccgggccattcaacg

SEQ ID NO: 723840 - DNA, 454 bp, Homo sapiens
  misc_feature (58)..(58): n is a, c, g, or t
  misc_feature (99)..(99): n is a, c, g, or t
  misc_feature (115)..(115): n is a, c, g, or t
  misc_feature (139)..(139): n is a, c, g, or t
  misc_feature (147)..(147): n is a, c, g, or t
  misc_feature (152)..(152): n is a, c, g, or t
  misc_feature (164)..(164): n is a, c, g, or t
  misc_feature (167)..(167): n is a, c, g, or t
  misc_feature (177)..(177): n is a, c, g, or t
  misc_feature (263)..(263): n is a, c, g, or t
  misc_feature (351)..(351): n is a, c, g, or t
  misc_feature (382)..(382): n is a, c, g, or t
  misc_feature (437)..(437): n is a, c, g, or t
ggttaaaaggaaaaaaagtaatttgaatttcccaagtgcctccgctgcatattccccntgttagatcccattttcatgttactttgtagccttggccanaggctcaaaaaggacncaaccagtttggggaaggggtggntaaggaanatggnataggtgaaggnggntgtgtgaccnctttcccccccccttcccaccctttagacaactttttcccttacctgtttttgctatggcggtaaagggatttttcctttgccccnctccctgccaaacctttatcctgggatcctattttgggcctggggggggtaaacctggggctggttttagaagggggttaggctgcanactgccttgtactccctggacccccccaaanggggttttttgggttatttcataaaattttttgaagtccaataaagcaggtaggngatttttaccacagccc

SEQ ID NO: 723841 - DNA, 965 bp, Homo sapiens
gaaggctacatttgtgtgagtgttgttgtatgcttcaggccttactgttttggaacattcggagatctcactgagctaatctgataacacaccttctcagctcatgccataaggggatgacctccatttgtttcctctgactagtggtcctctgctgacattcgcaaatgcccaccatcgattgtgtcgggcgtcttgggatttcccttcagtttctctcagtgtcctaccgtgtgcaagtataggtgggccaggtcgagtctctcacaatgacgggctacttgggattgctctatggtaagaactacatgagtgtgaaatggcgtgtgaacgaatagcttcggactacttgttcaagtgcgcttgtccagcgaccttagctgtttactctctatgagacagtgactgttattactctaatttttcttacttgggttagagttgaagacaattggacgtttacacatcttgtttccccagggctcgcgtcatttggatccccttggcgactaataggcttagtccacgagggggaacatcgcatgttcttagctccaaaaaggaatcttccaccatccccgttggcccattgaagcaaaatagtcacgcacaagtggtggtcatcgctttattctcgacaaggcccaggtttatgacgtcgtgaaagcttcgggcgagatgcgttcataataggttccctatgcgaacttcattatggcgcgtcgcgtttcctagacccgtggcccccccatttggtacgcaaagggacagcacctgggggtactacctagactccctttcgatgaaatacgctttgccttatttagatatgccgtctaagagtacattcttccattttacaatttttaagttcaaaacaaaatgtatcttgacaccttgttgtggtggtttcacaagtggtgcggcgctttgagggccagtttgaaggcccggaattcttgacc

SEQ ID NO: 723842 - DNA, 630 bp, Homo sapiens
gtgtcgttactggggctccgggaatgacaagttggtgatattgatggaggtgctagggtgcatgaattggggtgacaaaggtatggatctgccccccatcagtagagttgctttagaccaggagggagctgcctagaccaggcccaagacagtctggataaaaagcagagaagcttcatttggtccttaagttataaaaagagtgaatatcaggacagacacgagtctgagtcctgggagttaaaggttggagcccagtccttcactgagggatgggagccacacatacaggccttcggcattggtgggaaagagctgcccctgggacgtggagtcttctgtgagtggatccgctaggactcaggctctcagagcaagaggtttggacattcccaaaggtctccaaggagctgtggtggttcttttgatccaggatgggagcttatacttagaagaggcaaacatctctttcctcttgcccttggattacttggtggccacagctccctgacattgtaatcagagcccaagttacttgacttctgtgggcttctgggaggtgaatgagtgcaagctcaaatgctcctcccctgaccccagtcactgagcacatccatgtcttctgtgtcc

SEQ ID NO: 723843 - DNA, 355 bp, Homo sapiens
cagtttgaaatgttgaacttaaattcttgcaaaatgtggcacatgctaaatggtagttaatatttgcaaaggcttgtacagcaaccacccatgtggttgaatcacatccagtcttcatatatctcagttggttactcaaattaaagtattttttattatatggaatgtccagtaactattggtgtcttacgaaaatatagtaccgtgtcctatatagagctcacatctacatgtgctactctacactatgactgaagaaatctcatatatgaaagtcacagttatagttgacacatatcactcagtttatcactctccacaggatagtgtgtaatagtagaggtgtgtctatact

SEQ ID NO: 723844 - DNA, 538 bp, Homo sapiens
cgtgggaggtatctcacaggtaatgagtaggcgtatgggtatacccatattgctgaactggtaatgcgtatctacaggcaatccattgccatccttcacgctatctgaccttttctccacatcggaacaattacatactgctatgtcagctactttgccaagaaagggacagtaagtctatgggccattgatggcagccagtcaatcgacgagaactttacgcagaccttgcccagaatgccaatgcattctcatgcacagcccccagatgccagggaagaggatatcatacttgaaggtcaacagagcctgccatcccaggcttcagatttggagccgatactcaagcagcttactggaatccgtctctgtccctggaacactaaatgaggctgttgtaatgactccattttcatcggaacttcaaggaatttcagaacagaccctcctggagctgtccaaaggaaagccctccccgcatcccagagcctggtttgtgtctcttgatggcaagccggttgcccaagtgaggcactcc

SEQ ID NO: 723845 - DNA, 169 bp, Homo sapiens
ggcggtaccaggcaggtcagaaagcatactccaaaatgaaggccagctgcattagacacagaagtttttctttgaccttctcctgctctgtctctcagtcccattctcccccaaggtaagccatagaaactagaatccctcttctctaggtcacagaaactagaactcc

SEQ ID NO: 723846 - DNA, 107 bp, Homo sapiens
acaaccccggacaagtggccaaaggtggcctgggctttaatactcaagagaatggtggaaggttaaagcagcttggatttattcttactttgtatgttgtgtgttgt

SEQ ID NO: 723847 - DNA, 112 bp, Homo sapiens
cggtcgaataccgacagtacagtaggttcttatctgtggtgagtataaactagaggaatgctctacaggtgcaacaggttcagtgtgtttgctgacgtccagtgtacagtga

SEQ ID NO: 723848 - DNA, 107 bp, Homo sapiens
cgagcgtcctgagcgcacccctcgcagccctgtgctgcctggacgacgacctggcggaacgatactacggctcaagagcatgacgcagggacgagcagcagctcatc

SEQ ID NO: 723849 - DNA, 325 bp, Homo sapiens
catggatgtcttctctgctatcaagcacgaattgctattgagtccttctatgaaggagaatgactttgctgtgaccctgactcgggacatatttgtaagagctcaacgatggatctgttccggtctactatgatgcccgtccagaaagtgttggaagcattctgatttgaagaagtctgcatattgatgaaattgttcttgtatggtaggctcagactacgaattccaaagattcagcaactggttcaagagttcttcaatggcaaggaaccatcccgtggcataaacccagataaagctataacgtatggtgctgctgtccagg

SEQ ID NO: 723850 - DNA, 536 bp, Homo sapiens
  misc_feature (536)..(536): n is a, c, g, or t
cagaacagggccgtctgctccataaccagagcaagcgcagtgggcgagctgaactctcatacccactcacattcatgccttatataagcctctcctcctggttaaccttaacagcggagtgattcctctgctggtcgctgtttttgcttttctcttaccctattcctaacctctttgcttctctcttgctttccttgcgactcttgcttctctttactttttttttttagacatatagggtctttttttcttttaacacataggggatttaccttcattatgcttatccccattcggccccttcttcattcatgttcatctctgctattacgttctcctccacaagggatgcgaaccctattttcttttctccaagaccatgggagcactgattccctcactaggcctcgtgacaggtttctagaagagagaacgaggtcccacacccatttttggactaaattcttagacaggaaattctgggttcccttctttctttactgaggggggacaggcatgcccatttgccatactcn

SEQ ID NO: 723851 - DNA, 204 bp, Homo sapiens
tactatttgtgttggtattcggaactgaggccattcaacgcctccaggccattcaacgcccggaggcgttgaatggaccaccaggcccagctatttcgagacagaatcccactctgtcaaacaggctggagtgcagtggtgcaatcttggctcagtagaatgttcacctcccagtttcaagcaattctcctgtctctgcctccg

SEQ ID NO: 723852 - DNA, 291 bp, Homo sapiens
  misc_feature (62)..(62): n is a, c, g, or t
  misc_feature (69)..(69): n is a, c, g, or t
  misc_feature (97)..(97): n is a, c, g, or t
  misc_feature (105)..(105): n is a, c, g, or t
  misc_feature (165)..(165): n is a, c, g, or t
  misc_feature (169)..(169): n is a, c, g, or t
  misc_feature (206)..(206): n is a, c, g, or t
  misc_feature (213)..(213): n is a, c, g, or t
  misc_feature (279)..(279): n is a, c, g, or t
ctttcaacaactagtttattcaagaaaagaaaagaacttactgattcctctgttcctaaagnaagagtngcaagtgatcagggctgtgtgtagcatnccgcgttnctttagtgcagctaactgcatttgtcactgatgagcaaggaggggatcactaaagacatnttgngaagcagtagtatgtacgctctttgacaaaacacacntctgtgncttaacctgtagtttgcacacaagaacgagctccacctccccttcttcaggagggtctgctgccgntagattggctgg

SEQ ID NO: 723853 - DNA, 508 bp, Homo sapiens
tatgtgacccgatgaaacttgtggctgctgaaattttactcgcaggcttgagatagtatattcgcgctacttagagagaatgcgagtggtgggatcgtggtagcatgacattgtgagtgtgctgtggtttccattgatcgccgtcactctctcagtctccttcaggaatgactgcgtcagccatgaagacaggctcagccctgtgccgctcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccagcg

SEQ ID NO: 723854 - DNA, 565 bp, Homo sapiens
gagggctcggaggcgttctgcttcatcgacgatgagacgctgatgcattcctactcgtttcgctcgcatcacgtgtgcatggcgaataaaagctcatgtcgaccgttggcgtaccgcattggacactgcgacacaagtctcggctcaactgtctgcgtaattcagaatatgccgctgaatgcgtgccatcagacaaggttcggcgtgctgacaggcgtcataggcgatgagagaaactaggatacgtggtctactagatgcgtcccagtacactgatgttcgcgaatgtggtatactgcactatatacacaggggtgttttcgccgccacttggagaggcccaggagtttagatacgtatgaagcccgcaagtggtgccaccgatcggtccccggacactttgtcttaaaattgcacgttgaaaacgggtgggacaatttcccctttggtctgatcgacgcatctcaagacgcggaccaaaaacatcgaggcaggcacatagggacacatgaatgttacaaaagagtacgacgatgtgcccgttggcgatcttggcggatttttg

SEQ ID NO: 723855 - DNA, 142 bp, Homo sapiens
tggaagtacggcttagcggcacaatcaatttctaaaacagagggaatgtggaagagagaaaatctgatatgtcctgcaagataccctcaggaggtctctaggacactgataaatatcacggtatcatctagaaacgtggagc

SEQ ID NO: 723856 - DNA, 145 bp, Homo sapiens
tatcactgcacatggagactggtgagagctgcgtgtaccccactcagcccagtgtggcccagcaagaactggtacatcaggaagaaccccaaggacaatgaggcatgtctggttacggcgagcagcatgacctgatggattccag

SEQ ID NO: 723857 - DNA, 1010 bp, Homo sapiens
gctgtggctgccaggtcaaggccaacgaaggtgaacggccggcggggaggatactgtgcccaggagcaccctccctgcccgtcttgtccctctgcccctcccatctgcacatgtcacactgaccacgatctgtatgacatcttgagttgtatctgcaggacggggaccagtggctcccattttcattttacgccattttgtcgccctgcgacccactcccttcatacaagtctagtctagaatagcaggttctacgagcagctaggttctcaatgtctaagctatggaatcagctccccttatccaacatggcagtttaagaggacgtagtgaacttgggttttcgcgagtgctttgttcacgtagatggactttggggaggaacgcgatgcgtaacgccatgaccacgtgaggagaatgctagagcagagcgcgtgtctgtccccatgagcggacgtctgtcctctgctcttctgccgtcaggtcactgcctactgcctggggtgctctacttcattccagttggcatgacgtacctgtatacctgcgtggtgatgtgagcaacgtgtttcctccctgaccccgcgtaggatctgctctatgttgggatcagtcctgatattcgttcatgtgttaatttactgtttttggacatgtctgtctgttctagcagcaataaccctcctggggttcttgtggcgggtgcaataagtcccctccctgtgggtcgcttcgagatgagtatcgccattcctcatacccatactaggatcaggtccttgactctggggtgcaggcgtgcttctgttgtgtgttttaaagtccgttctgtcctgtttcgtggcgggaatgccctggggcagtcggggtatcctcgcggattcgaggccgtctactgctgggctgccatgggccggtcgctggctacgctactttccgttcgctcaagggttgggaacgagaaacccgcgttttggtggaagtgggtcttttccccttggggtcgccag

SEQ ID NO: 723858 - DNA, 221 bp, Homo sapiens
ctgcaacgattgtgtctgcctaatggggttttctgcaagagccttaattctgtagcaagacgcaacgaggagctgtgtaacttaagccagttcttcttggatcttacctttgttggccgacactaaggcagtaatcaagatcttggcttgaaacctcgaaagtcaagctattgtcctttcatctgtgtgtgatctcacaattaaatggatctacgctctct

SEQ ID NO: 723859 - DNA, 151 bp, Homo sapiens
tcaagatccctcacgcttatacttctcagcgctttatgcttctgcaacgctatcttcctgcagcgcttgatacttctcaacgctgtatacttcattagcgtctaggaggtccatggcatacttgaatattatagaagtataaagcgttgag

SEQ ID NO: 723860 - DNA, 467 bp, Homo sapiens
aaggatgacaccagggttttggcgtgtgtaactgtgagaatggagttgacagttactaagatgaggaaaattgcaaaagaataagagtgtattttgtttgcttaatcttagtttgttttgttaaaagactgagaaacagtggtggtaaaaaccagaaggtcaaggtctagaacatggtaagtttaagatacttatttaacatatggctaggtgtggtggctggctaggtgcagtggctcacacctgtaatcccagcaccttgggaggcggaggaaggcagatcacctgaggtcaggagttcgagaccagcctgaccaacatggtgaaaccccgtctctactaaatacaaaaaaattagctgggcatggtggcgcaactcggtaaatcccagctacttgggaggctgaggcaggagaatcgcttgaacccatgaggcggaggttgcagtgagccgagattgcgccttt

SEQ ID NO: 723861 - DNA, 100 bp, Homo sapiens
gatcggtcaagaggctaagctaaagaccctgaaactagacgagctacctaagaacagctaaaagagcacaacgcttctctgtgacgaaaatgatggctag

SEQ ID NO: 723862 - DNA, 329 bp, Homo sapiens
attatagtgacatggacaagtgaagcccaggctgaggtggtctgaaaaagagaacgaggaacttcttgtggaactgggtgcaatggtcacccttgctatgtttcaacaaagagaatggtgagattttgcccctgccctagagatctgtggaactttgaacttgatagagatcatctgaaattggaactcgtgtttacaagaaagcagggaatcaaacgtttgaaaacttcgcagcatgacggtgccttacgaaagaaaaacccattttctggagagaaattcaaataagtaacaaggagccaaatattaatcgccaagacaatggggta

SEQ ID NO: 723863 - DNA, 424 bp, Homo sapiens
  misc_feature (13)..(13): n is a, c, g, or t
  misc_feature (17)..(19): n is a, c, g, or t
  misc_feature (22)..(22): n is a, c, g, or t
  misc_feature (34)..(34): n is a, c, g, or t
ccacactgccggntcgnnnccncctgctgtcctnataccccaaccctggctcctcctgcgacctgctgtcctcatccccaaaccctggctcctcctgcgacctgctgtcctcatccccaaaccctggctcctcctgcgacctgctgtcctcatccccaaaccctggctcctcctgcgacctgctgtcctcataccccaatccctggctcctcctgcgacctgctgtcctcatccccaaccctggctcctcctgcgacctgctgtcctcatccccaaaccctggctcctcctgcgacctgctgtcctcatccccaaaccctggctcctcctgcgacacgctgtcctcatccccaaaccctggctcttcctgcgacctgctgtccttataccccaaccctggctcctcctgcgacccgggcttgtg

SEQ ID NO: 723864 - DNA, 379 bp, Homo sapiens
aatttccatattcaaaatgatcatattagagtggctgagtgaccttttgattttaaagcagactaaaatctggcccggccccaatgaaaagtataaaattagaaacttaaattcccagctaaatttcagctttgacccccctaactccagtgaataggtggcagctcagaaacaaggacagccctgctgctgccagagcaagctcccatccagctggcccttcgtgagagctccttcctgccgggcccgtgtgagttcagcgtgggcaaaagacttttatgccccttctgtccttcaaaagggaaatgatgcccacccccgatgcagcatgtcctgaatgaatgatctgtaaaatcccataataaaagcttatagtttg

SEQ ID NO: 723865 - DNA, 254 bp, Homo sapiens
  misc_feature (63)..(63): n is a, c, g, or t
  misc_feature (96)..(96): n is a, c, g, or t
  misc_feature (150)..(150): n is a, c, g, or t
  misc_feature (217)..(217): n is a, c, g, or t
  misc_feature (244)..(244): n is a, c, g, or t
gctgttggacaggatacgagcttgaaatccgggccttcctccagcagctcaagcgccgcgtanccggtgatgccattcagaaagtgcatccgggtngccttcagggaccaaggcgccgggacacatgcccccagcccccatagaggtctngacggatctggctgagaagataacagggccactggaagaagccgtggcagtggctttctcgcaggtnctcaccatcgcggccacggaaccggtnacccttctgg

SEQ ID NO: 723866 - DNA, 1150 bp, Homo sapiens
  misc_feature (425)..(425): n is a, c, g, or t
  misc_feature (1150)..(1150): n is a, c, g, or t
aaatcgagctgcccgtgaagaggcgggcatgacagcagaaaggacgagaagaccctatggtagctgtagttgattgaatggaaacagtagcgtaagcaagacccagaatggtcgcataaatctaccgatagaggctggctattagaaaagtttgcggtgaggggcgaccatcggaggcagaatccaattctccgagcaggacgatgctagatgacttcgacgccagatcaagagagaaatctaactaatcactcacaatcagatcccaaagtgaaccttggagccaagggcaaacatagttagccactagggaatgaagcagcgggcaagtgcctatggctagcaagtaccatcatcaaacaactaggagttgtcaccgaaaactacgatagtccggaatcagaggacatcaccgagtggggtgncatgcacgctgagttaaagggttcggttcgtaacagacgagttaggaggtaccatagcgatgaaatgcgtagaacgtaaacaagaacgcggaagtttaaatactcaagggattcgtgctgttctgaatcgtgactttccacatacttgccttccgctggtagcgcaaccagcgaccatacgaaaggaaaaaattacacggggtccccataacttgtcatcagagaggccgtgccctttatcgcgcacaccgggtaagaactggaagtaattcaaatctgtcaaagcctgtaagaaaagtttcaattagcgcgcaaacaaggacacgaggtcacaaaagggaaaatccacacggggctaccagtgggtctaacacggaagtgtggcgccaagaaaggccccccggggtttaagacattccgggcaggtaaggagacaccttttcacattgacccgttttattccaagggtgcacaaggcaaggggatttgccaagagtataccctctcatggtccctgtaaaaaaggaataaacggattgaagaacgccaattgtgaggcgccacaaaaaggccgtgacacctaatagctcacccctgtgcgaaattgtggggtagacggccccaagttgtccctcaaaacgtctccacgacgaagatttgggggggcaagttttcccccttaagaatttggcgatattgaaaccccggagaagagctgggaaagn

SEQ ID NO: 723867 - DNA, 166 bp, Homo sapiens
caatgtgtaaatgtcccgcgacgtccacctgaaagagtaatttatcatgattatactagtactataagaatcattagctctatgtgtgtggacactaattcctacttctaacaacctacatctatcaagtgctactcgtaatcgctctctcaccttttcatccaga

SEQ ID NO: 723868 - DNA, 615 bp, Homo sapiens
cgagcgaggggatggcgctgggccacgggagttcctgggagttccggcgttgccctggcagtcctgcggtcctcgtgcgtggaaggctgtcccggcgcctcaggcagctctgcgtgggccgtgggtgacttcctctgcgatccccttgctgctgatgtgttgaatgtgtgcatgtggacctttgcctgcgcctttccactgctgcctgtgccccacctggctgagtggctccatcttcctcatgacttatctgctctgctgtgacatgtgctgcctgtgggtctccctgtggcctcctgtacctgtcctccttcccatgctggctcctgggaatgctgtgttccctgtcttctggactgcatttcaccctgctgctggggatgatgcttccctgtggaatggttccactgtgctggcctgagtggtttcctgctgccctggtgactgctgtttctggcttgagtgcctgtggtgtccatgtccactgggttcttgccctgcactgtgtccaattggcctggtggatcggcgtgagtgctcatgtttggaccccatcattttgcattggctatggttgattgttttgagtgattgtgactgtgtatatttctccca

SEQ ID NO: 723869 - DNA, 327 bp, Homo sapiens
  misc_feature (305)..(306): n is a, c, g, or t
  misc_feature (315)..(315): n is a, c, g, or t
gatgttaccaagtttgccctctatacctgggattcatcccagggcaccttcacctccaagggcaacttctactccgggaaatattccttggagtttaggagatgataacccaccttcatctagttttcctggaccctctcaacctcgtgtttctttccatccgggaaatccttttgttgaagaagaaggtcatagactagatccagtctagagaaaggagaagagaaattcttcctgctcctgtaccgtcacactctatgatcagtatatacagtacactcacacgatgcacgtatactatcacnnatcagactnactgaggctctg

SEQ ID NO: 723870 - DNA, 429 bp, Homo sapiens
agaggtacctaaggagacatgaggacccaatgtcatgtgatattctagacggggtattggaccagaaaaaggacattagggaaaaactaaggtaatctgaataattcaaagtgtgggctttagttaacaataagggccgaatttggtggctcacacctgtaatcccagcactttgggaggctgaggtggccagatcacttgaggtcaggagtttgagaccagccttgcccatgatggtgcaaccccatctctactaaaaatacaaaaattagctgggcatggtagcaggcacctataataccagctacttaggaggctgaggcacaagaatcgcttaaacccgggaggtggaggttacagtgagtcaagatcatgccattgcactccagcctgggcgataaaatataaatcggtttccaaaaaaaaaaa

SEQ ID NO: 723871 - DNA, 276 bp, Homo sapiens
cagttgacttttaacaagatggctagacaattcaatgggcaaaagaatagtctttccaacaaatggtgctgggaaaactggctatccttgtgtggaagaatgaaagttagacacctacttcataccatacagaaaagttaactcaaaatggacgcacaaaggttgggtatggtgacccacacctgtaatcccaacattttgggaggccaaggtgggtgggtcgctggagcccaggagtttgagaccagcctgggcaacatggtgaaaccccactct

SEQ ID NO: 723872 - DNA, 1014 bp, Homo sapiens
  misc_feature (271)..(271): n is a, c, g, or t
  misc_feature (308)..(308): n is a, c, g, or t
cattaactgctcagtaccagacgtggcaaatctcaagtgacagtggaccccccccccggccaagtttatcaatctcgttccccttctttccaaccacctttcccgaagcgatcaacagtctcgagaaggctcagcaggaaagcttgagtctccataaccttctcttggggtgaaccttcccccaaccaatctggttctcaacatgggaaaacacggtggctcgagttaattacactagtgcattagacttccatggtttggatattccagntatgagctggggtttaaattatattggccactgtgcnttggatctttcctggttaaacagcattaccaggttgtggagttatattttcaccaattattattgcgtgtgtggcaatttgtgagagtttataatatatgtggatgtggggctgagagtgcgacatataaatttgtgcaaaacattctacaaaacacacttgtgaagggtgtgatcatagttggttacaaaagaaacagagatttaccacaggtatattatgggattccacagggttgtgtacatgttacttacagacgcatatgtgttaaatataccccgtggaacacttctctaacgaaatgtgtttatattcaaaagggggctccttaatggggggagaaacaaaagggttaaatgtggtatgtgcaactctaatttcaacgtgtgctgttggacaccaattttaaatataaggggacaaagtggtgggggccccttgcttgaaaacagaaaagcctcttgttgaggaagaaaacgtcttggtgtgtttggatgaccagaaaactctgtgtggggtgatatcccaaccttgtggaagcaaaaaagggatctttgaaattgtttctggaaaagattcgtgcgtgaaaatgtggcccgttgggggcttctctttacgagacatattaagactcaaaattctgctttgacattggggcaagatttcagacttatggtcacattcaagtcgagacgatcttcatgtt

SEQ ID NO: 723873 - DNA, 201 bp, Homo sapiens
  misc_feature (6)..(6): n is a, c, g, or t
  misc_feature (74)..(74): n is a, c, g, or t
  misc_feature (115)..(115): n is a, c, g, or t
  misc_feature (122)..(122): n is a, c, g, or t
  misc_feature (181)..(181): n is a, c, g, or t
tggatntggctggagtggcacagactggatctgggaaaacattgacttatttgcttcctgccattgtccacatnaatcatcaagccattcctagagagaggcgatgggcctattngtttggngctggcaccaactcgggaactggccaacaggtgcagcaagtagctgctgaatattgtanagcatgtcgcttgaagtcta

SEQ ID NO: 723874 - DNA, 857 bp, Homo sapiens
  misc_feature (70)..(70): n is a, c, g, or t
  misc_feature (104)..(104): n is a, c, g, or t
  misc_feature (114)..(114): n is a, c, g, or t
  misc_feature (151)..(151): n is a, c, g, or t
  misc_feature (190)..(190): n is a, c, g, or t
  misc_feature (305)..(305): n is a, c, g, or t
  misc_feature (316)..(316): n is a, c, g, or t
  misc_feature (334)..(334): n is a, c, g, or t
  misc_feature (336)..(336): n is a, c, g, or t
  misc_feature (351)..(351): n is a, c, g, or t
  misc_feature (360)..(360): n is a, c, g, or t
  misc_feature (371)..(371): n is a, c, g, or t
  misc_feature (417)..(417): n is a, c, g, or t
  misc_feature (422)..(422): n is a, c, g, or t
  misc_feature (424)..(425): n is a, c, g, or t
  misc_feature (440)..(440): n is a, c, g, or t
  misc_feature (465)..(465): n is a, c, g, or t
  misc_feature (549)..(549): n is a, c, g, or t
  misc_feature (553)..(553): n is a, c, g, or t
  misc_feature (572)..(572): n is a, c, g, or t
  misc_feature (579)..(579): n is a, c, g, or t
  misc_feature (602)..(602): n is a, c, g, or t
  misc_feature (606)..(606): n is a, c, g, or t
  misc_feature (617)..(617): n is a, c, g, or t
  misc_feature (645)..(646): n is a, c, g, or t
  misc_feature (649)..(649): n is a, c, g, or t
  misc_feature (652)..(652): n is a, c, g, or t
  misc_feature (656)..(656): n is a, c, g, or t
  misc_feature (658)..(658): n is a, c, g, or t
  misc_feature (660)..(661): n is a, c, g, or t
  misc_feature (675)..(675): n is a, c, g, or t
  misc_feature (690)..(690): n is a, c, g, or t
  misc_feature (754)..(754): n is a, c, g, or t
  misc_feature (855)..(855): n is a, c, g, or t
actctatatataaagaaatgcattccagcaacactgtcagcatctttattaccaaagaaatacataactntaacagataatctctctgtatcttagtattaaantttgcaaaanaaatggagatatatcaactctcatacaattctaaaancattgtgctgtgctgcctcacaggggtacgttcccagangtttctctctctagagcaatccctaataggacaattgttcactctgaggcttctggcttcttatctctcctctcttggggagctgctgcttctctgtaggttgcttccctgtgangcagggaccanagtttctgctctaataanancttttccactctgangtagctganccataaactanattgccttagtcctgttcaccctttggtgattctgttccatttgcnacctngnntcttcctcctcagtnacttttttttttttttgagagagtnttggtgtcactgaggctggagtgcagtggtgcaaactcagctcactgcagtctcaacttcctgggatcaggtgatactcctgcntcanccttcggagtagctgggantacaggngtgtgccactgcacctggctaantttngtaattttagnggagacggggtttcgccatgttggccannctngtntctntntnntgacctcaggtganctacccgcctcagancctcccaaggcgtgtgggaatacagaagtgagcctccgcacccggccgctcctcagtcaattcnaaacaactgtcctcacttgaggaagctggcctttctcctgtactgttttaccagttgtctttttaaaaaataactttcctccaaataacttactaattttntt

SEQ ID NO: 723875 - DNA, 401 bp, Homo sapiens
ctgtcacattaactagtttgactgttagataagtcacttaacatattttctcagtttttcacatataaacagaactaattcggttgcctcacagagttgtccttggatagtggtcttaaaaactggtgaatcagtctgggcatggtggctcacgcctataataccagcactttgggaggccaaggcagaacgattgtttgagttgagaacaggaggtcaagatcagcctgggcaacacaggaagaccccatctctacaaaaaatttttaaaattacctgagcatggtggcatgcacctgtagtctcagctacttgggaggctgagataggaggatcactggagcctgggaggggagattgaggctgcagtgagccatgattgtacctctgcactccagcct

SEQ ID NO: 723876 - DNA, 241 bp, Homo sapiens
gtttttttcagcctgtttccccagccacaggcctgctacgacccccccgatgtgccgcaagccctgtttccccatcccgcaccccccagacaacagccagggctggagtccaggcccctttcagctgctcctttttccgtgcatcgtgttttttttttgctttttttttcttcccccccttttctttttttgacccctcccctccggggggttttgtatcaaagctcctcaaaccccgtca

SEQ ID NO: 723877 - DNA, 1355 bp, Homo sapiens
gtcaactactggttcacatcctacgtgcgtccggtgtgaacgtccgtccgacaactatatgaccagtactaatatgcagaggcacacatatacttacctaccgtcggtttgccactctccacttggtctcgtctccatcaatggtcaggcacttatcaagagatgtgaacttgtccaacaccttgtggatggtggtgatgacaccacgacaccggagtcaggtctactgaaacacctgttcatgggggaagggatcacgtcatgaggcacagtgtactgagcttctgggcgttggacgagcgcacacagtaaatcagggcgtgagacttacggccaatgccaggcatatgaaccaaaggacgcgtgctgcacctatctgtgagctggcttgggtgctttgaaacgagtcttgaacacgaacatgtgctggtgtcaccttgggtagaataactacacacaagaccttagagaaaagatcagaatttacctggactagaggtacagccaagttaacccctataggtcctccgaccatgtggtgttgcctaccgatagacctatgtcgacacaataaacaaagagggaatccattgtcgacacattgcagaagtcggaacggattgcacccaatgacccacaagggccgtgtgtccattgaacgtacgtctcttacatactccggcacactgcaattctgggggcaaacaatccccggacttggggtggccatgccaattttctgcctccaattcgccaaaagtcgctcctaggggaaatctggtgcggccccaaagaaaggtctaattatcaaggcaccgttcaactagggtggaactttgtgcccgcactggttccaaacagaaattacgttcccttaagagcctactgggcctacgctaaatattaattaagctttaaccgaaaacactctcaaaagcggtttccgattaagccgttatagataaaacccttattacccaagatataagtgccccatggggggcggcacatttcaggactaggtcttccggaggcccatttaactggcgttcaccacgtgtcttaacacccccgtggacaattttcagccccaagtatgagcccagaaaaatgcgcttcggcgtgactagagggcccggacaattgccgcgccgggcaaaaccttggccgcgggcaattacctctaatctacgcttccaaatttcccctaacaattttcggaactcacactgtgagtttacaaaggttctctcacacactttgcacacttccccatgtgaccctccattacgatgtgtgaccacacaacaaacgcgctcaagggtccccaaacatttgtcagtaacggggacact

SEQ ID NO: 723878 - DNA, 127 bp, Homo sapiens
tgcatcaccaccatcactgccaccatcatcaccatcaccatcatcaccaccatcacatatcatcaccaccatcatcaccattatcatcaccatcatcaccagcattgccactaccattgccactacc

SEQ ID NO: 723879 - DNA, 985 bp, Homo sapiens
  misc_feature (146)..(146): n is a, c, g, or t
  misc_feature (182)..(182): n is a, c, g, or t
  misc_feature (190)..(190): n is a, c, g, or t
  misc_feature (199)..(199): n is a, c, g, or t
  misc_feature (210)..(210): n is a, c, g, or t
  misc_feature (628)..(628): n is a, c, g, or t
  misc_feature (635)..(635): n is a, c, g, or t
  misc_feature (663)..(663): n is a, c, g, or t
  misc_feature (727)..(727): n is a, c, g, or t
  misc_feature (732)..(732): n is a, c, g, or t
  misc_feature (739)..(739): n is a, c, g, or t
  misc_feature (758)..(758): n is a, c, g, or t
  misc_feature (769)..(769): n is a, c, g, or t
  misc_feature (771)..(771): n is a, c, g, or t
  misc_feature (858)..(858): n is a, c, g, or t
  misc_feature (864)..(864): n is a, c, g, or t
  misc_feature (894)..(894): n is a, c, g, or t
  misc_feature (898)..(898): n is a, c, g, or t
  misc_feature (909)..(909): n is a, c, g, or t
  misc_feature (912)..(912): n is a, c, g, or t
  misc_feature (925)..(925): n is a, c, g, or t
  misc_feature (933)..(933): n is a, c, g, or t
ttctgggccaccagtgcccctaccatcttcacaggcagtccctccatcgctaacctttttttaaccggccttttaggaccggaagtccttcatctcaagcatccaatgctgaaagcggcctgattttctctaccggaagccctttnccagaggctgggaacacggcccacctagcaggaagncccacctncttgagctncgccacccttnccgaagtttttctgtcacctgtgttaggctccgtcccctttccgcgttttatccccgtaccagaaaaggatacatttagtgcctcccacccagctccactaaacgggttggatatctcattctttgagattggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcgagccttcccgcttcctgttggttgtggccgctgtgctgtggggagcggccccgacccggggggctcattcgagcgaactcggaccacaaatgccagcattggactttgcaagatcnttccagnctctgtgtgggggctaccttgacgccanggagggcctccaggggtttccttgtggaggctcaccccagacaatgccctgcaggcccatttgncccangcacccnccagccccggtcaatgggntcagtctttantngcgctgcttcgaagattcgactgcaactttgacctcaaggtcctaaatgcccagaaggctggatatggtgccactatagtacacaantttaantccaattaacttcttaacatttttattaanattnattaaatccancancagatctggatcncgtctgtntttattgggggagagaagctccgagtacctgcgtgcgctctttgtctacgaa

SEQ ID NO: 723880 - DNA, 476 bp, Homo sapiens
  misc_feature (476)..(476): n is a, c, g, or t
catgtacagcatgaggggctgccgaagccccttaccctgagatgggagccgttttcccagtccaccgtccggatcgtgggcattgttgctggcctggctgtcctagcagttgtggtcatcggagctgtggtcgctgctgtgatgtgtaggaggaagagctcaggtggggagggagctggtctcaagctgcgtgcagcgacagtgcccagggctctgatgtgtctttcacagcttgcttccctttgtgacttcaagagcctttggcatctctttctgcggcacctgaatgtgtctgcgtccctgttagcataatgtgaggaggtggagagacagcccacccttgtgtccactgtgacccctgttcccatgctgacctgtggttcctccccagccatctttcttgttccatataaggtgggttggatgtcttcatctttgtctcaactttacgtgcactgagctgccttcttcttccn

SEQ ID NO: 723881 - DNA, 868 bp, Homo sapiens
tgtgcgggtaattgccagccatcacctgattgatcaaactgaagcctcagaactaagataataatccatgaagagcaaacactgaaagcgacggaacctgatctcttataactaggtatcctatgaaactcgatgtcatatatgggccacgactaactctccgtcggactcctgcctcactcatttacaccaaccacccaacatatctataagacctagtcatggccatccccttatgagcgggcgcagtgattatagggcttcgctctaagattaaaaatgccctagcccagttcttaccacaaggcacacctacaccccttatccccatactagttagttatcgaacactcgagtcagcctatcgtcattcaaccaatagccctgggccgtacggcctaaccgctaacattagctgcaggccacctactcagtgcacctaattggaagcgccaccctagcaatatcaaccattaaccttccctctacacttatcgatcttcgacaattctaattctacgtgacatactcctagaaatcgctgtcgccttagatccagagcctacgttttcaacgcttcataggtaagcctctagctgcacagacgaagataatataaaaaaccaaaggataccttcccccattaggtgggacgcgttatacgcgctacaagaaaggccccaatgggaccaattgaggggggggcgaaagcactgtccgtggccagaatatcggtagaaggtgtttcccaaagaaacggcgataaaaaaaaagggaaggagccacatagaaataacgccggtaaacacagatgtgtttcaacacaacaaggggttgggccaatagagaccacaaaggggcagaggaa

SEQ ID NO: 723882 - DNA, 1655 bp, Homo sapiens
  misc_feature (978)..(979): n is a, c, g, or t
  misc_feature (982)..(982): n is a, c, g, or t
  misc_feature (1298)..(1298): n is a, c, g, or t
  misc_feature (1305)..(1305): n is a, c, g, or t
  misc_feature (1333)..(1333): n is a, c, g, or t
  misc_feature (1397)..(1397): n is a, c, g, or t
  misc_feature (1402)..(1402): n is a, c, g, or t
  misc_feature (1409)..(1409): n is a, c, g, or t
  misc_feature (1428)..(1428): n is a, c, g, or t
  misc_feature (1439)..(1439): n is a, c, g, or t
  misc_feature (1441)..(1441): n is a, c, g, or t
  misc_feature (1528)..(1528): n is a, c, g, or t
  misc_feature (1534)..(1534): n is a, c, g, or t
  misc_feature (1564)..(1564): n is a, c, g, or t
  misc_feature (1568)..(1568): n is a, c, g, or t
  misc_feature (1579)..(1579): n is a, c, g, or t
  misc_feature (1582)..(1582): n is a, c, g, or t
  misc_feature (1595)..(1595): n is a, c, g, or t
  misc_feature (1603)..(1603): n is a, c, g, or t
ctagtcagtcattgacgctacgacgtgtccgagcacactggatagggaatgcatgcgcgtgttcactagtgttgatgacactccatcttttcccggttgaattcgaatgcaggcgccgtttaaacaacatgttttgtatgccacagggcgtttggtcaagctggaagttcggccatccggcaagtcatgcgggataagtagccaacttcggtctcgtgtttcccaccataaggctccagtggcacctgcggtcaatggccaatcaacagccttcagcagtatagccaagggggagtaccatcagccccaggtcaggcgcttcattacagcacggtatagtattcccaaggcgggtattggtgtaggtgggcctgtaccgcagcaaggccagcacgacagccctagtgtaaatgcccctcaggccactgtctgccttcaggatactggtgagggcatggaagctggttttgtactctcgagtcttggccccattccccagcttcaacatgcatccggttcttcaccaggtccaggggctggacaaataaactgtagctcccatcaccggccaggcccccattacagcgaacattgacggacttaggggaggtacggggcttccccagtctatcccagccggccccaggcacatcagccgtcgccagccatcgccacgtcaatggccctcggctccagggtcccgtgcgcagcgcaggcccacgcatcgcgccacaaggtagacaccagcgcagctgcaacagagcagagggcagcgcgcacgcccctccagctctcaggtccgacacccgctggaagccggcgcagggcgcaggcgcgcagcgcaaaggcggccgggagtaaggcggagctgaaggaggagcttgatggaagcgtgcgagaaggggcgtaactgatttggaaaccagaggaaaggcgctgttttcaccgaataaaaaacgccctgcaatagagaagagnnggntggaagggctcgcgagatttttttagtacggctcgccaagttggagcgctctcgcgatagacacagcaactattcagctgcgaggggacgggagaggtggtgagcactctcgcgagatttgaaggaccggcggaggccaaagggaggagaggacgcgcggcctcctcagcctctttcctcccgctgccatgcaccctgcgagccttcccgcttcctgttggttgtggccgctgtgctgtggggagcggccccgacccggggggctcattcgagcgaactcggaccacaaatgccagcattggactttgcaagatcnttccagnctctgtgtgggggctaccttgacgccanggagggcctccaggggtttccttgtggaggctcaccccagacaatgccctgcaggcccatttgncccangcacccnccagccccggtcaatgggntcagtctttantngcgctgcttcgaagattcgactgcaactttgacctcaaggtcctaaatgcccagaaggctggatatggtgccactatagtacacaantttaantccaattaacttcttaacatttttattaanattnattaaatccancancagatctggatcncgtctgtntttattgggggagagaagctccgagtacctgcgtgcgctctttgtctacgaa

SEQ ID NO: 723883 - DNA, 878 bp, Homo sapiens
ctctactgagggatgtaggagtttatatctgaggtctgagcctcttttcctttacttcctttactctttcctaagccttctttataaaaactatgcatgtactattgttattcctgttttgattccctttcttttattatccccagctccgtgcagtgacttgctaattctcatatgttagaaaggcagatctcctggttgacgaaaagatccacccaagcaagtcagcatgtttaataacttttctgagggggatctcaaactgtgggcacggattgttcatataatgacaaccaaatgatgacatgagaccaataaaccttgctactaggacattcctcggacggaactatattagcctactcttattatccttaggtttacgcggaagagcatattattacgttgtagacagtaacttacctaacttctacattttaacttgtggaacatcaacaaatatatatactgaaacatacaatgttctaattgacttcagtgtcccataaaccagcgttcaaacaattaccaaattgtgaccaatctttacacacatgcacaggtgtccctcagtatctgtggggcattggttctaggaccacttatggataccaacatctatggatgctcaagtccctgatatcaacatggtggactatttgcatttaaccctgtgtacatcccgtattatctaaatcatccctagtatcactttataataacgctaattacaaatgtagaatgcccatcgtacactaaactgtgcatcctggtattaacggacctaacaacgcatgaaacatgtccatgttccagtacagacgcaattgtcctgtgtgtggacatattacattccaagtcaaatgcaccatggacta

SEQ ID NO: 723884 - DNA, 325 bp, Homo sapiens
  misc_feature (239)..(239): n is a, c, g, or t
tggggttttaccatgttagtcaggctggtcttgaactcctgacctcaggtgatccacccacctcaccctcccaaaatgctgggattcaggcatgagccaccatgcccggccaatgccatctattaaaaaaacaaagaaaaagagtacacaccacaaagcactggggccaaatgcattgttttccatgtttgcaaggatttcccatagaaatattaggtttgatgcaaaaattaaatttncccagactgcgaatttttaaaatcatttggtaacttacgctaaaaacatattctattaatcaaaaccaggaaccttaccaatcaca

SEQ ID NO: 723885 - DNA, 298 bp, Homo sapiens
  misc_feature (70)..(70): n is a, c, g, or t
  misc_feature (83)..(83): n is a, c, g, or t
  misc_feature (87)..(87): n is a, c, g, or t
  misc_feature (174)..(174): n is a, c, g, or t
  misc_feature (214)..(214): n is a, c, g, or t
  misc_feature (287)..(287): n is a, c, g, or t
tagatatacaatcagctctgtacctgaagattcgtgtcacgtatactcatattgacaataacttgacaanggaacaagttacnctanggataaagcgcaatcctattctagagtccatatcaacaatagggtttacgacctcgatgttggatcaggacatcccgatggtgcagncgctattaaaggttcgtttgttcaacgattaaagtcctangtgatctgagttcagaccggagtaatccaggtcggtttctatctacttcgaattcctccctgtacgaaagganacgaatgttca

SEQ ID NO: 723886 - DNA, 100 bp, Homo sapiens
  misc_feature (28)..(28): n is a, c, g, or t
gagacatcctctataaactttcctccangaaatacaaggatccactgaaagatggtgaggaaaagctcaaatagcgactatgcacaacttcttgaagaca

SEQ ID NO: 723887 - DNA, 216 bp, Homo sapiens
ttgatctagaggatcccgagctctctctgttggggcgcccccgtgcggggtcttgggtgggtagagcaatcaggtgactggtgacgtttggcctccctgaactgcctcgagctccttgtgtgagcacagtgaccccggcgtggcactgcaggatgggcagtgcaggcccctgcgcaggtgctgggtggactgcttccaggtgtcatattggaagaa

SEQ ID NO: 723888 - DNA, 474 bp, Homo sapiens
cgcacgagcctgcctcagcctctcaagtagctgggattacaggcgtgtaccaccacacccagctaatttttgtatttttagtagagacagggttctactaaaaaccctgttggccaggctggtctcgaactcctgacctcaagtgatccacctgcctcggcctcccaaagtgctgggattacagcatgagccaccatgctgctggctgcctgcctttcaaaattgaagaaaaccaaccccaagtcatggttcctgggtgggtatcgtggcctagagagaagtatcagagcacctcagattgtcattttaaaaaagaagcctttcatgtacagttccagctttttcctcccaagggtgttgtggtaggtgtttctgtctttccactccacagacaagaaactgaggtccaaatgacttgcctgaggttatccagcaagtcgtgagcagaactagaacgaacttggatctcctgac

SEQ ID NO: 723889 - DNA, 556 bp, Homo sapiens
  misc_feature (80)..(80): n is a, c, g, or t
  misc_feature (119)..(119): n is a, c, g, or t
  misc_feature (163)..(163): n is a, c, g, or t
  misc_feature (172)..(172): n is a, c, g, or t
  misc_feature (195)..(195): n is a, c, g, or t
  misc_feature (295)..(295): n is a, c, g, or t
  misc_feature (328)..(328): n is a, c, g, or t
  misc_feature (330)..(330): n is a, c, g, or t
  misc_feature (358)..(358): n is a, c, g, or t
  misc_feature (377)..(377): n is a, c, g, or t
  misc_feature (390)..(390): n is a, c, g, or t
  misc_feature (418)..(418): n is a, c, g, or t
  misc_feature (420)..(420): n is a, c, g, or t
  misc_feature (462)..(462): n is a, c, g, or t
  misc_feature (473)..(473): n is a, c, g, or t
  misc_feature (492)..(492): n is a, c, g, or t
  misc_feature (494)..(494): n is a, c, g, or t
  misc_feature (518)..(518): n is a, c, g, or t
gtatggagagaaaactgtgcgcctgctaactgcctgccgaagacctgggctttaattttcttgccatttcaatcccaatntttctttaggagattgatgataaggttcggagtggactntttgtttgatggctttctaatatggagatagttccaagagagcnaggattaanttggccaacttcatgcacatgtnttatccaacccaaattacagttcaggtggctggtggtgaaagccaactcattaacctacagtgacatctgttcatctgatatacctttcctgagctcaanaggtctatttcttttgaaatatttatggctctnanactaaaggccatttcatttttgtttttnacttcacatgatggttaanacagatacttaanataataaaatcacctttaaaggcaaaananaaaaaaaaaaaaaaaaaaaaaaaaaaaaaggggggggggccntgggttttccntgggggggccccggcttcngngtccccggctttttttttcaaggnggtccctttggtggttggttttaaaggcgggggcctgg

SEQ ID NO: 723890 - DNA, 422 bp, Homo sapiens
atgagccggtccggacctcctgtgtgtgttgttaggttgttaatttgatcgcttctttcttgctgcttgcttttatttatttatttctttccttctttctttctttctgtctttttctttctttcagacagggtctcactgtatcactcagactggcatgcactggcatgatcacagctcacttcagcctcaactgagcccaagcatctttctaacttttttatgtgggtggttagcgtcacacatattttaaactaaacatattccaaactgatagaagatattttgcctcaagcttgcttctcctccaatgttccctatctaacaaagaagctaatctccattcccaacagaaaccacttgctaaatcctgctgattttacttcctacacattttgaagccctcctgcttattgctactg

SEQ ID NO: 723891 - DNA, 225 bp, Homo sapiens
acgggctcgcgcaaaaagctgagcatattgacagctttttgcaaggaccttgaaccgtccgccttgagttgacccgccatgcccccagaatcctccagccccagcgacctgatctacggcctcaacgaccggccgaaaccactgcccgctttcctcgcggcgctgcaacatgtattggcggcgttcgtcggcatcatcacgccgcctctgattattggctcctca

SEQ ID NO: 723892 - DNA, 442 bp, Homo sapiens
tcaaggaggaggagtcctctcatcctctgttcggtataggatcatcattccttgggcactggaatattccccctgcttcaaagccagcaccctcctcatcccctctcttctaatgtccttaccttttacaggatgcttatgacatcattaagatccctaaaagctccaagatagttttcccatctaaatgtatcttattcaatctaacctactaagttccttctgaattatgaggaatcattcaatatgtaccatggtctccaaaatccaaggcctgaacatcattgtgaagacattattcagcttagtatcattttcacatgacagttacctaatgtgttcatctaaatctaccctgcatagtctctttctacctgattaatcctcacacgagtttctccatcttccctcctttctgcaataaagttcccagtgtcatgca

SEQ ID NO: 723893 - DNA, 302 bp, Homo sapiens
ctgttgcgaggaatgctgagggttggacaggcaaaagcagatgtgtggcccagaacagctccgaagaaagatgagaacaggttagattcctcctgcgctcgcgtgtggacagcgatcggggagagtgatagttcagaccgtgttcctgtgcccagttggcaaaattccttcggccaagctattgaagcagccttcatgaaactggacacaccagctacttcagatcccctctctgaagagaaaggaggaaagaaaagaaaaaaacagaaacagaagctcctgctcagcattcctcgcaacag

SEQ ID NO: 723894 - DNA, 670 bp, Homo sapiens
attgtcgtgtgccgccacgtgcctgtgtgtatgaaacttgtgtgtgagacagtgagcgccgtctgtgagcagcgttgttaacttccccgtgtctcctctcggcggttagcccacgctcatctttgtcggattccataggattccttcgtcccccggccttcctgtgtcactgcagctatgatgtagccgccgcccgggcacgcagcaattgtgggtgggggataggcagaccacaaaagacaaatatctctggcagtggtggtctcgcgagggaacaacatagttctctcgctcgcgggagatgatcatgagcagaacgcacgcaggtatgggaagatcgcctcgtatcaaggttattgtctggcttgtccgcaccgggtcggcaccgggcttttgcgtactatttctcgcccaccaagccggactgtgagcggcgcgctctctttctattagagaacgagggcggatattgacgcaaaaattaagccccgggggaggagggttcatccgaggatactagctatacctgttgccacaagagtctcgccacagaagttagtgtgtcgtgtgttgatgttctccatccaggatgcatttgtgtcgtgcggatacgaaccaacctccacgagcagtactgcccccaacaaaccctgtgacacacaacaaaaca

SEQ ID NO: 723895 - DNA, 496 bp, Homo sapiens
tggtgccctatccagaagaccatccactgagactatccattcacatgaagcagcagctgcagctttaactatacatctaccaagagggaagggtcaccaacacaagcctcactagctcaacaaaatcatccccaacacccatgaccctaagtatcactagtggcatgccaaataatttctctgacatgcctcaacaaagcacaacccttaactaagggagggaagagcacaaccacaaatgtaaagactccattaccttcggtggcaaaggcttggaaagtcaatgctacatttctcttatggctcaatgtggtggccaggcgggctgactgagggtctgcatttactgaaagtaatgaaagcactcctccctgatgtacggtggggcaacatatgtccatatctagccagtgatacgagctatagtacagtatacaggacggccagactaaacatacctagctctgaagtaaatgcagtatcttgtcttaaataa

SEQ ID NO: 723896 - DNA, 274 bp, Homo sapiens
ttgtaagcacgtgtaatctgagtactttggaaagccagaggtagacagatacttaagcccaggagttccagaccagtctgggtaacaaagccaaaccacttatctacaaaaaaatacaaaaattagctggatgtggtggcagacgcctgtggtcccagctacttgggaggctgaggtcgaaggatcgcttgagtccaggagttctgggctgtagtgcgctatgccggtcgggtgtccgcactaagttcggcatcaatacggtgcgttggcccaa

SEQ ID NO: 723897 - DNA, 563 bp, Homo sapiens
  misc_feature (45)..(45): n is a, c, g, or t
aaatatgcaatacatattgttaactctagttatgctacatgcgtnagaacacgagaaatttatctatctaactagtagctttgtacttgtggaccaatctctgcctatttctctttcctctgtcctccccagagttctcgtacccctattctattctctacttctgtgagaacagcctttcagattccacatgtggatgaaatcgtgagatatttgtcttactatgcatggcctatttcacttaatgtcttccaggtttatccgtgttgccacaaaagacaggattttattctttttgtggctgaatagtattctatcatgtctccataccacattttcttcatccattcgtctttctgtggacatttaggttgatttcatatcttgcgattgtgagtagtgccacaataaacatagttcagatatctttttcacatgctgatttcatttcctttgggtgtatatccagtagtgggattgctagatcatatggtagttctatttttaattttttgagaaacctccatactgttttcagtaatgactgtactaattaacattcc

SEQ ID NO: 723898 - DNA, 822 bp, Homo sapiens
agcggggcggggtcgggttccgggcgcttgtgagaagatggtgctgcggcggctgctggtctggccctgctgctagcaggccgcagctggtggaacgtctgtcacacgtcgcggcctatccgcagcgtgcggcgcagatctacggccttcgcactgctgcgaggcgccatctgcttgtggccaggacgcggacgcgccgcctgcaggacctctcggctgggctccgatgggctccattgtgcgcagccgcgctgagcgatttagcagacgccttcacccagagtagctacgaccgacgaggctccgtaggtccgctcgtgggccaacatcaggtagccagaggggccctggacgcaaacattataatcctgggctgtgcggggaccggaggccgaattagcttttccttccgtggctctacagatgtgcatcaatgtggaggggtccttccgggcactgcgcgcggcttacgaatcccgactgggattgttgggcctagcagacatcgccacgcagtaagagcctatggccagaccgcccgctccgttgaagtcttgtgattggacaagacacagtgtggagaaagacccctaagccttaaccggaggatcgaaggtatgctcgggtccaggacgacgggaccttacgtgatgagccacggaccgaatggccatgagcagcctttgcctctgcaaggtgggactgaaactcttgagagatgctgctcaatctgactggtatacgtgaggacagttaattccagggacgatatggatgaaaagacagccctacagtgtgccaaatcctttgattaaatgtgtg

SEQ ID NO: 723899 - DNA, 306 bp, Homo sapiens
tgctcctttgaaatttgggtaaaaaattgtccacccgtaaaaaaagtcatttttgtattttttttatgttgtgaaaaccaaaattgtaattttataagtctttgattccctaaaattaaataatttaaatgtattttttgtatatttaaaaataaggagtccagagactacgcttaactttttatgcatgcatttgaaagctgtttttccctgataatgtagtaataagttgtattcataaaaaactgatttgtgttgcatttcaaaataaactggggtgtgctctgcctggttttgaaatcccca

SEQ ID NO: 723900 - DNA, 257 bp, Homo sapiens
  misc_feature (102)..(103): n is a, c, g, or t
  misc_feature (177)..(177): n is a, c, g, or t
  misc_feature (193)..(193): n is a, c, g, or t
  misc_feature (196)..(196): n is a, c, g, or t
  misc_feature (215)..(215): n is a, c, g, or t
ccttgagcctaaagggcccttttatgcccccctaaggtgctgttggtttattgctggcaacgtgaattttttaaggggtttaggagggggattttggagganngcctgaccccccccctatcccctgcctccccctttcaaaaaagggtggaaaatgaaatgaaagctatgggactnttggaggaaacccagngtntattttgggttaaaaaagngcttactaaggggttttttaataaaaacaaatgcccccttga

SEQ ID NO: 723901 - DNA, 1215 bp, Homo sapiens
  misc_feature (586)..(586): n is a, c, g, or t
caaagctaagacccccgaaagcagacgagctacctaaggaacagcgtaacaagagcacacccgtctatgtagcaaaatagtgggaagatttataggatagaggcagacaaatcctacgcgagtccatggatgatagctgggttggtcgcgaagaatagaatcgttagtttcaagcttgtaaatgttgcccgagcagaaccgcgtctaatatccgccattgtaaactttaagctggttagtccgaaagaggaactagctcctctgggacaacgtaggagaaaaaccattgctagacgagaggtaaagagaaattgtaacaccctaataggtaggcgctaagaagcagccacgcaaagtgtagagaaagcggttcaagcgtcaacgatccatctagcctagaaaaatcccagaacgatatagacgtggaactccgtcgacaccgcaattggagccaatctagtcaccgctatagaagaagctaagtgttagtataagtagcatgagaagattctcctccgaataagcctgcgtcagattgaaaacgactgaagctgagcaattgaacagcccaatagtctacaatcanacaacaagtcattattacgcctcactgtcaacccaacacaggcatgcgtcataaggccaggttaagactaacagtcacgacaggaactcggcaaatcttacccggcctgtttaccaaaaacatcagctctagcatcaccagtattagagggacggctggccagtgacgcatgttttaacgggcggggtaaccctaacggggcacaggtgcctaatcactcggtgcctaaatagaggaccgtaatgaatgcggtcaccaagggtcaacagagtccaaaattaacacgggacatgacctaccgtgaaaaagaggctgaacacccagtagagcaaacacctaggaggagacataattaagggccacaagccataaaacccgcggggcgtgatagcaaaaccagcgggctaacaaagccgggggaggcccccacggaaacaaacaccagcacgaggagttagaatcaacaagcccggagaaaaagacagcaacaatagcagaggcgaacagcacgaggaacaacgaataaccaggagagccccgaagcagcagacgcagggcagagctaaatgaacagatagaccctatacactccgcgcgcatcacaccacacaagagcatgagcaggacca

SEQ ID NO: 723902 - DNA, 170 bp, Homo sapiens
agactctcgaggatccccctgtttcctttactcacattgaagggacttcggtgtgttttgggagtcttggttgtgaccccaagagcacgtagtgagtgaagtaccctcaagcatagactcgggtactgtgatgatgtctgcagtccaggtttatgattctgctgttatgt

SEQ ID NO: 723903 - DNA, 357 bp, Homo sapiens
  misc_feature (14)..(14): n is a, c, g, or t
  misc_feature (26)..(26): n is a, c, g, or t
  misc_feature (177)..(177): n is a, c, g, or t
taaacccccataangatacttgaccnaatatttgaagcacagcaagctgacaagttcctatacagataggcagtgaaagagttttattttcccagcccaggcgcagtggctcaaatccccagcacttcgggaggctaaggcaggcggatcacttgaggtccggagttcccagacaancctggccaacatgatgaagccctgtctctactaaaaatacaaaaattagccgggcgtgatgcacatgcctttagtcccagctactcgggaggctgaggcatgagaatcatttgaacccgcgaggcagagtctgcagtgagccgagattgcaccactgcactccagcctggagagcagagc

SEQ ID NO: 723904 - DNA, 921 bp, Homo sapiens
cactgtgacacaagccccggacaggcaaagccgatgctggggaaacgtgtgtaagactggaccgagcggataccctagcacacgggcgccacccctcaagtgagaacgcccgggagagcaacttggcgaactagacaaaacaatggggcatctccaacacgatcatgaccgcccccgagggcccccggcgccgcctggaatggtaacaaaaactggaccgggtcctcgcggaatactattccccgcgccgccaaaccgtaaaatggtgaccttctccaggagactgttgtataaagggcgctctaaagaaagtggggaaaccagagataaaaccacacccacgtttccaagaaccacaaagttcttcgtgttttaaaaagaaaccctccaaaaatgttcttccccacgccacagttatggtcaaataaaccacaatcttgggcgcccccaatgaaatggccgtgtctttctcctcgtcattcacataattgcgccccctgaaatattttcctcccctcaaggtccccaaggatcaaacaactcttttgggtttaaaaaacaacactactgttttggactctctaaaaatattatttttcccacaaatgaattggttttcaaacccagacccctatctccacatgaggggaatttattaaaaaattctcctcttgtttccctaactgttatagacaccccaattagtattatgaatcctgagtttttcttactactctcttaatataagcatgccccaagtctcgcccaaaaggaagttcgtttttttgatataggcaccctacttgttaaaaataaccactataaccacaaaacctcttttaacccacgaatcctgggtttttttccatggggggacccaaccaattttttgccaaataaaccctttaaaagccaaaaaaa

SEQ ID NO: 723905 - DNA, 152 bp, Homo sapiens
tctcctgcgtggcgcttggggtggctcgttgtggggctcgtatcgtgtgcaccttgtcgtggcgccttgggtggctcttcgggtggctctttgggtggctctttgggatccgatccgatcccattccatccgttcctcgtctcctccacgtg

SEQ ID NO: 723906 - DNA, 689 bp, Homo sapiens
gcacgaatttacatcaccttggagttattgatttctattttattaaatatttataattgataccatccgtatttattttaatgctcacaattgtcccccaattatggcccaagaaagctccttccaactggttgctatgtccctttgaccatggccccatccattctttaaaccaccattttacctctggcaccataacgtgcgtacatacccccatcttgtatttttcctgcccccatcttttaaatccagcccattctcaaggggttccttcttaatctggctgttgttgtgttggaactcctggtacccatcttagaaccttaaggagaccagcgaacccagcccataagctttccctgatgctgcttagagttaaaccgagccccggtactaagttatgtcatggagaccagtgaactaacctctggactgcttgctacatgagaccattgattttcttattttctatgtagggtggtaccatttcctccttttgagatatttcttccaacatatagcttttccattagtggggattttgtccattataacccaaaaccatgtgacggataccccagatgtttcatgttgtagcttgggtgaattacacctttctgaagcccttacacttcctagtttatttggatttaagttgaccaataaaaattgcatatgtttatggtcta

SEQ ID NO: 723907 - DNA, 222 bp, Homo sapiens
gtgtgtacgagataagtatgctttgtgacatttttatccagctgtggagaatctctgcgctgtcatcaggtacaacaaaagatcaaacccatgtcccgatgttaactttttaactataaaagaatgccatgaaaacccatgatcaacactttaccagctacgagccgtaccacaactggccaccacaaatggccatgtcattactctgtacaccacgggtac

SEQ ID NO: 723908 - DNA, 323 bp, Homo sapiens
ctcacgtctatatagaaaccgtacctatataatgctcagctctatggcataacctccatgaaaccttttctgaccccctttgtaggagaggaatgccgtcttccccacgtcctggtttacacgatggaaaaactttctctaatacacactcctggctcctctgtacttctttaaagagattaatgtataacttatcttttaatcttttttgactggcagatcatgaaaaattgaagtgcaacatggctcagagttctgtgtttctaccctttctgaacaagtgtactccatttcttcagggccaggctctctccagcgtagag

SEQ ID NO: 723909 - DNA, 173 bp, Homo sapiens
  misc_feature (15)..(15): n is a, c, g, or t
  misc_feature (27)..(28): n is a, c, g, or t
  misc_feature (30)..(31): n is a, c, g, or t
  misc_feature (77)..(77): n is a, c, g, or t
  misc_feature (108)..(110): n is a, c, g, or t
  misc_feature (154)..(154): n is a, c, g, or t
  misc_feature (157)..(158): n is a, c, g, or t
  misc_feature (160)..(160): n is a, c, g, or t
attccaaaaaagatntctatgactgtnntnnaatagtatatctaatggctgtggcattgttgatgctcacatatganaaaaaagtgtcctataattctattgaaagtnnntaatatttattgaattattttgttactgtctgtagtgttttgtngannantggaccaaaaaaa

SEQ ID NO: 723910 - DNA, 578 bp, Homo sapiens
ccacctcccgagtgaggactcgacttggcgcagggccgaagcagagacagggtcttgctctgtcacccaggctggagtgcagtggtatgatcaccacagcattgacatcccggcctcaggcgatcctcccacttcagcctcccagtagttgggactacaggcatgcgccgccacacctgttgggagccgaaaaggccaaagggatcatgaccaactcagcgttccgctggagactatattatcaaactgcaaactgtttatcatgaatgcaggatgtgggcacactcacactgccctgccaccaaaaggtttgctgagggcctcactccctggcaccgggctccttgaagttatctattgagaaatctagcacctattgttcgaagaatgcagtcttgcaagcctgctgtcaatcaaactgctgaccgacaaccccccaccgctcttgctatctcttttgcctaataaatacggagggctgtgtaggaggactgtgtaaagctcagggtccttgtccactagaggcaagtgccccctgaccccttcttccaaatatactctcttggctttgcttttta

SEQ ID NO: 723911 - DNA, 195 bp, Homo sapiens
gactagcactcgtatgatagtcaagcatttacagttcaagatgcaacacttggaaatgtgaaaaagtattactctaatcattgtcaatttatagacccctgactttctggaaataaactgtgtaattaccttttactctgatcataatctcccagctgtctaagaggttatttattcctatatttagcagggcct

SEQ ID NO: 723912 - DNA, 595 bp, Homo sapiens
  misc_feature (110)..(110): n is a, c, g, or t
gactgcgttgtagatcgggccggctgcaaagcgtacatctgcagggctgttttcccaggttccctcggcctgtacctcgtcgcactcctcgttgctccaggtccttcagntctccgagtcgtctcaccgtaggctgtgacgagcatgagcgaacaaagaaggatcaggagggttcacggaaaaggaagcgtgacaagtttcccacataagcaaagaagagaaggggaaggctgttacattcaatcttacacccgatgaatggtgggactattaacatcatttgcacgcgaggacaggtgagtgcgaagggcatgacaaacatatgagcagacattcgtgataacttgagatcggggatcatacacgtgtatgacacatgtaagaaatgggaccaaatgttgttgctgcgcatccgaaaagagacttctacgaaagtgcctccgtgagtaatgggcacgactgatggttgaactgaagatcaaagaaatttgaacctcgggagtgggtgtcgagaaacaagaagactagtgccagggtaagccacaaggagctattcagggggaagaatatgccatcacgttccatcgagccatta

SEQ ID NO: 723913 - DNA, 152 bp, Homo sapiens
tctagaggatccctgtccgggttggtgcatccgttagcataagtgtgccttgagcaagggggtctgaggcttttggatggccttggcagtgaaggactccagcttccttgggaagtaaagcagccttgagaagagtttttattaaagagtca

SEQ ID NO: 723914 - DNA, 1482 bp, Homo sapiens
  misc_feature (316)..(316): n is a, c, g, or t
tcataataggaagcaaaaagaaaaaaatgaaaagcaaacatatgcacgcactttgcttgtagacaaatgcaagaatgtaggttgtgctgtgtaggtttaggtgctctattggattggtgagtgaccagaagcgaagtatgaaggtgatgctgccaaaagcgacgaagccgagtttctatgggaaaattcaaggttacagtggagtatttattgttgaagaccagtatgctatggaggtagaaaccaaaccgaacgacctaatacaatacaataaataatacataaaagaattttcgtgccgcccctaatatctccnccaggccaatgaagcacttccaccaagaagtatgcgctgcgcaattaaaggccctgcgaggggtcgtgcctagggtgcaacgggttctctataattcagggtcaagtttggccgaatgagatttatatagtatgtacgcaaggattccacaaatggctggtgtgaccacgcaaagaaaatagcggcgcgttttaatacaaatcggaaaccggtgtaaatcccagcaacaattgtcgtccgagaacactcggccgaccgggcaaactaacttcgtggcatttttacccaaaccgcggagaagggagtgaccccctaccattttgagcctatggggtgcgtcccagggatctaaaaacctagaggatataaaggggcttaggaaagagccgcttcggaggaattatttctccacgacgagagtactttcacaaaccgcactaagagggacgctgagaggggaagacacgtttccaagcacaccggtacagcgaaccgggcggtcgaacaccttgacggggggaacgcactgtgcgaacattcccgtgaaggcaccgacacttaaaaagccgaacattatacttcccggataaagggggaaacggcgaagagggcccccgagaacacacggggaacagggcactctggaccccgaagaggcatcccaacactgtcgtgagtctcaaaggacaaagcacagcgaagaacaaaatagtgaagggccctccggaaaggccccacaagaaggtgtcacacaaagggggggtgtacaacgcgtggcaaaaacaaacactcaacaaccccggggcaacaaagcaggcagcactagaaagcgcgacacagacactagcgagacgaagcgatgataagaacaaaccccagagaggagatgcccacagaaaaaaccctgtaaaagagagcatgcaggagggcgagcgagcaacaacaaagacagccggcacagcaccgacacaccccaacaacacacacaagacgtgagagtcgaacaggagatcgcaccaaaggtgagataaccagagggacagcagcagaccacaacctagcaagcttggcgagccaacacaccactgcaagcaagacagagacgagcaaactaacgcatgcgacgagacaaagacgacagaaccagcttgccggcatgacgacca

SEQ ID NO: 723915 - DNA, 422 bp, Homo sapiens
ctgacgaaccgagctcgtacccccttctacgtctcatcactggagaacagtctcgcacagaaaatatactgaagagctcagtcaaagtcagctgttgaagagaggtagtaatgaaagtaaaaaaaatccaaagcaaaaacattcttgtcacattattcttgctcagtgtctccttctttaaagctctatgcaggtacctgtggcatgcagcacatcctacccgtaatggagcacagtgctacacggtgaggcagtgaccagcagttgaaaccatggacagattaagggaggcagaagaagaggagaatgagtgtgcagaactgcaagaagaatccttgcctgattcaaaaacagctgtgcaagacttcagcacagcagcacttcaggtatttataatctagcatttattacttgtgacaact

SEQ ID NO: 723916 - DNA, 368 bp, Homo sapiens
cacagtggctcacgcctgtaatcccaacacattgagaggccgaggcgggcagatcacgaggtcaggagttcaagaccagcctggccaatatggtgaaacctcatctctactaaaaatacaaaaattagccaggcgtggtggcgctcacctgaatcacttgaatccgggaggcggaggttgcagtgagctgagatcatgccactgaactccagcctgagccacagagggagactctgtctccacaagtacaattactacagagtagcatattaagacttatcgggccaggcgtggtggctcatgcctgttcccagtactttgggaggccgaggcaggtggatcacccgaggtcaggagttcgagaccgc

SEQ ID NO: 723917 - DNA, 219 bp, Homo sapiens
atttctgccttgtgattaaatatgaataccatattgactagaaaattggtttgtctttaaattatggttttgaaaaggtttactctcttttgctattcatagaggttagtaggccataggccctttatctcatttatttattattagttcattaattagggcagagcttgctatattgccagcttgagtgcggtgttcatcttagccactgcaaagtcc

SEQ ID NO: 723918 - DNA, 261 bp, Homo sapiens
tctgcagtgcacgcgagtgtgtgtgatccagaggaggaaggtgacagaggcatgtgttttctgtgatctctgtgtggcttgtggcatcagaaaactgtggctggagtatgaggagaggcgtaccccttgcttctgatgtggcccaggggatgcgtgtgattgagacatatgtgtagacttacagctgcggcaccagaagggcacttatagctgagaaaattgactgctcagagagctgcaacagcttgcccagtatcatac

SEQ ID NO: 723919 - DNA, 700 bp, Homo sapiens
  misc_feature (449)..(449): n is a, c, g, or t
  misc_feature (471)..(471): n is a, c, g, or t
ctacatctggtggacagaccctgtattgtttacgtaaggaaaactctactgtatcaagagaatggaaaacatgagtgtggtctggttttatatcctaagaaacagtgggaggaaggcttatagatagagagtctatggtacaagtaccctgcaaatctaaaacttttcaaattgcatagtttacatgccagcagatgttacttcagggccatgccttttctgggtggagtttccaagggaacacagctttataaacacaagggattaattatagatgctctggggacttgctctaatattctaaactgtttactgaagaggcttcttatatgtcagtctaatgcaggcttctgcaaaagcttattctctgtgtctactgggtaccaatatagtgtgaggagatttagcttaaagttcattacagaaacactgtagacctgtttgccaanaaaaaaggcacacatactttgntcatccttgttgtgccggcgggtgcaatccaatgtagaatagaacaagcttatgcaggcgccaccattgaagatattggccacatcggccatatgaagccaattgaataaatggccgaggtttacatgtgggaattggaaaaccctgggttacccaattaaccgcttgaaaaaatcccttttgacaatgggtatagcggccccccgatcccctttccgtggccaccgtg

SEQ ID NO: 723920 - DNA, 133 bp, Homo sapiens
atttgccacgcgcccccgacgaccggcccgacggtgcatttcccgatttccttttggttccaagtccaatatggcaacctctaaaggatcagctgatttatactctcctaaaggaagacagacccccacgatt

SEQ ID NO: 723921 - DNA, 399 bp, Homo sapiens
  misc_feature (1)..(1): n is a, c, g, or t
nctcagaaaactcaaataacttgccccaagatcagagtcaagtaatcaaaacagcccaggtgggcttgacacgatggctcacaccctgtaatccccagcactttgggaggctgaggcaggcgaatcacttgagccgaagagttcgaaaccagcctgggcaacgtggcaaaatcctgtctctataaaaatcacagaaaattagctgtgtgcctgtgatcccagctacccaaaaggctgaggtgggaggatcactggagcaggggaggttgaagctgcagtgagctgagattttgccactgcaccccagcctgggtgacagagtgagacccagtttgtctcaaaaacgagcaaacaaaaaaagcagaacaacaactccaaaacacacaacaacaaagaaac

SEQ ID NO: 723922 - DNA, 1261 bp, Homo sapiens
atgtgctgtgcgtgaaatgtggtatgctgacttttcatgcatgatgactgtatgaatggctgcctgtgtgaccctgtgatgtgaacctgtgaaataaacatgaatctcatgctgaacatgagagcttgtgcatgtacgcatgttgtgctgtgctgctccacatgtgatgaacctgatgacgtgacgaacgaatgatgctgctggtgttcggaccctttagccttgtgtgatgtgcaaacatcttgtgccagagcaagcacgtgaaatgtccttagatcttttgaacagatgtctaatctttgactacatcttccccaagttgcattccatggtattagagctgcaggtttacaatgcactacgacgcatgcttatcagcccatgttggtattgcaccaaaaaccagatttataattattacttgccaagtcatgcatgcgacatgtcaaagttctgcgaaataacactacgacacgagcgcgcacattgaactccgtccaacaccattttccgtacgtcaccctggcagttcatcgagagctattcgccaggttagctctgaccggcactcatttgtctccttgtctctagttgcggttgattgcactccctcgtcaccttgaccgggtgtcctggatggctacgtgaaccttctggaccatggactcaccatgcctcgcaccttgggctattctcccttggacagctgtgcacctggcatccaactttgcgcccacggtcgcactttgccagattctcctttcacagtgtagccttgggtcttcccggatacacgcgtcccctgcgacaacgctctcgcatcttctttgcttgcgccccggtctggacccgtatccccagcccactttacagattctttctggccgtacgcttccctactctccccactttctcccagtcccgggtctacacgccacagcgttcatcaaacgcccacaagccgtggtcttctccgtaccagaaaccctcggggagcgatctgtgcgacacacttagtccataggtgacaccttcctcttctgagtgaactactcaaactctccaccaacttgttagcctggtgcgccaatacacacgtcgacacccaccgactattaactcattacagacactacaataaagagtgcagcagaccctcacaccgcgagtcagtctccaagactggctacaaacaccagtccacagcctcggtagcaaataactcacctatcatactagcctgtgtgccaccatacactct

SEQ ID NO: 723923 - DNA, 248 bp, Homo sapiens
  misc_feature (73)..(73): n is a, c, g, or t
  misc_feature (116)..(116): n is a, c, g, or t
  misc_feature (141)..(141): n is a, c, g, or t
  misc_feature (150)..(150): n is a, c, g, or t
  misc_feature (163)..(163): n is a, c, g, or t
  misc_feature (186)..(186): n is a, c, g, or t
gaattgaagactctcagggctcacccggaagatctcctgggccagaatctgcattttaacaagatgctcaggntctgtaacccaggctggagtgcagtggtgcgatcccggctcantgcagcctctacctcctgggttcangcgatcctnccacctcagcctnccgagtagctgagatcacagggnttctcaaccgggggtgattttgccccccagagaacatgtggccatgtctggagacaattttg

SEQ ID NO: 723924 - DNA, 159 bp, Homo sapiens
cagcgcagggatgcggcataacgtacagctgctctgtggcttgttgtgaccgccaagaatgagggtggaaactgtgtcatgtagagacaggtctaggaactggccccacagctcgtcttctaggcgccgttgatgccggtaggagccgcatttgaatcc

SEQ ID NO: 723925 - DNA, 648 bp, Homo sapiens
  misc_feature (11)..(11): n is a, c, g, or t
  misc_feature (56)..(56): n is a, c, g, or t
  misc_feature (546)..(546): n is a, c, g, or t
  misc_feature (566)..(566): n is a, c, g, or t
  misc_feature (574)..(574): n is a, c, g, or t
  misc_feature (593)..(593): n is a, c, g, or t
  misc_feature (630)..(630): n is a, c, g, or t
  misc_feature (636)..(636): n is a, c, g, or t
gtacccgaatncagcaaaacattacagaaaaaaaaaaatcaatgaaaccaaaaggnggttctttgaagagacagaaaattaataaatccttgccaaataaatataaggtataaggactgaaaaagaaataaaactcattattcacagatgctatgtccatatatacaggaaagcccaaaagaatctaaagataattagtaaaagtgagtttggcacagttgctgaatatgaggcatatatatatctttctaaaagatatataaaaatgcaaacaatccagaatagccaggacactatctttaaaaagaataaacagagggccaggcgcggtggctcacgcctgtaatcccagcactttgggaggctgaggcgggtggatcaagaggtcaggagatcgagaccatcctggctaagtcggctctaataaaaatacaaaaaattagccaggccgtggtgcaccgcgcctgtaagtcccagctacttcgggaaggcttaagcaggaagaatccttggaacccgggaggcaaaagtttccattgagccganaccgggccattggacttcanccttgggnaccagagccaaactccacnttaaaaaccaaaaccaaaacccccttggaaaaaactngcttangataccttaact

SEQ ID NO: 723926 - DNA, 1802 bp, Homo sapiens
  misc_feature (1244)..(1244): n is a, c, g, or t
ggttgtgtgtctgttgaggtgtgtggtgtttgtgttgtgtgtgtggtggggctgtgtgggtgcgttggtggtggctgggtggttggtggcgttgtggttgttgttggtggttgttgtggtttgtttggctgcgtgtggttgggtgtgtgtgcatgaggggttggtctggtgtggttcgtgtggctggtgtgtgctgcgtgtgtgcttgtgggcgtgttggtgtgtgcgtttggttggttggtgtgtggtctggggggttgggtctcttctgtgccttcttgtgtctgccgtcctttttttccttcgcccgcggttgggtggctcaacgcacgcagctttcgttgttttgggctgcccgaccctgtgtggtgaggcttcttgcgcgagggggtcgtccaccacgacaagggtgtgtttgccgcgcaaagtatgccgcgggctgtggttgtgtatctgggccgccctcctgtgtcttaatgatccccggtgctgcttaaaaagttatgtcgtaagtacgccttttgggggtgtcaccaaatatttctctcggcccatctttgtggtggcgccctccctccctgccctgggaatggtgataaatccgcccttgtgttgttcgtatggtgtgtaaccacctagtggggtgctaataacaccccaccaccaccggggtgtgtgttgttgtcttcagaacacacaattatggctcacggtcttgttatctcttgtggctgagagagtgcctcctctattggggggccactagcggtgtttgccccccgtgttggaagctctgtggtgttgtgcccaggaagcataacagggggtttgcccctccatatggctccttcccctggtggacaaattgttgttctcgctggatctttcttggagagctcaccatgtggtgatggagtaataaagagggagaattttttggcggttgtaaataaaaagagggtggtcttcctcctcgtccgttgtgtctacacccacgggagaatgtgtaatttgtcccaccggagcggtggtttataaaagtttgtctccaaaagggtttgtgtgtggacaatgtttcgcacaccacacgccccccattgaaatagcggccccacatatggggtggcgccgcaaaaggcgcccatatcaaatatagtgcgcgcagaaacaaaatattttggtagagagattgtaggatacggttcgtatgccgcctctgaaagccataaaccgggtgcccctgngcgctatctgtgtggcccaataggcgcgaatagcttggggacaccccaacacacacaaataggtttccccccagagtgtgtgtctgatatatggcgacattgcgccaagaacttgagattggtttggataggccaagacgcatatgtgggtgttgtgcgcccaaagtgagaaagaaaggcacatgaaatattttgttgggagggcccacatggagagcgcctcttgtggttccacaggagatatggccacaagagccacgctccaagataagaatcacccacattgtctgagctcgtggacgcacaactcgagaaaaagtttgaacttgtggtgtttagatcttagaccacccacgagtcacttcctcttctgtaagctccacaggaggaagcaccccctcccacccccactttgcttcgcacgtgaatcctagaattctttgtggcttcttcgctgcacgttccccttgggttcccaaggtttcccttggtccctcccaagcctagctggattgcagagttaagagttatgattatgaaattaaaacgtataataac

SEQ ID NO: 723927 - DNA, 790 bp, Homo sapiens
  misc_feature (18)..(18): n is a, c, g, or t
  misc_feature (75)..(75): n is a, c, g, or t
  misc_feature (90)..(90): n is a, c, g, or t
  misc_feature (92)..(92): n is a, c, g, or t
  misc_feature (98)..(99): n is a, c, g, or t
  misc_feature (127)..(127): n is a, c, g, or t
  misc_feature (151)..(151): n is a, c, g, or t
  misc_feature (162)..(162): n is a, c, g, or t
  misc_feature (178)..(178): n is a, c, g, or t
  misc_feature (186)..(186): n is a, c, g, or t
  misc_feature (238)..(238): n is a, c, g, or t
  misc_feature (244)..(244): n is a, c, g, or t
  misc_feature (296)..(296): n is a, c, g, or t
  misc_feature (301)..(301): n is a, c, g, or t
  misc_feature (327)..(327): n is a, c, g, or t
  misc_feature (331)..(331): n is a, c, g, or t
  misc_feature (334)..(334): n is a, c, g, or t
  misc_feature (398)..(398): n is a, c, g, or t
  misc_feature (400)..(400): n is a, c, g, or t
  misc_feature (415)..(415): n is a, c, g, or t
  misc_feature (421)..(421): n is a, c, g, or t
  misc_feature (431)..(431): n is a, c, g, or t
  misc_feature (434)..(434): n is a, c, g, or t
  misc_feature (436)..(436): n is a, c, g, or t
  misc_feature (447)..(447): n is a, c, g, or t
  misc_feature (451)..(451): n is a, c, g, or t
  misc_feature (572)..(572): n is a, c, g, or t
  misc_feature (606)..(606): n is a, c, g, or t
  misc_feature (687)..(687): n is a, c, g, or t
  misc_feature (723)..(723): n is a, c, g, or t
  misc_feature (745)..(748): n is a, c, g, or t
gggggttttttgatgatnagcgctcaggtgagttgggagaaatctggtggacggttgttgaaggtaattaaaaanaagaaggaagacgangnggggannctgcagtgagggagtaatggggttctanggttctcaccacccttgggcaaanccagtctagtncaacaacactgagganttggtcangtagaaaggggcggatgatacgtgcaggaagccgttgaaagtagaccctgcngggcangggaaggaaaaggtgctcttcgagatgttggtgtccaaggcactgggaatanaagcnttccagccctcgaaatcggtgacgtntgcnacnaagagcccttcgaagagcatcagggatttgttttcgtaggcaatggtgcgatctaagccgccananttggtgaggcccagnacaggnagctcgtacnaananaaggagaagcngtanttccagcagctctggatggtggggaggtagaccagggaccaggacaccctcttgtcctggaagaggaagctggggtgttgtggagtctggaaggactggtaggggtagtatctgtagtcanagggggcttggaagtaatcagaagaatatttgancaaaggcccccgtctggactgatagaccagttgtgacttccgtgcactccaggaactgtctgtcacaaaggcactccaggngggcgaggtgtaaatccggggcttgtaggtatcctnggtgaggttcaggcctttgtannnngccagcaactggaagggcacagtgtggaattccagggcctgc

SEQ ID NO: 723928 - DNA, 256 bp, Homo sapiens
  misc_feature (179)..(179): n is a, c, g, or t
cttatgcattagacaggattcacgtgtccgccctactctattcgcgcctagttccacaatctgcatttctcatacggggctatcacccgctgtggccggactttccattccgttctgatatgcaaactgctaaaacgcgagggctactccgatttcgctcgccactactttcggaatcncggttgatgtcttttcctcgagctagtgagatgttccagtcaccgggttcgacttcattatcctgtgacacgatcat

SEQ ID NO: 723929 - DNA, 834 bp, Homo sapiens
ggtcgtggtctggcggagctgcggtgtggcttgtggcgtctccgtgcgtcgtggtccctcccttcctcttccccatcttcttctctcggtcccgggagcccccgcccggagagagtcgcggtggctgatcgtggtgcttgagtagagccgtggttggtgacagcatgactgagcgaggtgatagaaaacgaggaagcaattctattgccaaggctcgatgacctactggaaacaaatcccacacctagcggtggacaggcgagtgtcttggggggtatggccacatcatccgagcatcgaccagtcaatcagctcccggaagtatctgcagaggtttgttgacgggaaggcccgaacaataacagggaacgatcctgatgaccctgtgactgtggatgctggcattggagacggatcacctaagccggatgcgtcctgccgacatgatacagaggaggctgtgcatatggtcgatcataaacgggtacggaaattccatggcttcaagccgaagaacatatcctggggagatgcgtagggcaaaaagtggacaacacatgcgactgagacacacgtgagcacgaagtttccgtgcggcgtctagcataggcgcacgcgctaccgtcgcctaaactgagcctctatcgtacagtgcaaaaaagaagattgagcacagggagggcgtgattactggcacgacggtgtagcagcagaatgttgccggggaccttgaaaatggtccgcaggatcatctgcagtgaagctcaaactcctgaccgacggagaggcaagaaaactcacccgatagaaatctacaatgtctatagatttgca

SEQ ID NO: 723930 - DNA, 1173 bp, Homo sapiens
ggctcgccgcccgcccgcccgactggagacgcagtcccagctatctgacttcactgtgaaccgatggctaatgcagaacgtgagtgtcccacgtgggggatgtggcttgtggtacctaactgaaggacaactgaacggggagaactcctgaatgacactaacaaccccaatgtgatttttgcacgttacatgctctgttgcaacacacggtgcatatattgaacgcttgtggtctgtgagacacaaccacgtgcacgtcgtatgcaagtagcaaagctacacaacgactaccccacacaattcgaccgacactggtgatagactacacggcacgtataccgacacgcaacctgagggactatgggaaccatcgctctagccccgagtaaacctatgttgtgtcggacgacgcacaaatgccagctcctatcctccatgtgcaacgacagtactgggtacttggtaccccacgtgaccactacagacccggtgacccgtggctaggtccaagcgtacacacaactggaactccacgacacggcactccaagagccccacaaacgccacacatcagagataccaaatcatcggcgccatggcgcaacacggtcccaaccctccctggaaacgggaccccgcggaacaccacgaagacataagtgtacacgcgttcctctggggcgtcttgcagatgaaattaccaattgctgcattccaatgtgcgtcaccaccaccgttggcaacttggcgcacacgttccgctgtgtgaaacgcaacgtcacactactgggaagtcctactatcaacccccacatcagtcgttagttggaccactcgcacacaagactccagcacggggcgttcccgcgatcaaggtcaaacacccataagaggacacacagcgaagaacaagtggccacagcacccaagacgaaaaaacagcaatcgaggggacaagataccactagataccgtgtatggaacacctcacaccacgctgaccgcggcgacggggccacaacatgcgacaaagaccgacttccggccataacgacgagtggccgcaccacagacagcgaaacacgatgcgaccacacggacaacgcaaacaaggacagttggcactgaacgcgataggaccaacaggacacgcagccaccccccaacaagcct

SEQ ID NO: 723931 - DNA, 240 bp, Homo sapiens
acgttgtagactcccgagaaatgccaaatgctcttagtaaacacttgccatctttcagatcgtatgtctctaacagtagatgttgagtgctcatgaaacttctgctggtgctacatacattcgagaagcacgtgtggacaagtatactggcgcatcagatcaacccaaaggaaaccaaggcatagggcagcataggacaaaagcacgaacgaagcaacaagcacgggaaaccttgccatc

SEQ ID NO: 723932 - DNA, 615 bp, Homo sapiens
ttttgcttatttgggttttgttttaagtaaaaaccctttaattgttggaagtcgggcttttctctatttcccaatggagggaaggggggagggtttgcccttcccccatttggggggataaaagacttacatccttttgcctcccttcggggggttggggtttgatctttaccaaggcccgcccccgcaaaggaagggggggggtgtctttttaaagggggtttggtttttttcccccgccgcggtatcactttgcaccgcgcctcctatattttattggggagctgtacaaaaccctgccctaggtgcctttttttttcatgccccataaatttatatagtaactgcccttctgccgaggaggcaccttggggagggtttgccccccccattttttttaagacccccctcttggggggcggtgcttttctccccccaaaaatttttaccattcccaattggggcaggttgttttgtagtaccctagaaaaaaaaaaaaagctcaagacagaggtgaagtgtctagtgagattttaaagtgtgcaccaccaagtattgttaaagcgttccatctccaccagagggtgtgtaccattgtttttaaattataaacaa

SEQ ID NO: 723933 - DNA, 433 bp, Homo sapiens
agcgtgggggctctccagacatcagagcttaaagcccaggactctgcaagcggcatctcattccggggtccaggcctctcccggctctccatcccctccataatcctcatgcgaaagacctgggacatagggtgatactctgtacaatgaatccaaacacgcctttgtagagcatataagcatgggcaaatggtagcagagggtatgatgacacgcccatgatgggtctgagcatagacacaaggcattggttagtgccacatgcccctatagaagacggtatagcaatgatattcatcgtcgagatgcgtccatcactgtggccatgcatcggagccggaccggccaagtgataaataggatagtcatgaagaaaacttccaacaacactggagggccggcgactaggctggaaccagagcacaggtaccaa

SEQ ID NO: 723934 - DNA, 142 bp, Homo sapiens
cagccggtcgacgagcggaccagcaagtccgtcccaccgtgacctcctaagtgtcgggtcacaggcataagccactgcactaagacctgcttactttttttgagacggtgtgtcgctcttgtagcccagggtggagtgcagt

SEQ ID NO: 723935 - DNA, 162 bp, Homo sapiens
caaatagatccctaatgcaaggtacaaaggatctacaaccaaagagttaaaattgcaattgcttattcgcaggaaacactaggtaaaggctcacttatccccaactgtgcaaaaaagcaaggcaacccagttgaatctagcctccaaccaacaccaaggccc

SEQ ID NO: 723936 - DNA, 506 bp, Homo sapiens
ttactgatcgtgcgtatacttgacggcagtcatacggaagcatgagctgttacagatcggtgagtataactagatcacgcgtataatggagctgacgacgcaacgcaggtgcgaccgtgcatgggtctgcaacacccacgctgacttcgccgacaagtgccccaagccagagatgctgaccatccgcttcctgaatgctgagaatgcacagaacatcaaacacaaagtcagaagcaatgcaggacacgcagatcgacagagagagcaaaagcacaggcaggatcaggcaaaacctgatcatgccagaagaagtgcgcggcaaagctagacgctctctcggtgacggaggcgcacaaggaggatgctgaggcgcaagcaatagatcgtcttattttattttctcttcctcatctttcctttccttttatcaaaaaattttaccctgcccacatctttgtcgggttggtctaaattctttcatttagcacacagggacgttatataac

SEQ ID NO: 723937 - DNA, 175 bp, Homo sapiens
tcgccaaatggactcactggcgtgccacagatggctgtagacctgtaagcgactcccccagtccggtttccaaatctgtatcatgagagtaacaatcgtgccatttgccagggcgctgagggtactgagggtggcccgtggcacgtggagagattggatgaaaaacgagggggta

SEQ ID NO: 723938 - DNA, 677 bp, Homo sapiens
  misc_feature (1)..(1): n is a, c, g, or t
ngcccctccaccgattctcccccccgtccaccccggaatccttttttgcgggacaccctcctcttccctcccctcccccctggttttattgcccccctctccaccccccccccctcctccccatgatgactatacgagattttactatctctctgattcctcaagatataaaactattctgacgataacatatttgggagaacttataacataatatattttacgccccccccggtttaggcactctctcggcgaagaaacactttatttaggcgaggatatcgagtcttttacaacgattcttcccttctcttacactcgaggtcttacagcaggcgtccgctcttgtctaacacaaatacggtgttttcggtggctgtgtcccacccgccgcgctcccactgggtttcttgtgagagtcagtaagacgaaactcgtgtttcacgaggttttgtgtacataaaccgacaagcatctgcacccctcttggggcccacacaatgccccccacccttcttaagaagaagtgttttatatccccgcgccatctagaacaccaccattactcttccccgttctaacatagacacaacaacacctggcggctctgatttgtactccccagagagattgcgcccctatctctcatttaacacacctcttgcccccacaagaca

SEQ ID NO: 723939 - DNA, 1459 bp, Homo sapiens
  misc_feature (355)..(355): n is a, c, g, or t
  misc_feature (534)..(534): n is a, c, g, or t
  misc_feature (615)..(615): n is a, c, g, or t
  misc_feature (619)..(619): n is a, c, g, or t
gagagagaactagtctcgagttttttggtttttttttttccctttaaattccttttatttaaagggcggaattttacctcccgggccaataagttttgtgggtttctttcagtttctcttcgtgggaaatactcttttttcttctcgtgggacaaccttccttctttcgtggttttaggaaacaactcgtggtcccttttcccgatagaggattcatctcaatgtggtggcgaggggaagaagcctccagtgttagtggggttataaactccgacccagtgaagcctcgtgtgtgaggtctcgcgggcgggcgccatctcttataggtgtgcctgtgtgtgtctacactgtgggnatatatgtcgcctcacatgtgaaccacagaaaacatatctctcacactactctgtaaaacaccgcttataaaaaggttctcgagcacatatatacactctctctgctgtgaggcgttatattcaaacagcccgtagtgtgtgctcgacgccacaaaaaacaatatctcagagacacacnattctatattgtgggggcgccacacacgcggacaacctgtgtgtgtgtcttccagagcccccacatgtgtgtgctatgtgnggtncccgtggcgcacaacacctgctgtggcacaaaacttctcacacccacaatgtggtgtagtacaccgcgtctcgcagaaaatgtgtggtgtacccacaccacgcgtgggattctctgtggagtacaagcgggtgcacccaattctctttcacaaaaaaaatactttgtgcggagggggctattattcgggtatatttattgcctataaaacctctgtgagtagagggcctcgtgagagccacagtttcaccagcgagaagggtgatgcctcttaaacagaggttgcaccacccggaagagatattgggggaaacctcttcttgtgagattcggggcgatggaaattagcgggggggggggacacccccccggggtcccccgggtggcacattcagggggaacaccccatcttcgcacttcgccgagaagggcggcgcagaagtgtgtctcccaccaagaaaagagggtccctcccccgggttcccccaagaacagttggggttgccccctcggggtctcactgtggccttcgggaaaaagccggaacgaagacgggcatgccgggggcgcacgcgggcgaaagaagagtccccctaaagaagtggaccccggtccacagcgggtgcccctcctcaaaaaggatttcgtgggggagaaacgcgggggggtgagtccccactctggcgggggaactcaacaagggggggaccacggggacccaaaggagggggggcggcagagcagccatttgtagaagacaccccccacgtggtcggggctagagcagaggatgaggaaaccacaagagcacggcagacaacaaagttgggggaccacagaa

SEQ ID NO: 723940 - DNA, 139 bp, Homo sapiens
ggaaagctagaccagagcaggaaggtaaaagttaacaggcaacattttctcttagaaaaggtgataaatcataagtatttggaattagacccttgcacagcactgacctgggaagagtttaactctgatttgtcttaga

SEQ ID NO: 723941 - DNA, 274 bp, Homo sapiens
  misc_feature (182)..(182): n is a, c, g, or t
tagggaattaacagtctttatggggctcaaaccaggagtccgggggtctcttgaggacctctcttgtggtttttgtgctcaatttttctttctctccagcgtttctttcttcggccgtgtttctccgtatacccctcattgagcgtggtttctttcttctccggataggtggatctctgggncttttctctttctcctctctttctctcctctccgagggggtggcgtgtgtgtcactgtggccgtggtgtcacttctctcgagcgccaaacct

SEQ ID NO: 723942 - DNA, 391 bp, Homo sapiens
tcagctcgtaccggataggcgggcagacagaatgagacagtcgccgggcgctgactcatgcccgtaatcacagcaccttgggaggacgaggtgggtggaccacgaggtcaggagttcaagaccagcctggccaacatggcgaaacccagctccactaaaaataaaaaaaattacccagacgtggtggtggcaggcgcctgtggtcccagctactcgggaggccgaagcaggagaaacgcttgaacccgggaggcagaggttgcagtgagtcgagatcgcgccactgcactccagcctgggtgacagagtgagaaagaaagaaaaacagaaacagacagagacaaagagacagagtaggtgatggacagagagagacagagatagaaacaga

SEQ ID NO: 723943 - DNA, 690 bp, Homo sapiens
caacgtgtaaattcgcctcaccgtggactaagagttcctgtgaaagcgggtcgtagtgttacattgcagtataacagtcataccatggatgcatccagattcctgttaaaaaaactcctcagtcctaactgtgcactatattgcatagagcatatggctcagaagaagagtctcatggcaatttcgactgcatgttgatccagcgtttcaatttggtcaaattctcagtgctcagataatgcactagtaaaagcaatggacaccctcattagaccaatcgacatagcagtatggataggcatgtggccacagagacagtagagtctctggcgccactcggtagctgggaatccgatcagcacagcgtcctacggctgggtgtcaggctgttcactagatttctgaagaatcactcgacgcgtgtgtacagaccgtgtgagagagtcagtgtgtgatgcctagtatcattgcatacggccgcaagccagtgactgccgaccagcgtaactctgtcttatgactcaggaaagcagcactagtgagctcacatgtttggctcatagcaaaatggcaggcagatctcactgggtaggtcctggaaagccaaaggtcattcccgctgaagcacagtccagatagagaggcctgtaaaagccgcatgtcgatgtcctcacgtgcctgactcgcttg

SEQ ID NO: 723944 - DNA, 573 bp, Homo sapiens
agacagaggggatccttaaagcaggtggaggctcagcgacttatatgacaagttagcagctttacttctttccccttaacagagtagagtcaaaacaaaaggcgctagttttgtccaactgacaaacataagagatatgctcactagaattctggaaagtactcttactagttcacctttgaatccccagaaaattcaatatggctactactgatgggaattttaatctgagattgccttccaaccaagccttatacattatatccaccaggacacccctatcacctaaaaacaaccatcagacggacagcgatatgaaatgctggctatgaagtgcttcctttagttcttcgctaacctggacttgcattgagtacccgcggcagcctccctttgacatttcatttttacaatacatagggtaaggcctcatgcatgaggtacctgatcaatcctgtgtgaattaaccaatgagctgagaaatgacacagacctctctgacctggaaccatcagacttctgttcatttctcagctttctctcagatgcagtagtttttccatggtccgagcg

SEQ ID NO: 723945 - DNA, 253 bp, Homo sapiens
  misc_feature (163)..(163): n is a, c, g, or t
cgccccaagttttaccgcctcacaaatttaaccctgcccactaaatgcccattgaacctttctcatgctttgagactgattacggaatatagaatagcaaagtcaattgaagtgaagattagagtcttctgacttcatcttactgggttgaaggtaggcctcntttcttgtcctggctatatcgactgaaccttgcgagttgaaaagcttggtggatccctctagcagttcgtacctgccaggacatgcaatc

SEQ ID NO: 723946 - DNA, 119 bp, Homo sapiens
  misc_feature (37)..(37): n is a, c, g, or t
  misc_feature (84)..(84): n is a, c, g, or t
ggaaggcaggcgcacgaggtccagggaggcccttttntgatcatgccccttctctcccaccccatctccccaccaccacctctntggcctccatggtacccccacagggctggcctccc

SEQ ID NO: 723947 - DNA, 906 bp, Homo sapiens
gcctaaggactataccccatccgatatgcaacacacttatactgattgcacgggtcaccactgtaagttggtattactgtgatctctgaccaggtatcagtgcattccctgtcccaattattgagtgagatgtgactataaccgagcaaacaaatgtcaagcgatataagagaataccaataggagcaatggatctagaacatcagcgcacttctcagcattgcgaattccctcaagggttgtattcgtgatgattccgacccagttatcttggatcgagagagatcctaaacgatagccatacacagatcgattttgatcaagcatccagataatcgataaataaactcggcaatgcacacgatcggcgtcataatgcattgatgtctaagacgcgggaagaatccacgtggatggagtattcgaaaatgatcttggatggaagttgatggttgccgacggtcaaggatccacattctctacctatttgtcacctgcaaagcatggtgctggacgaggacatttgaaattgggcacaaagatcatcgacatgagtagtatttgaagataaatagcgaataggtacgtacgtgagtgaacgaaaagctttccaggtatgttatatcgccataaggacgcctgatagagtagccagtctagatacagagacgagcggcaggacccgtggatacaccaccttactgcttcagggctgacgccgtaagagacaaaagctactgactagaatatcccattgtcgcctattcatatttcatcgggcgtaaaatccgcacttttgttcccatgaaacctttgacaggacctaaaccggaatgacctgaaagttctcgcgaataacccgattggtcaccggtgaatatcgcaatacctgaggtcacccaatca

SEQ ID NO: 723948 - DNA, 918 bp, Homo sapiens
ggacgcagagaattggatctggcgcctcctaacgcagcccgcacaggagcgaagggatggagtgcagtggtgcgaccttggctcactgcaacctctgccttgcctccggagttcaagcgatcctcctgcctcggcctcccaagtagctgggattacaggcacccaccgccacacccagagagtgtgacgatccccctgatgcggctgagatgttctgaaatgaagacgttggctctcatccccagcctgaagagagaaaattctgagatggctcccttacagattgagagcagatacggggtttcaccgtgctagccaggatgatctcgatctactgacctcgtgatccgcccgcctcggcctcccaaagtgctgggattataggcgtgagccaccgcgcccggcggctgtggctaattattaggtaactagcgtcgttgggtctccctacctgaaggcctaaaggctggagataagagggctgaaggggagtagagccaggactggtgggcctgggagccaccaatagtcccagaagatcctacggggactttgcttctgctcctgatctctggaatcgattcatcagctgagcttcgactccagcctctggcatccgttctcccaagggcactgggtaggaaacacagccaagaacgattgcaggatggggtccttccaggacactgacgtctccagcttgcgcactgtgagtccctggaacgagttaactccaactcttctggaacttctcctcacttgctactgggaaaataccgggcttcggagatgcaacaggactggggaccttttcaactttttcctgtgtcacttcttcaaagggaagaaggagatggcagggacattgcccaggcacccggggaggacccccctaaaaaaaaaaggggtcaaagttcc

SEQ ID NO: 723949 - DNA, 412 bp, Homo sapiens
ctacttgttggctggagagaagtatatggtaggacaacctctgacttcatatggagaaggcacatcattggatgtggcatccatcttggctatgaagatattagggtctttgctgagcttctcgccaagtactttatacttggactccaggttcttacagtgaccacaccaaggggcataaaattcaaacagcacatcttcatatacattatacactatttcatcaaaattctctgctaccaataccttcacaggcccatcattgctctctgggataggtccagacttccggtatctcttcagattggcatcaaagtaatcatgcaggaacctctaaagagccttcccatcacgcgagaactcctcctgcatgacaaacttatctcctttaacagttctgatagcaacaaca

SEQ ID NO: 723950 - DNA, 603 bp, Homo sapiens
gcatggtttggctccctgcctcgggctctcaccctcctctcctgcagctccagctttgtgctctgcctctgaggagaccatggcccagcatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgaaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctgggggccaatgggactgtgcaggagacagcgg

SEQ ID NO: 723951 - DNA, 417 bp, Homo sapiens
aataaagtacagagtaataatttaaaaataaaaatgtaaatgcagacccttagaccttttcacccaactactctcagagagtctgattcagtgggtgaacatcacagaatcagctctcaggtgactctgtgacagtggcccaaagaccacagtggcctgtaacagaggaggtgggacatcccagatggtggaacagcctgccctgtgcagtgaggagtgggtgaagccctcatgtgaggacaggttgtctgactagagccacaaactacagtcgtaagaaataaagaaaataggttgggcgcagaggctcacgcctgtaatcccagaaccttgggaggccaaggcaggaggatcacctgagtccaggagttccagaccagcctgggcaacatagtgaggccctgtccgtaccaaaaa

SEQ ID NO: 723952 - DNA, 452 bp, Homo sapiens
ctttaattagatacactaaagtaatcttttcaaacatatgtccagaccatcatatgtgtgtagcttacaatgcagcctgtgagtatgaaagattttatttacccatagagtgtatttaaaggtaaatatagaaagcttcttcccatgacttcttattaaatagaaaactcctatgtttcagtagcactataagtattgtatataaatggtatacatggtgaattcgcaataaatatgagaaaaaaaaaaccttttacctttaacatcatccgtaaacgtacttatcaaaccctaagaacctttgatctgccaaatcaggtaacacatgtgcaggttaactatgtagaataaattatatagatatatatatattagtcgtgttactgcaaattgactgctttattctttctggggtttgggccttatgcctaggcagaagctgcagtggagca

SEQ ID NO: 723953 - DNA, 779 bp, Homo sapiens
  misc_feature (761)..(761): n is a, c, g, or t
gcatggtttggctccctgcctcgggctctcaccctcctctcctgcagctccagctttgtgctctgcctctgaggagaccatggcccagcatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgaaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccctgcgggaggcctccccatgtgcactgcgccaagagacagacagagaaggctgcaggagtcctttgttgctcagcagggcgctctgccctccctccttccttcttgcttctcatagccctggtacatggtacacacacccccacctcctgcaattaaacagtagcatcaccnctttttcttgttgctcta

SEQ ID NO: 723954 - DNA, 784 bp, Homo sapiens
gcatggtttggctccctgcctcgggctctcaccctcctctcctgcagctccagctttgtgctctgcctctgaggagaccatggcccagcatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgaaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccctgcgggaggcctccccatgtgcactgcgccaagagacagacagagaaggctgcaggagtcctttgttgctcagcagggcgctctgccctccctccttccttcttgcttctcatagccctggtacatggtacacaccctcaccctcggcatactatgctccctttctctcgttcttttttgttttttttttttcc

SEQ ID NO: 723955 - DNA, 357 bp, Homo sapiens
  misc_feature (37)..(38): n is a, c, g, or t
  misc_feature (87)..(87): n is a, c, g, or t
  misc_feature (348)..(348): n is a, c, g, or t
caatacaaggcagtttcatccttttgaggcctaactnngggaggaaatggaaggagtcatgttgccctgtgcagagtcatgcatgtnatctgtgttatgatagcaaatggccagtgttagttactcttggggaaagtagtgggattggatgagggcattgggggaggccagtgtagcttaaaccttttatttagtatgtgtctgtatggttttgaaatttttatattattttttaacttagaaataaatgacttaaatattccctcaaaggcagtcatctgtaggggctttaacaaatatttgtagttttttaaatgtcaaagagatggcttcttactgagatatttncctgtgtgg

SEQ ID NO: 723956 - DNA, 784 bp, Homo sapiens
gcatggtttggctccctgcctcgggctctcaccctcctctcctgcagctccagctttgtgctctgcctctgaggagaccatggcccagcatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgaaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccctgcgggaggcctccccatgtgcactgcgccaagagacagacagagaaggctgcaggagtcctttgttgctcagcagggcgctctgccctccctccttccttcttgcttctcatagccctggtacatggtacacaccccccacacctcctgcaattaaacacgtagcaatcgcctcacaaaaacaacaaaaaaag

SEQ ID NO: 723957 - DNA, 346 bp, Homo sapiens
tatctcaaatctctgacccacttttctgcctttctcttccacttttagagattcatttcaagccagacttggtggcttaagactgttataaccgccctttgggaggtcaggtgggcggatcacgaggtcaggagatggagaaccttctggcgaaacccgcgaaaaccccgtctctgctaaaaatacaaaaaaattagccggtagtggtaggggagcgcctgtagtcccagccactcgggaggctgaggcaggagaatggcgtgaacccaggaggcggactttgcagtgagccgagattgtgccgctgcactccagcctgggcgacaaagcgagactccgtgttggg

SEQ ID NO: 723958 - DNA, 174 bp, Homo sapiens
cccggagagcagcctgctgaggcagcagaatctcttgaacccaggaagtggaggttgtggtgagccgagatcgcgccattgccctccagcctgtgcaatgagagcgaaattctgtctcaaaaaaaaaaaggttaaaaaagaggctgaggattaaaacctataaaatggaattgc

SEQ ID NO: 723959 - DNA, 355 bp, Homo sapiens
ggccactgctgggatcagtggtgccatggagcaagcgaggagttgtttggcctgaaagccggaagcgtgcccaaatctttgcatcaccatgtaggcagtcacctcgctcctcagcactcggggcaggacagaagcttgctgtctgctcaccagacatcctgtgctgccctacagacaccttgctcgccagccatccccactcacttctgaccgggagccaattctctggccaaacccaggctctagcaccgtcttggtgctgcttgagaaacatctagtttaagtcaaaatccaatgtctttttaatatatagactatatgtacctatggactagaggtgaatatatatacatca

SEQ ID NO: 723960 - DNA, 727 bp, Homo sapiens
gcatggtttggctccctgcctcgggctctcaccctcctctcctgcagctccagctttgtgctctgcctctgaggagaccatggcccagcatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagaaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccctgcgggaggcctccccatgtgcactgcgccaagagacagacagagaaggctgcaggagtcctttgttgctcagcagggcgctctgccctccctccttccttcttgcttctcatagccctggtacatggtacacaccccccacacctcctgcaattaaacacgtagcaatcgcctcacaaaaacaacaaaaaaag

SEQ ID NO: 723961 - DNA, 535 bp, Homo sapiens
agtatggtacatagcgtgcatcatgttcgcagcatacgacgtataaaacggtgtgtaatgtatgactaccacagacgtacgctgcggatactataccgcgtatgtactcacagtcctcagtggctaatatggtagcaactgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccctgcgggaggcctccccatgtgcactgcgccaagagacagacagagaaggctgcaggagtcctttgttgctcagcagggcgctctgccctccctccttccttcttgcttctcatagccctggtacatggtacacaccccccacacctcctgcaattaaacacgtagcaatcgcctcacaaaaacaacaaaaaaag

SEQ ID NO: 723962 - DNA, 930 bp, Homo sapiens
ccaagtagctgggattgcaggtgagcgccaccatgcctggctaatttttatatttttagtagagatagggtttcaccgtatggctaggctggtctcgatctcctgaccttgtgatccgcttgcctcggcctcccaaagtgctgaagcaatttcttttttttttttttttttggaaacagagtctagctctgtcgcccaggcgggggtgcaggggagtgatctcggctcactggcaacttccgcctcccaggtttaagcgattctccgtgcctcagcctcctgaggtagctgggattacaggcgtatgccaccatgcccagctaattttggtatttttagtagagacggggtttcaccagtgtgggtcaggcgggtctcgaactcctgacctcgtgatccggcccgcctgggcctccgaaagtgcggggattacagggcggtgagccattggcgccgggcctgaagctattctttacaaaagctcttagttcggtgtggttggtgggttttctttggcgacgggactctctgtcgcaaggctggagtgaggggctgatctcaggtcagtgaacctcggggctcgtgggtcaagcgattctcctggttcagcctcccaagtaggtgggattccggggcctgcacccaacacccaagtaatttgggttttcacgcacaacgtggggtcccctttttgggcacggcgggtcccgaacttccaacctgggcgatccgcggctggccccaaggggggggtccacggtaaaaccggccggggcctaaaaattcgggttgttcacaatccgggtaagggcccaaaaaacaatctggttacaaacacggggcaacaggaggggccgacctccaacggacgcacgccagagggattcgcaagcgcatttgggaaagaaccaggtgcatgacacacgcggg

SEQ ID NO: 723963 - DNA, 459 bp, Homo sapiens
atccctgcgagtgatggtaccagtaatggataaatgagcgaatactttctgagtgtacctttgcaagattaatgttcgtgacattgtctattaatgagaaatgggcataataccattcacgctcgaggtacagctgacataacccaagagtactatgatgttgatgaaacagactgtggggcaggcttgtaagtggcatactgtggtccaggtcagctgaaagaagatctgtccagcatcatcctcctatacagaggaggacctccagatgcttgtagaggctcactgctcagatctggttcaggaactacttcaggagttgtgccaccgttccatcgggtgctgcagagactccatcaggtgcttgaacaaagagacgaagtgcttcattccaagctgttcctgaagctgtacctccaggctttggagaaagagggcagcctcttgtcaaagcaggaa

SEQ ID NO: 723964 - DNA, 134 bp, Homo sapiens
aggatctggtcgcgcacgactgcataactgcgctgccgacgcacggcgcgctgtacgcgtgggagctcgcgcgcgggacgacgtgctgcaggtgcgcgtcgacgggcaggtcacgttcaacggcacgtacgaaa

SEQ ID NO: 723965 - DNA, 632 bp, Homo sapiens
actgcagctaaaagatatactttatttagctctcaagagtctaggatccagtattcagcatgcagttgagaggggacaacctttcaggttagagggtacttatgtcagaaaaaaattttagaaaaagtataattccctaaaactacattaagcaacatttaaaaaaaaaaaaaaaaaagggaaaccgggttaataaggccactcaggctggccttaactggacgtagtagagatgtattaaaagggtccgtgaaagctaagaaaagctaaaggactacaataaaaatacaggaagacagcatattatactaagctggaaaacgattaaatgggcgctacttttaggaaaaataccactttggaaacacaataatttttgttttctttctggggagtgggggtctcaacactcgtggtcacccaaggctgggtgtggcccggggtggtggtcccaggttcacgtgggaacctcgtggctcccagggttcaaggcagattctccgtgggctacagcctcctggaggtacgctggggattacagggacggcggccataatggcgtggtaatttggggattttcaagtaggaactgggttttccctttggctcagcggggtctcaattcctgcctg

SEQ ID NO: 723966 - DNA, 406 bp, Homo sapiens
ctcccccccgtcacgttactcaaaattagccaggtgtggtggcgcacacctgtagtcccaactattcagaaggctgaggtagggaggatggcttgaacccagtgaggttgaggctgcagtgagccatgatcatgccgctgcactccagcctgggtgacagagtgagaccttgtctcaccaaaaaaaaaaaaaaaaaaaattagcaatagggtgggctttgagatagatttggatgattacttccgattccctaaagtttatttggtccctgggttcggcgaaatagttttaggcgcaatcttcttgtggagaaattggttgtccctttctggagtctctccattttcccttcatattctgtcatcgtgggaacctaaagcttgggttaaaattgggaatttgatag

SEQ ID NO: 723967 - DNA, 200 bp, Homo sapiens
ccgtgcccttagcacgacatctcttgtcgctgttcattgttcgtgcgcacctttgccgcatgcatgtacttctctcgcaggctctaacacagtgctgccacatgtgcctcgcggatctccttagtgagctccatcttgtagctgagcttctcctccgcctgtccagtgaaactgttattctgctccagaggcttttgcaa

SEQ ID NO: 723968 - DNA, 86 bp, Homo sapiens
gttaaaaaccctttttttaaaggggggaccctctgcccccccaagggaatgggtttgttttatcccaaaaaaaagtttttccaata

SEQ ID NO: 723969 - DNA, 946 bp, Homo sapiens
atcgctgcgctctcctcttcccccggctggtctcctcgctcgccttctggctctgccatgccctgctctgcacgagacacccgcaccatactcacccagctaagcgggcccggcctgcggaggtgggcggcctgcagcctccgcatatagcccggcatctccgagaaacgccacggacacccacaccccggcgggactcacgcagcgacgaccgacgggcctacagcaccagctcacaagatgccctactgacttaccaccaatacacacctactgcgcagcaacacgcctgcacgtgaccaacccggaccactcccagactacgcggcctcccctacacagcgcagctaccactggcaccgagctgcgcatcccaaccggccccagggcccggaggcccggccaacaaccccctcccacacctcggacctggccccggacccctgggccggctccactagccactcacacgcaccccctcagcccgcgccaacaccgaccgggctggcccgccccccggaccaaagcccacgcccacaacaccacacaaggacccgccaagccccacacccccgccgcgacccgcaacccgccacacacccccacacccccaagcaacgagcactcccgcccctcccgccacccccaccacacccaagccccgcaacccaccagcccacccacgcccccccgaccacacgcgacccacccgcaagcccaccggcccccccccctgcccacccgccccctcaccccacccccacgcccacccacacccccaccccccgcgccacgcccacaaccccaccaccccccaccccccacccaccccaccaccccacccggccacccccgccgcccccccccacaccgccaccacaccgcgacgcccgcccaccacccacccccccacccaacccaccccgcaccccacccgcacgccccc

SEQ ID NO: 723970 - DNA, 877 bp, Homo sapiens
  misc_feature (513)..(513): n is a, c, g, or t
tataaaaaaaaaaatctttctttccctttttctaatttattttgtttttggggagggtgggttcccagggggtaaaaaaaaaccccctcattgacatcaaggggtgggtatgagtgcggaaacgctgtagtggggcggttctgtagaagatgggatattcgtcttggagaaccattttgtacaccgccactaccgcgttttcacaaattatacaacctgctggtgtttaggagaagacgcccccagtgtgagaaggagagggggccaggggagaaggaggacaatttgtagaaaatagacatggagtgagatttggtggtggtcatggggcagtgtgtctacacatactaaaaagtttccccctctccgatcgctctgggggaaagaaagtggagtggctctcttgggacgattagtgccgagcacacacacctgtgtgggaatgtggggggccgctacccaaaatttatagtgacggggggacacttgtgtggccccccacagaggggagtnttccgtgaactcttctgcggggaaattcataatcttagttaatttcctcgcggaccaatagttgtgggaaacttattatttgtgtggccaaccccatataagtgtggagcaatggtggtaatagtcagcgggaatatatgcagagtgtattaaaaacagcgggaggaatgagctaaaaaactcgtaactgttgtggataaataaactaagtgcttggggcgcgtatatgtggggtgggacaaaactttcgtgtttgagaccgcttattgtgaacggttgtaacggtggcgggaatttattctgggaccgatttggtacggggagagtggttttgttaaaacccaaatgggtttgaaacacaagg

SEQ ID NO: 723971 - DNA, 115 bp, Homo sapiens
gacccttctgacacctaacagttagaaactgtgtcaaagaacctcagaaggttggtagtgcgtctgtacctatatgagatgaggtcatttgccttcggctaattatcagaatatt

SEQ ID NO: 723972 - DNA, 767 bp, Homo sapiens
gggccccaagaagtcggaccacagggagagcctgaggaactcggcatgcgcccgtgtacaagcgtgcaccctgcgataatcaggcttcaagggagagagtcttcgcccaggactttaccgccagtgcagttccaattcgcgtgcaagtagcgacccgcaccgccgcataccccgttcggtccacccaccagacttaaaggaagaaagcttactctacggcccctctccacttgtatacgcaagagggaactcataggtgaaaccccctgaccctccgccaacgttaaatgctcgagacggaatcttccacaaggcatgggccaatgcacgcaacctgcaaaagcacttggagggcccaggtgtctctccaccagcccccatgcagtagggactggaagatatgtcatcttgctcggttgtgttatcactccgcacccccgtaccccagcccgtcttccggaatttctcaactaaatttcattattgggcaggaaaggaggtcatgggttcatcttcatttttgttttttcgtgtttttaattaaaagaaaggttacctcagttttcactccttagacatggatgtagctacctttttttgtatgtcttttttttttttaagcaatcgtgttgaattaggagtatacttggtgtggaaagagtatgaatttgccatgtgatttgcaaatggggggaagctactgtgagcgtgtgtttttttaatttacactatagagtgatttttttttcacccaacgtcaagtttta

SEQ ID NO: 723973 - DNA, 1141 bp, Homo sapiens
  misc_feature (213)..(213): n is a, c, g, or t
  misc_feature (218)..(218): n is a, c, g, or t
gcagaggcggcagctgcggccgcggcctccttgcccccatttgcgtgccggcgcctgcgcgcggctgcttctgaccactggcctgctgatgctggctggcccactgtggctggctgcacacctgactgtgaatgcccttcaatgtgccctgctgctgctgagctgctgacttcaactgctgccctgctgcttgctggatgctgtgcacaatgnctgancccactgaaccttgcatgtggccctgtgtgctgctgcactcccatgctgcaatgcctgtgtgcctgctggtggccatgtgctgcatgtggccctgatgactggctggtgctgaatggcacctgcttgcggatgtgctggtgctgatctgcctccttctttgtgcttctgtgaccttgcatgtgctttgctttccttgtgtgccccctgctgtgggtgtgctgtgctgttgcccaaatgcatctgtgtggtgtgctttgcttcccctgatggtgtgctggttggtggatggctgccttgcaccttgctggctgtgcctgcctgatgcccctctggacagacagcccttgtaccaggtgctgacttgctggtgagccttctttgctgtcaggcctgctggcccctggccatgtcactctgtgaggcccactctgggccctggccacctacggcttgcggccactgcggggctctgtacgcggtgctggcctgccttggaggagcaccggctgggtcagccacgggtgcagggcgggggggacaaggaaaggagagagaggacaggacggcccggggaacaagggcaaccaggaagatccggggaaacccccggtctgggatccagagcagagagaagaagatcttcgagaatgatcaaagtagcgagaaaggttgtatccgataagcggaataacatggagtgagaagttgattggtgtaaatttggggaagaaacgcgatccctgtttgatataaattttgggacaagttatatcaggccaggagtggtaacgtaataggggaaacaggatggtattgagacattgatgtggcctttccattgcagacaattggagagggaatgaaaagaggtagagaagctacaaggagcatgaagtatgcatgggaatgagtgtgagcagcg

SEQ ID NO: 723974 - DNA, 132 bp, Homo sapiens
tagagagtctgacttgagtaagttttgggccctggagcatacgtcctgtggacaggacgttggtgcgtgtgagatggccacctgtgacggcataatgctgagatgtatgagatggccagatgtagaggcaag

SEQ ID NO: 723975 - DNA, 150 bp, Homo sapiens
gcggtccgagaattaagagtgtgatctaccatgcattgtctcagaaagggggcgaatgactccgatgtcccagcccttcaggagcacagcgggccgaggccttcgtggagggcctttcctgtaggcgcagcacggccccgtatggacccc

SEQ ID NO: 723976 - DNA, 294 bp, Homo sapiens
ccctttaaaaccccccctttttttccccccctttttttttaaaaaagggggggggggggtttccccccaggccccttttccaaaatttttccccgggtttttgcgggaccccccccccaaaaaccccctttttaaaaggggggtttttttttttttaaagggggccccccccaggccggggcccagtttttttgggttttttttttggccccggcccccggtaaaggccccttaatttttttttggggggggcgggggtttttttttttggggggggggacttttttcccccca

SEQ ID NO: 723977 - DNA, 763 bp, Homo sapiens
ggagagaactagtctcgagttttttatttacatttttactgtgatggggcccaagtttaccaactaaattagcaggaggaccacgctgcccttcttgggggcacaacaatgggtggggatgagcagtttcccctcgtttccaattgaaaaaactagggaaatggtcaggcaatgaagtttcccaaggtgggtgtattagctccattttcagtgcgtgctgataaagacattacccaagacgtgggcaagaaacaagtgtttagtgggacttacagtcccacagtggctggggaggcctcagcaactcagtgggtgggtaggcgaaagacacttcttacatgggtggtggccagagaaaatgaggacagaggcaaaatgggaaattcctgaaaaacctatcagatctcataagacttatacactatcatgagaaatagcacaaggaaaagaccggcccccatgattcaattatctccccgtgggtccttctcacaacacatggaactcctcaggagcttacacatttgcagttgacatggggttggggacacagccaaaccatatctatactgcatactggccctaccaaatctcgatattctacacattttgaaaagcaattcatgcctttcccaaacagtcccccaaagtctacagctcatgtcagataaaccacgaaatcacaagccaaaggtctaatctgaagaacaggcaagtcccttcagtgtatgagcctgtaaaatgtaaaagacagctaggtcta

SEQ ID NO: 723978 - DNA, 862 bp, Homo sapiens
cggagcaggggtgtggattataacggctcccccgtgcgtctagttagtaagagaggcgcgacgcaacagcggggcttgcgcttcggtttaaacccacccctgttacgctacgcggtataaaagcggccagtgggtgcttattgtgtcgaagacaaacacccgcccctctttgttagacagaggagagtataagacacagagagggtatctcgcccctaccaagtgaggggggtgagggacgatcagatataattgctggcgcgcgacgaccgacgccctattgctgctcggatatgagaaaatagtagctcatcctctgtgtggaccgccccagcagcagtgattattgtgtcaataaaaagacgtctgtccccacaacgaacaaacttccgtgcacttgccaggttggtcagaggaaaccaacagagttgtgataccgcccactccacccactgagggagctcactcctggggtgtcaccccacgccccgccagataaccaacagcacagactctctgggggagtgagtcccacatcatcgcgcggcgccgcgacacagcttcacttgtgcggttgcacgccgtgcggtgcgtccaacccacttcacgctgtggaaaaacagaggtgtaaaacccccctcgtgtgttacggtagccctacacagtacgcccacgaaaattacagttgaggcctatgtgcgcggtgagggcaccccacgtagtatactattccccgctgcttgctggggggagctgtatggcaccgcggtagatgagtgttggtgcaccccacggtaacgcggggttagtccccccccccccccccgggggccaggggtgcgggaatccccttccaaaaaac

SEQ ID NO: 723979 - DNA, 865 bp, Homo sapiens
tgtcgatcattggtctgggtctcgtgcccggattgaacatgacgattgtcgtagtagtacgtaccgaatcctggtcgtcactagtgtgagtgtcctgacctgtagaaatacgctgcggcggcaacgcgtccggtacctgatctgtagtgtccatgatgggcgattctgggccgacacattaacctgggatctttgcgtcgatcatggacgtatcagatacggtagttcctctggcactgctccacaatttaactgctccgaggccagtgctaagattgctaagataagttcgagacatttgtacaccgtactattaatggggcgtacaaaatacgagaagcactaatcgtgtgcgattgtcgctaactcgatcgcgtagactgcactagcgatttgacgtgtcgagcgaggcgggagaaattgttttgagcgatagcatataggtgcgatccgtagatccgctgtcgcggaattgtgcatcccttaaagtttgttgatccctaagaagaagagttaggtcacagctaaggcgatcgtttgagcctagagcgctgctactctgacacttactaactgactgatgtaactcgctagaaagtctatgctcaagccaatgcccgtacgaatgtgggaattggtcccccagcgttataacgactccgatcattcgcggatatggcgcctgtttaaattaacagccccataacgaatgatgtaagtggcggtggggcttcagcgtgcacaggaactttaaactacttgaacccttcttttgttcgcagaacgatttaagcataaagcgaagaatcactccggatgcaccatatgggagttggccagttattgaatggggttcatagggctg

SEQ ID NO: 723980 - DNA, 239 bp, Homo sapiens
  misc_feature (1)..(1): n is a, c, g, or t
ntcgggccggttcctgcccatgtggtgaaaccccatctctactaaaatacaaaattagccgggcatggtggcatatgcttgtaatcccagctacccgggaggctgaggcaggagaatcgcttgaacccgggaggtggaggttacagtgcgtcgagattgcgccactgcactccagcctgagtgacagagcgagactccgtcccaaaaaaaaaagagatttttaatgttcataggtgtct

SEQ ID NO: 723981 - DNA, 251 bp, Homo sapiens
aattatagtatatgtagtatacataacaatgcataaaaaaatgctagtgctacggtgtctaagccaattggtagccagtagcccatatgtggtaatttaaatttaaagtaatcaaaagcaaataaatgaaaaatcaattcctcgattgccctatccacatttcatgtcctctacagccacatgtggctagtagctaccctgtgggacaacaaagatacagaacatttccatcatcacagaaaatcttcctg

SEQ ID NO: 723982 - DNA, 1452 bp, Homo sapiens
  misc_feature (1197)..(1197): n is a, c, g, or t
gcttaccgggagactggagtcgaaggccgctgaggtatttgttctacacgccagacgtgtttagcaaagggtagttatctcggaagggcgaggagtaccttatagcaaccccagtgagtgacggtgaatggagcttggagcgtgggtcatcctatgaatggcagcgtcgaagcaaattagtgaagactatccagtagaacatccacgagtcattcgtcccgagttactgtaaatagttcctatcggatgtctgatggcatgaaggatgcatgaaagaaccgatgcatgatcatgtatatctagcaaatgcagttgaattgccaccaagtttgggcatcccacttcgacaattagagaccatgatgatggaatttctggatttatcgtgacatttaccacccatttcaacatgttacccacttagttcttcagtggggtctcaatcttagtgcataacctctgaagtgtaagctttcaatttcccttaaaggcgtaaactattcactaagataaacaaaccaagtgatacttagggtacacatgaagttccacggaggtaagtttgttcattgtatgcccaggaagttcgctcgagccactacttaaacctagcacacttgatgacgacctaaccatgggccttggtgcgctagagaccctttgagacatccaaggaacgcggttgggcacagcatataccaaaacggcagtgtcgtggttgcccccaacactccattatgtcgccccttccttgggggcagtagaagccccaaaacaaaaatttctggcaagaaattataccttggccacgttccatagataaaaggtttatggccccatattttgcgagacaggcgcagcttcccacccgggttccaaccaaaggggttttacagcacctatacaattgcggagttgagcaccagcgaaacaagtttggtccaatcaaatttattttgtcacatacacaacatcggttaacccaatttccgtttccggccaatccagagttccctccacacacccgctgcgcttaaaaaaagtttacactatggctctaggttggagtcacaacgcgaggtctggaccactgtgttctttttcacagcaaagtgcggttggggtcgacctcccttgcgaaaattttcgcacaagctccactcttgtctgcaagaagttaatccctcatgccagagntcatcaagcactcactcgcgctttcaacacgagggccactcatgagacatattgagcctcttttattcacccttcccatcaccaaaaagagggaactttcccatttgtaatcaccctctcatcaaatttcggccatgttcagagaccaaccttgggacagtcacattttctcaaaaccccactctgggtctcggcaactaacactttctcgcaatctagtctaattctctcatctacactctcgttatccgcgac

SEQ ID NO: 723983 - DNA, 284 bp, Homo sapiens
tgctgtgtatcatttactgaagacctggactagtgcccactgcaaacctcaaccacagtgtgggcaagggtggatcatgtggccttccgctcatgaacagttacaacctgaacgatatggcctcagggctgggcagtgagacgcggctggaccgcaggataggagatgcacagagcgacacagtgctgctacactcctcggccacactaatgaccaatgatgataacgaggaatccgaatgcacgcacgtacctgccgactacctgcatgctgacgaggaacgt

SEQ ID NO: 723984 - DNA, 275 bp, Homo sapiens
  misc_feature (102)..(102): n is a, c, g, or t
  misc_feature (118)..(118): n is a, c, g, or t
agaaaaaagggcttcccagggctggctggagacccatggtgagttcggagagaagggagaccccagggattccctgggaatcccaggaaaaagttcgccccntaagcatgggccctanaatgtgtgccatgggccccctggagcccaggccccaaaggtgaatcgggagactacaaggccacccagaaaatcgccttctctgccacaagaaccatcaacgtccccctgcgccgggaccagaccatccgcttcgaccacgtgatcaccaacatgaa

SEQ ID NO: 723985 - DNA, 1279 bp, Homo sapiens
  misc_feature (546)..(546): n is a, c, g, or t
  misc_feature (642)..(642): n is a, c, g, or t
  misc_feature (865)..(865): n is a, c, g, or t
  misc_feature (937)..(937): n is a, c, g, or t
ggcagcggaggttttcctggtttcggaccccagcggtccggactgtgtgaatagtcctctcctgccatggcggatccattcgatagttgagcctacatgtcgttcagccgagtagtagtacatggtacacgggggcatataaccgccagtcgcccacacatctcgactggcctaaggaccagcaccgaatgtcgcagcctcacctaaagtcgcgttgcgaaccagggctcggcgtgtcgagctaggcctacgaccaggtttgcactggacgttttctccgaagaggggcctctttccccactgtggccaacatagcataggtaggctagagccctggtgctccccgggggggtccccctttgccggatgacattggagggcttcgggaccttaaccccggtgtggccattttggagaccccaactccttgcgccaaaacttcgcccaaacagacgacctctttgggaacaatggggcaattgcccctcagagatgacttggagcgagcccggacgaagatgctgggcgaaaattacaggggttccngaatggcaaagcgtggggagaagtttctatatcccgaaaaaagtgtgttcccccttttgaggtatgcattgcccccaacaaagggggggcacaccntttttttcgacgacgtagaacagcgcgcggccgctatatgtccttgtgtgaaaacgcattcttgtgtaccgcccgattttaacagccccgttttatcccggcccgtggccacaaacggcttctgggtgcccccaaacttgttccgccccgggcatcggctcccccccatcttcggcgccgaaaccacacttcttttggactctctccgagaagaagcgcccgncacagggcgccacacggcacggcagcacaaccgttacaccagttttttgactacggagacgcgctcgggtanctattatccccacgcactaggacaagagacacccccgcggggagtgaaaaagtcgcgcgtgcaataacgacaatcgcgtgtcgaaaaaaacacccctctgcggggcgcaaaaatcgcggcaccgggcctcgaaaaacattatttcaaacagccgcggaattttatcgccgcgacaaacaaagcaagcagtaccccccccgaggggcgtacatttttttctcccacgccccacttatatcaagcggccgaggacacagaggtagtattattaccagagcgagacgccgccccaggcaatatctgacgcagaagcaggggggattatcacgcagcgcgcttttt

SEQ ID NO: 723986 - DNA, 168 bp, Homo sapiens
  misc_feature (26)..(26): n is a, c, g, or t
gacgtgcacttggtgctgcgcccagngaggaagccgtaccaccagtcagcgcaggccctggtgaaaagccttcccgctgcctttgggaggcgtgctgccttgaaaaggagcaaggagcactgaaggtctggtggcattctgtaggcctggagttgaatgggggaatgc

SEQ ID NO: 723987 - DNA, 639 bp, Homo sapiens
cttgttcttttctaaccccaactcttttaccagatcaaaccaacctcccaaccccaccctcactccacaaccaccaccacccatccccctaaaccacctcacccactcctatatccacccccccccccacaccacacctccaccaacaccatcccccaacaccccaccctacaacactccaaccccccctcctcaaaccacacacaacaaatactcccaatcacccccctattccacccccctccacccccacacacacacacaaatcaacacctccccaacctctcccctcacctacccccaccacacaaccacaacctcactatacttccccacccccaactccccacatccctccaaccatactcaccaccacccacctcacccaaccctcctatcccccctcccaccaccaccccactacacccgcctcaccctctctccctcccccaaaccaacgcctactcctcacacctccacccaccaacacccaacaccaccccctcaaaaaacaaaacccccaccccaacatccccacttacacccaacatacacgcacccaccaacaccatcctcctataccaaacaaacacaacaaacaccccaccaccaccaccaaccccatatacaaacgaaccc

SEQ ID NO: 723988 - DNA, 313 bp, Homo sapiens
  misc_feature (222)..(222): n is a, c, g, or t
  misc_feature (303)..(303): n is a, c, g, or t
gtattcttctgctcctttaaataatatccccttactcatctgttcttcttttctttcccttctacttcaaggtctttattttcttattatctttctgatatatttatttacagaagtagagaagtataatctaaattcatgtttgtagcacttacagcatcatatacgtacaaattatttggtctttatagctactaccaggaaaacatctgcagacagaanaatttttcactccctatggactaggtttctcacctgtaataacagaaaatttctctaatgtccaaaccaaattccttcttngaagaacact

SEQ ID NO: 723989 - DNA, 395 bp, Homo sapiens
aaaaaaaaaaaaaaaaccccccccttaaatagccccctggggggcccatagagcggatgctttcatgcccccttttttgccctttttggcccggagctcctttgagtttggggtttctaggatcaggggccgtctttggcttacccaaaaattttaatctcttttaattctcccccgctttaaaaaaaagtttttggggggtgggatctttatttattccctagtttgcagacctgtttgaataaaggaaccaaggattttttcaatgtttctgccctgaaaaacgggtttgttttagtggggtagattttttacccaaatattccccagtttttgttgcccctgttgtttgggcctggctcctaaattttttgtaataaaaagcctttgtctta

SEQ ID NO: 723990 - DNA, 210 bp, Homo sapiens
tgcttctgcccactttcaggagaaccatgatgtgcgccccagaaaaccttttttttttaaaagggaggtggggttagaagtaaaaggttgatcatgggagggagttgaggggttaatatatctacatacatacacatttttgtttttttttaaataaacaggaaatgattttatgcctccatcccacccatgagggttgcaggctttcca

SEQ ID NO: 723991 - DNA, 446 bp, Homo sapiens
  misc_feature (28)..(28): n is a, c, g, or t
  misc_feature (84)..(84): n is a, c, g, or t
  misc_feature (103)..(103): n is a, c, g, or t
  misc_feature (408)..(408): n is a, c, g, or t
  misc_feature (430)..(430): n is a, c, g, or t
gatttcttgacctcgtgatccacctgcnttggcctcccaaagtgctgggattacaggcgtgagcactgtgcccggccatatgtntttaataacccagtttgtntcttcttgccttcaggacatcaaacggtcatgctactggaagctcggaccatggccccttctgctgggcacccttagataggcctctgagggagatctgattgccattttcccgaaacagtgccccctatcagcaggaagcagttaagatctgtctttgtccctattcttatcctagtggcagttagatagacttctttagagcgaggaatgagccagatgggaagggttccctggtaaaactccaactggcctgtgcactgctctggggtggagccacagaagtttcgttcctcagttttgcanctgggaggagcctgggccttcnttttctcggggaggaa

SEQ ID NO: 723992 - DNA, 220 bp, Homo sapiens
tcggtaccggcgcacgccagtgtcgtgcagaagcgcgcgatgcagcaggtgtcgacgtcagcgtggccaaggtgcgcctgttgtcgcagatgctcgatgccaacaaccagatgatggtggtgcgccgcgagatgctgatccgccaaggtgacgaccgcagcagcgacgagaagcgcattgccgatctggtcaagcgctacgaggccagctggtccgccta

SEQ ID NO: 723993 - DNA, 533 bp, Homo sapiens
gtgccagcaggttactgaagtgtcaagatcttcacaaactttctgatatattgatcctccaaattctgtcccagtcattgccatgagtgtgtagctggaattccccagtcctgtagcccagtgcaaagttataccttgtcaggttagatttggcactgtcaaaggtcatctggtgtgcagcacgccaggcctcataaccaaagacaggtgaaccatggcttgcaggtccagcaaaatcaaagtcaagatcacaaccaaggttaatacactccctcttgtacgaggacttgatttgaccactttactttcctgtgttgggtgagaaggtagtatcaaatgtcagtgtcaaaccttgacaaatctggtctgcaattgcgatgtctgtacccagagtgtaatcagtgtaccagtttactgtgaaagtcagaccatactcaaaccacttgtattgggtctccacggtcccagtacctttaccagtgtcggtattagatgaaccggacgttgaaaattccacgccactgcagactatt

SEQ ID NO: 723994 - DNA, 657 bp, Homo sapiens
  misc_feature (386)..(386): n is a, c, g, or t
gtcccgtgcgggcctccgtcctcgggcgagcagggcccttcgctccgggaggggaggtgacgcggcgcgggctggacggccggagacgcggggtcagggcgcggacgaggggagcgcagggtcggaggggctcccggacgctgcccgcccagcgtcggctctcgttggcccctggctgcgcgcagcgggcccgactctcagggccctgcggtgcccgctgccagcgtgagggctccggtcacgcggcgcgcgagacgaacgagcgagatgcttcccgaagcgcggggcccagtgcaggggctcagccggggctcctcccaaagctcacctggagcccagcacgactgcgttctggaaacgctgtgtttgacagcaggggcaggatngggggctgtgtagacgctggccacgtggcaattgtaggagaaccatgggatcgataaatgttcactgttgtccctgaagcgcaaaactgcagggctctggaaagtccgtgtgtgtgtttttgttgttgtttttgtttgttcgagactccatctcaaaaaaaaaagaatcagtaaaagatataaaggagaaaaggacagaaccacaaataggcaacaaatatgttaaaaaaaagtttagcttcacttaaaatgaaataaatgtgattaaaat

SEQ ID NO: 723995 - DNA, 946 bp, Homo sapiens
cgaggagggaagaacaggacctgtgggtgcagaggcccggcactgtagagaacccagatagacagccgtgtggtggaacttggtcaaactccacgccccgcctgggagtgtttgtcaggttgctgtgtgatgtaaggataggaggtgcccagtgctccgcatcaatggaatgtgcttggatctttggccccacctacagagagggctcagtgtgacttgtgacctggtgggcatttgttgttgctctgtgtgcctgaccctgggacctggtggccagacagcttgtgtctcttgtctgggagattatgctgtccccaaggagcctgtaacacatgttgtggcttgttgtggtatggttggcttggctttatccttctatggacttcactctctcacttgccccaaccttgcaatagctgcacacaacaacaccttgaatcctgcaccctctgtgagggtgcatctgtatcttccctgttgcaacaaattgcaccatgtaccaggatggacaaacacccgtcaaggacattatgttgcacctaaggtattccctttctcacgcgaggagtgagacctgtcactattgatgtttgacctctgaacgttgtgatggcccgagccggcatgcgtgagacccctttcaggacatacccttgctgtgatggacctttgatgtccgcgtatatactgatcaacagtaggactgcagagtggggtcctgagtgcagaaaacacgtgttctgacattcagaactttaatttaccacaagtatcttacggggttttgttagtggatacactcaaaatccggacggttgtaagatattgaagaagggacagatccagggtttattcgaaatggttgaatgggtagattatgaagtttggtatatgagttttaattaaaattatttgttggtggaacagaacagagacagaatgagtg

SEQ ID NO: 723996 - DNA, 209 bp, Homo sapiens
gataatgaaagactcagagtatgtagggatggggaggactaatcccaagtcttataactccaatacctgtgtagtcccatagtatcttaattaaaggaagccaggattctgggcaggaggaggatgagagaaccagcgagacagtcatcaaaagctgcctgacaccatttgtcactgatcaggggtcagatgtctgactcagctctctg

SEQ ID NO: 723997 - DNA, 482 bp, Homo sapiens
ggagggtggccgggagttactgttatccttgtccttgttggacacttgctgatactgggagttgcctgggcggcctgatcgactcaggttacctttcagagtgaggaggacccccagtaagatagaggactttttggttttacggggaattttttaggccaaaatatttcaaaccaaatccatattagccttagaacacgtaaacattatagagaaggttatgatagtagaatagcaaaagcaaggccagacattaataccttgagtgaaggtatataaagaggctatacaggggttagaattgggggacattgattaaaaggcatacccaaaaccagaaagaaacagaagagaagggcatagaagagataaacccttgggaactagacattagcaagaagtacaaataataccagaaagaattggaaacaaattggagtaacccgaagcttccaaaatttacaggtaaattcaaaaggtcc

SEQ ID NO: 723998 - DNA, 850 bp, Homo sapiens
  misc_feature (12)..(12): n is a, c, g, or t
  misc_feature (33)..(33): n is a, c, g, or t
  misc_feature (44)..(44): n is a, c, g, or t
  misc_feature (56)..(56): n is a, c, g, or t
  misc_feature (60)..(60): n is a, c, g, or t
  misc_feature (65)..(66): n is a, c, g, or t
  misc_feature (72)..(72): n is a, c, g, or t
  misc_feature (76)..(76): n is a, c, g, or t
  misc_feature (89)..(89): n is a, c, g, or t
  misc_feature (97)..(97): n is a, c, g, or t
  misc_feature (129)..(130): n is a, c, g, or t
  misc_feature (133)..(133): n is a, c, g, or t
  misc_feature (142)..(142): n is a, c, g, or t
  misc_feature (158)..(158): n is a, c, g, or t
  misc_feature (165)..(165): n is a, c, g, or t
  misc_feature (185)..(185): n is a, c, g, or t
  misc_feature (193)..(193): n is a, c, g, or t
  misc_feature (195)..(196): n is a, c, g, or t
  misc_feature (209)..(210): n is a, c, g, or t
  misc_feature (214)..(214): n is a, c, g, or t
  misc_feature (221)..(221): n is a, c, g, or t
  misc_feature (237)..(237): n is a, c, g, or t
  misc_feature (260)..(260): n is a, c, g, or t
  misc_feature (267)..(267): n is a, c, g, or t
  misc_feature (279)..(279): n is a, c, g, or t
  misc_feature (307)..(307): n is a, c, g, or t
  misc_feature (316)..(316): n is a, c, g, or t
  misc_feature (329)..(329): n is a, c, g, or t
  misc_feature (332)..(332): n is a, c, g, or t
  misc_feature (334)..(334): n is a, c, g, or t
  misc_feature (356)..(356): n is a, c, g, or t
  misc_feature (361)..(361): n is a, c, g, or t
  misc_feature (374)..(374): n is a, c, g, or t
  misc_feature (379)..(379): n is a, c, g, or t
  misc_feature (387)..(387): n is a, c, g, or t
  misc_feature (401)..(401): n is a, c, g, or t
  misc_feature (443)..(443): n is a, c, g, or t
  misc_feature (445)..(445): n is a, c, g, or t
  misc_feature (455)..(455): n is a, c, g, or t
  misc_feature (459)..(459): n is a, c, g, or t
  misc_feature (461)..(461): n is a, c, g, or t
  misc_feature (500)..(500): n is a, c, g, or t
  misc_feature (562)..(562): n is a, c, g, or t
  misc_feature (595)..(595): n is a, c, g, or t
  misc_feature (603)..(603): n is a, c, g, or t
  misc_feature (612)..(612): n is a, c, g, or t
  misc_feature (684)..(684): n is a, c, g, or t
  misc_feature (696)..(696): n is a, c, g, or t
  misc_feature (706)..(706): n is a, c, g, or t
  misc_feature (730)..(730): n is a, c, g, or t
  misc_feature (753)..(753): n is a, c, g, or t
  misc_feature (824)..(824): n is a, c, g, or t
tctcatttaacntttttaaagggtctcaaaaanctgtgacaaanttttggtcaagnagantccannaaaaantacngattttaaaaacnaaaaactnaaaactgccacacgcaaaaaagaaaaccaaannggnccacaaaanattcccctttccttcngaagggnttacgaagcattgttatcantaaccagncnnttactactaaacnnaaanggccaantgaaacaaacagttcngagcccgttcttccaccactgantaagagngggggggcaggnataagggaaaaaattcagttagccttcngagctttcngggcagacttggngancntgccagccccagcagccttctngtccnccgccttgaaganacccnccgcaacngtctgtctcaaatnacgaacagcaaagcgacccaaagggggatagtctgagaagcncncaacacacangggngngccagggaccaaatcaacaatggcagccccaccagactncaagaatttagggccatcttccagctttttaccagaacggcgatcaatcttttccttcagcncagcaaacttgcatgcaatgtgagccgtgtggnaatccaanacaggggcntagccggcgcttatttggcctggatggttcaggataatcacctgagcagttaagccagccgcttccattggngggtcatttttnctgtaaccancaacgttgccacgacgaacatccntgacagacacattcttgacattnaagcccacattgtccccaggaagagctttactcaaagcttcatggtgcatttcgacagaatttacttccgntgtaacgttgactggagcaaaggtga

SEQ ID NO: 723999 - DNA, 210 bp, Homo sapiens
  misc_feature (73)..(73): n is a, c, g, or t
  misc_feature (128)..(128): n is a, c, g, or t
gtcagggccatgctctcccagctccactgggatcatgtcaatacccagatgctcgcagatggcaaaatgccgntcgtaaccgggaacgggggcgatgaacttgacgttctggccggaccagggtttcngtccggcaataccgtgaacgaaagcgaacatcaccagatcatgcatgatcgacaaactggaattgtcggcagcaatgatgtg

SEQ ID NO: 724000 - DNA, 864 bp, Homo sapiens
  misc_feature (18)..(18): n is a, c, g, or t
  misc_feature (507)..(507): n is a, c, g, or t
ggcacgatcctgtctttnctgaagcggatcccccggtcaacacagctgcagttaacttggtcccgggtgacccccgatggattggagcctggtggctaggcctgctcatttcttcagctttattggttctcacctctttccccttttttttcttccctcgagcaatgcccataggagcaaagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattggtgctgtgaacctccctgctgcagccttggggatgctgtttggaggaatcctcatgaagcgctttgttttctctctacaanccattccccgcatagctaccaccatcatcaccatctccatgatcctttgtgttcctttgttcttcatgggatgctccaccccaactgtggccgaagtctaccccctctagagccatcaagttctatacatccgcagtctcctgcctgccgcagggactgctcgtgcctagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcacaaagacaggatcgtgccctgtcccctgggcccacttt

SEQ ID NO: 724001 - DNA, 1279 bp, Homo sapiens
  misc_feature (1068)..(1068): n is a, c, g, or t
catccaagcagtagcacagatgacgtccggttgttcgccttcgtgctgcttcaccaccgtgggatgccatgagcaatgaggtccaaggtttgccctcatcacgtgtgatcggttgcaggaacgtcagcgaggctggctgccgcgccttaaccggcgcacgagaccaagagccctggctggaaggaggatcgtaccaggacattatcgcctaagggcagttctgtgagttcagttgatcgggaaagggtagcgtggtatggccaagaatttgcatctgagtagcggagtctgtagacgtagaaggcggggtggcacgcccaagtatgagcgtatgtccctgaccacgtgtgagctaagcgccaagaggctcctcgttgcattaccaaacccctttttcccgaagggttccattggtggtcgcttggcgtgcacgcgcgtgtcgttgtcacgcaagtgggaatcgcgtgcaccgtgccgctgtcgtgcacttcaacgtggagtacgcacgatttgcagaggctcccctaaccctgaggggttgagcgaccaccagggagtaaaaaggtccacccaacttgtggcataaccgtataaagggcgggcccaaatatgtaacggggtttcccccccgggtaagcccggaaaaaacccccaccggtttacatgttggtggtttcccatctaaagcacaaagtgttccgcccccacactctgccgaaagaaggctatttttcggcctcggggcgatgttgcgggcccttttgacgaagtagaacagttccgtgaaccacggccggaagtcgcgttaacctcccttgctatttgtagaaccgttcattcctaatcggggttgaagaacaccctaccttggtacctgtttgtggacgaatccctataggccttgaattgttgaccttatcctattgaatccccgcgcggcgcgtagctgtaacgttgaggaagggacgtattgcctaaagggagttgaaaaaaacgagactttccacatttgctctttggactttggcctgggtaggggggaatgtcccctttgaaccgcttggtggnctcatatgtccaagttgtagtgttccccgcaatgtagaatgtgaacccacgtgtccccccctttgttggacatgcgttggaaagcgcccacacgtgttttggtacagcccttggtgtggcatgtttgttcaccattccgttatacacaggacaggtcgggacaacacattaacgcgggtgtccgtttgccaccccctttataggttggacc

SEQ ID NO: 724002 - DNA, 112 bp, Homo sapiens
cgtgggggttatgccaattctgctccatggacatccggaaggacaggcagttgttgatgttggcaataacattggccctgtaattcgtcagctgcttgcatctctccagaaa

SEQ ID NO: 724003 - DNA, 640 bp, Homo sapiens
  misc_feature (85)..(85): n is a, c, g, or t
  misc_feature (87)..(87): n is a, c, g, or t
  misc_feature (283)..(283): n is a, c, g, or t
atcctgtctcaagatatttctctagatgtgcctggcaagcagtaaatgctcaattaatgtcagctacttcgattacaatttaacntnccaaatgttccttcctgaagccatgcttccttctcagtgatccagctcagtgtttgtagcccacatgcagtcccaggcctgtgcacctggatcacctccttctttccacttataggtgctgtgaacctccctgctgcagccttggggatgctgtttggaggaatcctcatgaagcgctttgttttctctctacaanccattccccgcatagctaccaccatcatcaccatctccatgatcctttgtgttcctttgttcttcatgggatgctccaccccaactgtggccgaagtctaccccctctagagccatcaagttctatacatccgcagtctcctgcctgccgcagggactgctcgtgcctagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcacaaagacaggatcgtgccctgtcccctgggcccacttt

SEQ ID NO: 724004 - DNA, 688 bp, Homo sapiens
  misc_feature (161)..(161): n is a, c, g, or t
  misc_feature (239)..(239): n is a, c, g, or t
  misc_feature (272)..(272): n is a, c, g, or t
  misc_feature (298)..(298): n is a, c, g, or t
  misc_feature (364)..(364): n is a, c, g, or t
  misc_feature (376)..(376): n is a, c, g, or t
  misc_feature (378)..(378): n is a, c, g, or t
  misc_feature (383)..(383): n is a, c, g, or t
  misc_feature (412)..(412): n is a, c, g, or t
  misc_feature (428)..(429): n is a, c, g, or t
  misc_feature (439)..(439): n is a, c, g, or t
  misc_feature (445)..(445): n is a, c, g, or t
  misc_feature (448)..(448): n is a, c, g, or t
  misc_feature (460)..(461): n is a, c, g, or t
  misc_feature (464)..(464): n is a, c, g, or t
  misc_feature (469)..(469): n is a, c, g, or t
  misc_feature (478)..(478): n is a, c, g, or t
  misc_feature (492)..(492): n is a, c, g, or t
  misc_feature (494)..(494): n is a, c, g, or t
  misc_feature (507)..(507): n is a, c, g, or t
  misc_feature (515)..(515): n is a, c, g, or t
  misc_feature (609)..(609): n is a, c, g, or t
ctggaaaccagataatcacacaaaaatcacatttatttcaagagctcaaagtgcaaatacagcaagtcagttcacaaagtttcaagatacagtttttaatgacaatggaaatttgatatacaaaaatggaagggtaaatagaaataaagctcctcaatttnttaaaaaaattcaagtaatttgaaaagcctttagactaaaatactccacttacatccattcagaaatgccagtactgncactgcaatcaagaagggctcttcaaagagagnatcagctcaaactggtcagctctagnttagatggagttcttggtgccggctttctgattggagctcagtcactcactgctatcaattgatgngttcaatccagntntttgntctttaggtggattctaaaacagtttaangttaggccgggcgcannggcttccgtnatcccngcncttggggggccnnggngggcngatcattgnggtccgacgtttgngncccgcctggcccncatcgtgncccccctctctccccccctccccccttagctgggcgtggtggcgggtgcctgtaatcccagctacttgggaggctgaggcagaagaattgcttnaactgggaggcagaggttgcagtgagctgagactgtgccaccacactccagccaaggagacagagtgtggctttgtctc

SEQ ID NO: 724005 - DNA, 952 bp, Homo sapiens
  misc_feature (595)..(595): n is a, c, g, or t
taagctcggtacagacttctgtcaccaggtatcgtgggaggcattggcatagatgtgttctgattgtcggccaaaacaccaggctcacggaaatgcaggtgctgtttgcttcaggagagcattctctggatgccctcccatgcacacacgcctggagggggctcacctccacccagccctgagcttctgaggccagagactcaagggctcagggaagggtggctacagtgagcctgggccgtgaacactcaccccttttattgccttcagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattggtgctgtgaacctccctgctgcagccttggggatgctgtttggaggaatcctcatgaagcgctttgttttctctctacaanccattccccgcatagctaccaccatcatcaccatctccatgatcctttgtgttcctttgttcttcatgggatgctccaccccaactgtggccgaagtctaccccctctagagccatcaagttctatacatccgcagtctcctgcctgccgcagggactgctcgtgcctagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcacaaagacaggatcgtgccctgtcccctgggcccacttt

SEQ ID NO: 724006 - DNA, 121 bp, Homo sapiens
aacatcagtaattggacaatttacaatttaacaacatgatcctatcaataacaagcacatttggtaggggataaagacacattcagccatgcaatccaggtgtcaataccgttaaggataa

SEQ ID NO: 724007 - DNA, 255 bp, Homo sapiens
attatccccgtaacgccaatcgatccctgtattattgtagagacggggtttcaccacgttgcctaggctggtcttgaatgcctaggctcaagcgatccgcctgccttggcctctaaaagtgctgggattacaggcgcctgccaccatacccatctaatttttgtatttttagtagagacagagtttcaccatgttggccagcctggtctggaactcctgacctcaggtaatccacctaagttgggcgtacgggga

SEQ ID NO: 724008 - DNA, 200 bp, Homo sapiens
acgcgaaaactattgatctctcttccaaagtgaagaaaatagcagttcatagccgggtgtggtggctcactgcctctaatgccagcactttgagagactgaggcgggcagatcactatgaggccaggagttcatgaccatgcctatcccaatcatggatgaacgctctgtctctattttataaaacaaacaacactagac

SEQ ID NO: 724009 - DNA, 1158 bp, Homo sapiens
ggacagcatgaggctccctcgaaccgccccctggaatgagttgctaaccccccagggtcccgatgcccgtgaacgagcgatgtgaccaggagcgcttcccctgtccctgcccagccaatgcgcccctacagcgcatccgcatccacgtccactcccaacgatccatatggtcagcaccacggaccccatggactccaacctcatccagctcactggccagagtttcagcactgatgctgccggtagtagaggaggtagtgactggaaccccccgagcgggagcccagcccagacagcgtgtactcgcggaggaagtccccacatccgaagtcaccagacagagacagcgccacgccgcacctcctcgcccccaccgccaagaagaaacgcgacgaaccatgaggtaccagggacctcaggctatccctgcgccacacgataccaccacagtgagcgtgcacgcttcgctgacaccagcgctccgcgaccagcgcgcctcgctcacgacacacggcgatacccgaacgagcacgctggcatagagacagactgatggcacaggcaagcggtggacctacccaccggccgcacccccacaccccacgacgcctgaaaccgcggcccacgcgcccaccaccccacgcaaccgcagccatgccaacggaagccacacacgagaacgcaccgccgacccacctccacaccccacatcggcacagctaacacagggagctcccacatgcaccccgcgccccgcgcaatcggacacaaccaactacaacaccaacgagaccacccatccaacacgcccacaccaacaccccatcccgacaccacagccaacccactgcccaactgcagtagcgcaccccgaacccaccaaacaggccgcatcacgcaccacaatgcaaacacccagcgccatcacaataccagacacgaaacccacacccacgcgaccagccacgctggccccaccactaggccaaccacctgccgccaaccacaacacactacacaacgcgcagcaagaaaacaccacacacataccacacaccgcaagaaatctaccacaggcgaccacacgaccaaacgccatccatgcacacaccactccgacacgccgacaccacacacaggcgacgcaacgacacaccc

SEQ ID NO: 724010 - DNA, 106 bp, Homo sapiens
cccggcccaaccccgccccccccccgttgccttcgccatggggggtttttttaaggacacccgtgccccaaagccacctggggccccattaaaggtgggggggggg

SEQ ID NO: 724011 - DNA, 274 bp, Homo sapiens
  misc_feature (79)..(79): n is a, c, g, or t
cagctgctgttcgtatctttgcttcctccgcagcagcctgtagggcactctcccttattcttggtcccatacttcttgnggtagtatgtgagctcctgttgaatcttctgctccacactttcctgtttcttgatcattatcttctctgtctccttcagtttctgtattgcttcttcaggggttggcccttactccttcttccccttcccgcaatgagcctgccgtgaccactcatcgcgagctcgcctcttctccctgtacgtgtcgcagatgt

SEQ ID NO: 724012 - DNA, 440 bp, Homo sapiens
  misc_feature (407)..(407): n is a, c, g, or t
cggccgtacagttgcgtcacgtgaaacaacctgtagttccctcttattggcatttcattttctggttctgggttggtcacttaagaacacggctccactccattcaaggggtcaaggaaaataagctcattctgtcctttctatggctgctgcaaaccctagttctgtgggcagctggcagggaacagggagctggaattcctagccttaagaactggcttctggcttgaccccttgggttaactccgaaggaaccaacttcctgccattctggaagttgctgttaaggtaaggtggctggagccaaagggcagggtgggcctggcttgggaagcaggaggggaagccggcagaacgctacagtggggactcaccggaggcgaaccaggacgtccagcagctgcagnccgataaactcgttccgcaactggtacggcggg

SEQ ID NO: 724013 - DNA, 130 bp, Homo sapiens
caggtaggtcacacacgcctgtagctcaaatgatcctcctgccttggcctcccaatagtgctggaattacaggcatgagccaccacacccacacaagactatcatttataattgaccaagagcctagtat

SEQ ID NO: 724014 - DNA, 188 bp, Homo sapiens
cttggaaagaaagagacacagagacaaagtacagagaaagaaaaatgggcccaggggaccggcgttcagcatatggaggacccatgccagcactggcctctgagttcccattagtatttatatgatcattatcgtggcatttcccggagatggggatgtggcaggacaagtaggataataagtggaga

SEQ ID NO: 724015 - DNA, 291 bp, Homo sapiens
  misc_feature (9)..(9): n is a, c, g, or t
  misc_feature (17)..(17): n is a, c, g, or t
  misc_feature (66)..(67): n is a, c, g, or t
  misc_feature (75)..(75): n is a, c, g, or t
  misc_feature (142)..(142): n is a, c, g, or t
  misc_feature (159)..(159): n is a, c, g, or t
  misc_feature (273)..(273): n is a, c, g, or t
ggtagatantgtatganagtatattcagtgtcttacacttagtgtgtctaaatatgactagtgttnnccactgtnaatgatctgtatttggtttgcgaatttcaaacaaagaataaagaacatgaaattagactatatattnctgtatttcccctgagntttttctaatctggtcccttcatacttttccccaaaggttcagcgtcttccatttctttcaagctcaaatctttcactggatgttttgaggggtaatgatgagactattggatntgaggggaaaagaacctg

SEQ ID NO: 724016 - DNA, 99 bp, Homo sapiens
ggcagtttttgcttttattggtcaagaattctttacaaaacccacacacacacatccacacacacacacacatgatgcctgcccttctgtcgtcttctc

SEQ ID NO: 724017 - DNA, 164 bp, Homo sapiens
gagactgcgccactgcactccagcctggcgacagagcgagactccgtcctcagaacgaacaaagaaacaaacaaaccagatgactgggagactgaaggagggaaaaaggatggaagaaaaccgtagggaaaggatggggcctcacagactcagctgtgtctctt

SEQ ID NO: 724018 - DNA, 208 bp, Homo sapiens
gcgcgtgagttgtctagtccacgctcggagccatgccgtccaagggcccgctgcagtctgtccaggtcttcggacgcaagaagacagcaccacttttggccgcactgcaaacgcggcaattggtctcatcaaggtgaccggccgcccccttggagatgattaacccgcgcacgctacaagtccaagctgctggagcaagttcttgctt

SEQ ID NO: 724019 - DNA, 269 bp, Homo sapiens
tataggcgctagtgtagtcattatagagacggagagtagaataggggctgcgtggtgtgggaaggtgggagtggggattaggtgtttaatggggacagagtttccgtttgggaagatgaaagagttctggagatggatggcagggatggttgcacgacactgtgaatgtccgtaatgccactgaaccatacatttaaaaatgattaagatggtatattttatgttggtttggccacaatttaaaaaaaatcagttgtctaaaaaaaccc

SEQ ID NO: 724020 - DNA, 188 bp, Homo sapiens
tctcttactctcatctgcgcttttatactatatgtgtaggcattcataaacaacatgtattcataaatgtgtttcacgtttctgaacctgacatactgtataaattgtatttttttcagaatgatttacttgctttcatgatttcgattatgtattttaacttacatgtggttttcaattatatgatt

SEQ ID NO: 724021 - DNA, 292 bp, Homo sapiens
acgcgagttaaagcagctgagattagtggcggtacagccaagagcgatgaaagctgcatggcccgtggagaaaaagctgaagcagtgcacttgatggatcttcatgcccgtggtgttctgcccggactggatccccatctctgtgacttccgtggagactcacttcctagatgagagaagtgaatgcttatcaatgaagatgggtgaccactctgaccaagcctccacagtgctggtgtggcccgtgaggctgtggctgggtcgagtatctcgttcgaagaggctcacgtct

SEQ ID NO: 724022 - DNA, 138 bp, Homo sapiens
acagggccagtttcttgtgcactaaaggcgtttttttccccccgtgatggagtcttgctctttggcccaggcttgagtgcagtggtgccatattagctcactgcactccagcctcaatgacaatgaaactctgtctca

SEQ ID NO: 724023 - DNA, 604 bp, Homo sapiens
gagtataaatttgatcacgtccttggtgtctattgcccacttgagaaaggttttgccaggttccacagatcgcttcaagatgctttcgtttatgataggaaattaatatttaaataagactaattgaaaactagattatctggttctaatttcttcctcctgtgaaatgttcttttggtttgtatttctttaggtattttccaagttactgctgcttttacttcacgacctccaaccccacttttgttatcagcgtcatatgccagagtcatggcagatccagcctggacaacatagtgagacccatctctatcaaatatacatatatatatatatatatacacacacacacacacacacacaaatatacatatatatcaaatatatatgtatatttgatagagatgatagcaattatgtgtgtgtgtgtgtgtgtgtgtgtgtgtgtgttagccaagtgtggtttctcatgcctgtagtcccagctactttggaggctgaagtgtaagagttgcttgagcccatgagttagaggctgctgtgagctatgatcatgccactgcactccagcctgggcaacagagcaaaaccccatctctaaata

SEQ ID NO: 724024 - DNA, 306 bp, Homo sapiens
gtaaggaagggtccccaggttgtggagaccaagttgagaacaataatgaacaattattgtatgaacaattgttagagacagctaatcacaaacaacctgcgggcacaaatgacctcattccacacgtagcacccttcagcaggaccctataaaaccttcctccagcccttgcctctttgcaggtagccccttctctgctgagctgcccactgcaacatattttcacaatttctctaataaatctgcccttctttacctacaactatcttggtaaatggctttaccacctacaaaactgaccctagg

SEQ ID NO: 724025 - DNA, 175 bp, Homo sapiens
acccactactggctgcgcatgagccggctattcaaggtgtcctggacactggcaaggagctgtccgatgacaacaccatcgggaaagaggagatccagcatatgctgtcgcaatttgtggagcactgcaaacagctgacataacttgcaaatgcccgggggccttatgacagaac

SEQ ID NO: 724026 - DNA, 1393 bp, Homo sapiens
  misc_feature (429)..(429): n is a, c, g, or t
  misc_feature (551)..(551): n is a, c, g, or t
gcagtggtccaaaggaccagctccttggagaggggatgccctgtgtggtcgagtaacgcccacgtgaggatccacatccggtcttatgcaggaatcgtggtcaggatcttcgggcatcctatgggtgccggtccaatgatccctcctcctcgacgaggtgctctgccttgcgagatgttgtgctgcgtgggattagccaggcaacctcatggcgacggtaggaactgagtaggatgcaacgtaggttgctgcgtgttaggaccgtaggtgtggtggcgtcgcaagcgaggactaatcgtcctcggccgatgcgtacgtatagtattctacctagagggtccctggtgcctagcctggtgtctcgtggtggacacaggcatgtgtgtgagcagacattggaatggagttctacgagcgattgtcttgtgnccgaagactgcgtagcggctgtcaattaaccgtgcatggctcatgtgctctatgtgcagagctgtgacatgtcgtggtccatagtggtctaaagtcaccaatttatgcgtggcatgtgaagngattgaggcatgttagcgcgcgtacaaattcgtagggggacatacaattgtgcgtggaggaccccttgatagaacgataaacgctatggggttggctcgtgtcttggaaatgaacgctaagtactgcaatgtgggacccgaagaatggaagaacttgctttggaggagaacgcgtttctggtaaattgagattggtaaacaatgacgtgaaagtctatcagcacggggactttgcgagacaagtttgcttacctagagtgggaaggcttctttacgggggataggtctcgctttgtagttcagaaatcattttgggagtacgttgaagacgagttggcgattgagggaagcattgatgcaccaattcaaccgtcggtaacgaaaattattgttgcgccacacgagagggcccgaatttcgtgcacttggccccccctataggtgaaattgtgtcctacttagttgcgcgaacaacagagggtgtgatctctttcccacctttgaagcctttagttcgaaaacgcatatgggggcaccgacggaacccaaaggagcccccattggttttgcgcattaagttggaaagcccttggggggcttaaatagcctcggatccattccaaatttccaccaagtccgctgggacttcgcgttgacactgtgggttgtttggtccccacatgtttgaggaattgggcgagacgtgaacctgtatgagatagcggttaacggacttttcctcggaattccgggataatctaggaattctacccctaatggggcgcttggaggaccaaactttgggcattcttgacccatgtgttagactgtcttacgggtca

SEQ ID NO: 724027 - DNA, 118 bp, Homo sapiens
catggatttgctggtgcagtacaactaggcttaatagggagcagaggttgtggtgagctaagattgagccattgcattctagcctgggcaacaagagtgaaactctgtctcaggaaaa

SEQ ID NO: 724028 - DNA, 486 bp, Homo sapiens
  misc_feature (64)..(64): n is a, c, g, or t
  misc_feature (100)..(100): n is a, c, g, or t
  misc_feature (118)..(118): n is a, c, g, or t
  misc_feature (124)..(125): n is a, c, g, or t
  misc_feature (145)..(145): n is a, c, g, or t
  misc_feature (147)..(147): n is a, c, g, or t
  misc_feature (149)..(149): n is a, c, g, or t
  misc_feature (175)..(175): n is a, c, g, or t
  misc_feature (198)..(198): n is a, c, g, or t
  misc_feature (210)..(210): n is a, c, g, or t
  misc_feature (246)..(246): n is a, c, g, or t
  misc_feature (272)..(272): n is a, c, g, or t
  misc_feature (277)..(277): n is a, c, g, or t
acaggagctagagcagtgacaatgctggtggcaacagggcagtgtagcaggtgcttcatgttcnccttttcaaccttttcatttaattgtcacaactcgnaggtggattctgttaggnacaggnngccccaggaccactccgccncngntaactcaatgcagctgacccttaccntgaatactctgcagctgcattcntgaaccgttatntaggcgctatagcaaggtcaccagacttgctacacngaagccctctgggtggcacggggggntcatnagaaacgtggattgctcccccttgtcacttcctattttcgcaagatgatatattgtaaggcggtcagggccttagatgtggtatagttaattgtctcccagcagcagggtctctctcccccatataagcccctcgttttgtcagctcaggcctaccgccagcgcagggtggtaaagcatggcagggtaattaactttcctggcctgaaa

SEQ ID NO: 724029 - DNA, 415 bp, Homo sapiens
tagaaaaattagacacctaaggatttcatgactccagacctgtttccttagcataataccacaccagtaggagaaatacaacttacgaaatttctttgtaaataaattctataacattttgggtaaaaatttatcataaaaaaattattaaaagcaattgggttggaaggaagttctgtcaaaatacaatccaggtgtgcagttctctgataaatttagcagtggttactactgaggcagtctcaaaaaaaagtgtaaaaggactttaaggggtgatgaaaattttctacattgcctttgtggagatggttatacatttgtcaatactcatcaatttgtacatttaaaagaggtaaatttattgtatgtaaattgtatcttaataaaactgattaaaacagacatacaaacccca

SEQ ID NO: 724030 - DNA, 288 bp, Homo sapiens
  misc_feature (218)..(218): n is a, c, g, or t
  misc_feature (239)..(239): n is a, c, g, or t
taggtgtctagcaggaccttaaggcgagtcgggtactggctgagagctagcgggtgtgggagcatccgggcagcgaggggtgagtgcccaaagccacaggtgcacccttccctgaagcagagtgaggtttggggggctgagtcccggacaggttgtctcttgggttcccagactggggcagcacctactccgtgtcagtggtggagaccgactacgancagtacgcgctgctgtacagncagggcaggcaagggccctggggaggacttccgcatggccaccctctaa

SEQ ID NO: 724031 - DNA, 487 bp, Homo sapiens
tatttgggacaaatcacttaaccatacccaaccctatttcttaaaaatggaaaaaatttcccgcaaaccacattggcttgtttcaaaatcaaataagaaaatgtacacaattctgttggaaacccagagggtaccggatgctatttaagtcactagcccagcacaaatgcttcaccatggtgggtgagccattgtagatgcctagggtgtcaggaaaacaacatggagtaaaggtggtggctttattttaacttataaagctgtaacccttttaatcttgaactactttcgggcgggccaagatagtgtacagattccccatatacccttcaataatattccccaaatgataatgtcatcctaaaccccagcataataatcaagatcaggacacttaccagtgatacacacttataatctagttgacagatcttatacaaatttggtcaatggtccaaatgtccttggcgggtccaggatcccaatg

SEQ ID NO: 724032 - DNA, 133 bp, Homo sapiens
gattgtgtctggaaccttcgcatcttggaccactcacatgaaaaatactgtggacactcaattaatgggctagttcttacaatgaaatgttctctaggattctaaataggcaggtacttactatgttactgta

SEQ ID NO: 724033 - DNA, 102 bp, Homo sapiens
  misc_feature (16)..(16): n is a, c, g, or t
cagccccctgaaagtnttgtgtaccccacctctgaagatgctgggggaggcagctgggatgggagccagccccatgcctgtttgtaaccccacagtgggtga

SEQ ID NO: 724034 - DNA, 270 bp, Homo sapiens
  misc_feature (211)..(211): n is a, c, g, or t
  misc_feature (262)..(263): n is a, c, g, or t
tcgaatcgagctcggtaccttgatgtgactgtctcgcctcggcctcccaaagtgctggtactacaggtgtgagccaccacaccatgcctacagaaggctttagacatttccaacgtgaggtcatacagtaactcaaaaattacacgttgtcttctcttacaagcagtgacttcaaagaacacatcaaatttttccatactggttgtttacnttcttgtaaccttcatagacgaacgtctctacttacaggtgtttggtaacnnccttggt

SEQ ID NO: 724035 - DNA, 344 bp, Homo sapiens
ctgttgagggacttttttaaacccccacccatgaacagacgttggggttaaaagacaaagcagcctgcgccagtgtggccctccctgtagcagctagcaaaggcctttagcaggtacagtcccttctggagtctttatttgcatcccaaaagcaaaaggagtcctggtgccctccctccaaggcaggtgccctcctgaacactcccttggaaaccagtaaacatcattttggaatgtgaccacccagagactacccaggagaaaggaaaaaaaaattttgaaaatgcaaaattttggggggcttccccgttcagttttttaataaaaggaccaatatcccccca

SEQ ID NO: 724036 - DNA, 786 bp, Homo sapiens
  misc_feature (14)..(14): n is a, c, g, or t
  misc_feature (96)..(96): n is a, c, g, or t
  misc_feature (111)..(111): n is a, c, g, or t
  misc_feature (123)..(123): n is a, c, g, or t
  misc_feature (156)..(156): n is a, c, g, or t
  misc_feature (182)..(182): n is a, c, g, or t
  misc_feature (292)..(292): n is a, c, g, or t
  misc_feature (297)..(297): n is a, c, g, or t
  misc_feature (303)..(303): n is a, c, g, or t
  misc_feature (322)..(322): n is a, c, g, or t
  misc_feature (475)..(475): n is a, c, g, or t
  misc_feature (566)..(566): n is a, c, g, or t
  misc_feature (645)..(645): n is a, c, g, or t
  misc_feature (693)..(693): n is a, c, g, or t
  misc_feature (707)..(707): n is a, c, g, or t
  misc_feature (712)..(712): n is a, c, g, or t
  misc_feature (785)..(785): n is a, c, g, or t
ctcattccttgtgnagtttttaggagttcgggggaagatttcatggagaggtagctaaagggacatggttttttgtttcaggggtgggaggatggntctgaggaggaaagntcagttactgcncactggggaataaaggttagttttattcttttntagtgatcttccccagaatattaatnctttggatgcattatttgagaagagatggttggatgcaggaagcttgcaacactgaaagttacacagagatatgcataccattgcggataaatacacatctgcaacatgntgggnccaganaggttatcatgggaaaaanactggagggagagctgagaatgagtgagttgacattgtggaagcccagggatttctggtgaggaggaagagccctggagctgcggcatcttgggggcctctcaagaaaccaaggttcctgaccagactgcttagaggagaaagattcagcccnaaactcaagagaggagggcaggcgtcagcgccttttcctggcaatgtggagaagcagccagagggcagagggcgaggaagacttcacagcnagttccctccacccagggtcaccaggtgcaccgagaggtctcagcctacagaaaggttttttgctcgttgcttcttaancactaatgatggcataaaggtcttccggtgggggcggcactgaggccnttcagggaggtccnggacncgatccttgtgtacctgggaggatggcaagtggtacgttggctccactggggtttctgggagcttgggagggnt

SEQ ID NO: 724037 - DNA, 107 bp, Homo sapiens
aggagtatagggtgtgccctgtggcaaggcagcaggagtaacgaagctctcagtgactcctcccagtagaccagtggagagcagtgacacgtctcacggtggccctg

SEQ ID NO: 724038 - DNA, 1164 bp, Homo sapiens
  misc_feature (644)..(644): n is a, c, g, or t
  misc_feature (716)..(716): n is a, c, g, or t
  misc_feature (772)..(772): n is a, c, g, or t
  misc_feature (821)..(821): n is a, c, g, or t
  misc_feature (914)..(914): n is a, c, g, or t
  misc_feature (923)..(923): n is a, c, g, or t
  misc_feature (930)..(930): n is a, c, g, or t
  misc_feature (932)..(932): n is a, c, g, or t
  misc_feature (962)..(962): n is a, c, g, or t
  misc_feature (1008)..(1008): n is a, c, g, or t
  misc_feature (1041)..(1041): n is a, c, g, or t
  misc_feature (1065)..(1065): n is a, c, g, or t
gactgccggagaggcgccgccacttggggtggcgggcacccggtggatattgtggccacttatggctcggaggtgaggatatgtaaaaatagtttgcaatcaaagctcacacctcgacggatcactaacacaacggacatctcagagaaggatacatctaatatagaacaagtacataataaggtgccatgttggtcgctggtgctgcgcataacccaagaactgcgagctggcggggatggagaggagcggcgggcgggcatagttttaatttatgacttcctcaggtatagggatgagttgtgtttgtcagttttgtattttaggtggagttgctacagcgcccgtcgcgcgcccagcagtacactatgctacacattgctctccctctacccgtgccctgagtacggctgttgttcgtgctcgcttgttgtgcgtgtggttggagagtcggtagtcgtatcgagtgtgtatgtgtgtagtatagtagtaggaaggggtggtgggagtcttttgttatagtgatggactgcaacccgacagaaagatatgacactcatcaagggagaacggagagacgagtagtagaactgggagacaagacattctcgctattacttagatactgtctgtacattctattngatcgtagagcgaccgtcacggtggagagtcgagatgataatataaagtcgagtatacaagtgagagagtgnatgatatcggtttgcgtggctgaatacgctaagaggttgtcatcgttcagtacccnacacgagcccaataccacatcctcgtgtatcatggctacctctcatcangtccacgataccttgcacacagatgcgtgcaggaagcgctatgtagtacgagagattgagaggagcatagaacgatgtagcagacgtgtagtncatgtatcntctatgncntgcgctgtagtggaatgatgtgttgatcantgataacgactcatatcgtattcgtcgatcatggactatagacgtntcgtgtgcagaagcatcataatcattctcaaanagacacaatgacaaatataacaanacatacatgaagtagcgaacaatcacagcacagacaagctccgctctctctagcgcacagcgcagcgagcatgcgatatcacatccgacaagcacagtc

SEQ ID NO: 724039 - DNA, 139 bp, Homo sapiens
tttgtttgcaggaagagagccctaaacactatttgcggcactgctgtttcagcgtgagtctttcaagcaagttgcgaaaaattgatattttaggtgaatgtgaaaggttggtaataagtggaaggtggatgctcgttat

SEQ ID NO: 724040 - DNA, 647 bp, Homo sapiens
tcccagttggtttaagcttattataggtttgggaggaatttggccatttggtaatcttacaaatcattcttcacccttcctcacatcagtcttcctggcttttcccagtggtttaactggtaaattggttgtagctaataatgacaaatcttgagctggattttcctcttcacctggtaatgggctgggatgttatttcccaagacctggaggggactcacactttgtttggataacttgggatcacttctccgtgagtgttagagaagggtcaaatctaccaacaggaagccctgtatctctggtaattcccagggccattggtgtaatatggttgttggtgtgccatctggatcggactggtttatcgaccttaaaacaatgtccaccttatgtttccagtgaaatgggggaattatcctatggtctacctctttcatggattggctggtgaagaatcagattgtgcaacagggtacaggacttgccctttggaaatctatacctcgggatacttaagaggctttttattaacaaagggcccttctaatggtgctatttattggaccaatacctataaagattggccttaatttggggttataggcttttatcaaaaggtatcctcatagacttatgcaggttaa

SEQ ID NO: 724041 - DNA, 838 bp, Homo sapiens
ggggaagcgctcgtccgtggacgaggacctcggaaggtcccgaggaggccgcaggaaagtcgtcgagggacgggcggcccgcctcgacaggtccagctcctgttcggctcactgcaaggaaacccctggaggctgaggagagaggctggcaccgcctagcattcgtgccccagctcaggtgagccgcccagtcatccgtgcccgcctaccagggacctggccacccctcccaagctccacacttgtgagaagtgcagtaccagcatcgcgaaccaggcctgtgcgcatccaggagggccggtaccgccaccccgggtgctacagccgtgtgccgactgtgggcctgaaccgtgaagactgcgcgggcacttcatgggtgggtgacgagctgtactgtgagaagcaatgcgcacgcctagcagcgtacgtccggctaccctgccaacgcacgtcacgacgtgcttctgcggcctcgaggaccacgccgatgccgcatcaagcactgccgtctactgctggagcgcagggtcatgcctatataagtaggcatgccagggacacatggtgggcagcttgctcggtacactgagctaagtcttggacacgctgatggccccttatgtcctcgctagggtgggcacaaggtactgggacctgtcgtggatctgtgggagactcaccctctaccttgccaggcctctcccctgcaggactggcattgcactagtctgaggtggccactgcctttgatcaaccatttgtgtgccagggtctaagtagggtcgaacacagaagtgggaaggagagggtggatacggctagtgggtcacagtggtaa

SEQ ID NO: 724042 - DNA, 785 bp, Homo sapiens
ttagggatcggccgcgcgcgctatcattgacaccatgccgtgtgcatgctatcaagctggccagggtcaccaaggtcctgggtctggaccggttctcatgggacagtgcacgcaggtaatcgggtggtggcatttgggcgactgccggcgacctatctccctgatttgacctctaccctgtccctaacccctgccagccggaatccgggtagccgcattctcatttcatcacggggttcttgatggttccctttaagcgatctgtattctggccccgatcacgttctctgaattctatatctgcttcccactccgcggttgcctttccgcggaccgccctttacttcttcctccagctccggtggggacccgtaggtgcgcgtggaattcatggacttacacgagccgatccatcatccgcaatgtaaaaggccccgtgcgcgagggcgacgtgctcacccttttggagtcagagcgagaagcccggaggttgcgctgagcttggctgctcgctggtgggtgcaaagcatggacatccccttgatagacctttggcttggtggtagtggaggcttcgttaaggcccaggatgagagggtaagggaggcagagtctacatacagagactgacaagagggacggcggcgagtttgccaattgcttgcggggcctgtcacacatctcatgtttagggtctgttcacaggggtcttggatgtcggggttcgaccacttggcccgatgggcatggtctgtccaatctgctccttgattttgtccgcccaa

SEQ ID NO: 724043 - DNA, 134 bp, Homo sapiens
tataggcatcgctaccgcctgggcaccatccgccatcttcctcggtcatgaacatgcataaatttatacagtgctgaacccacggagaggtgcttcccacagccttcgaggcctctgagaagtgcgcctgggtg

SEQ ID NO: 724044 - DNA, 1130 bp, Homo sapiens
  misc_feature (478)..(478): n is a, c, g, or t
tgggtcagcaaaatttcttttaaataaagaagagtagggatccagggtttagttttgtggtacgcctcggtttggccccgtcggcctcgggcacgctcagaacttccgggcccttgagagcggagactgtagggtttgggtggtgggctggtgcgggggtcccggggcgccttgccagaaatggccgtgatacaccctctcggcccttgtacagaaggaccgagaagagcaggagacagtgtgccaacagcccttataggggaggttccaggggccagcctgtggtctcaggaaagttgaggagattcttgtgccccctgtgcccgtgaagagattgcgcggtgtgcggcgcccgggctgtggctcacggcgcaggtgcacattacccttttaaggttgtgggtatacctctgctgtaaaacccgcgacaacatctcatctcaagttatagtggtctcccacaaaaagcacagcgtgncgcgttctttgttttctctccgcggccacgagagaaagtctttccattcttctcgcggaactcatctcgcgggaagagagggtgaacacagagagtgcgggccccgagtgttggggtgtggccagaactctctatataaaacaaacactctctctgtttccacacaacaaacagccgctgtggtcttgtgacagagttgcgtggaaagtgttgggggtatctccttctcggtggggcccagagagaaacacccctgtgtattaatcaaactgtgtttgcaccccaagacgaggcaccctacgaggggtattaagaaattatctcgcgtggggacccatctatggtgggagacccatccctgttattgcggcgccacacaaaaacctcctatatagggagagggctcccttagtggtatgaagtcggggagaggggcaatgttgtctcccaaagcctccccccaatgatgaagtggcgacgggcagagaacaaggcctcccaggagacttgatgaaccacggcggccggtattagtaggcgtggcaagaaagacaccacaaggtggtctgttggccgagaagcggggcggacaaaaaagcgcttagaattgaggcaaggcacccccaccaaggggttagaccaggtgagaaaa

SEQ ID NO: 724045 - DNA, 607 bp, Homo sapiens
cttcctcctgtggaatgtaagctgcttgagagcaaggaccttatctgttcattaacgtaacctccagtgtcttgaacctcctggcataggttggtgtttgggtaactttgtatgtactgggctgcctgtaacggaaaccacaggtcaaactgacttaagcagtaccgcattaactgcttcacttaaaaaggaattctaaacgtaggcttaaaagattttggattaagggccgtacctatgtcagggcctcaaaggctttcaatctttacactctggccttcaaattaatcctaatcctaactctagccttaaggatgattgcaaagtacctgttaaggctgctggcttcttctctcaggttcagtggaagggagagaaagaagttacacatcattctctaaagattagggaaacacttacatagatgccaccagtgaactgtgtttacacttttatggccttttgtgaacccatttgtttacccaagagtggattcactgttaggccaaaagggcccatcactgtcgctacagatggggttgctttgacctgagtcatgtggactctgagaggaattagagatccctgataaaatcggagttctctt

SEQ ID NO: 724046 - DNA, 194 bp, Homo sapiens
ttttccagttgggcccccccttccccccccccgaacaaaccccctttgaggcctcaccaaagagacaatagggggccaaatgggcccccctttttttagcccctttttccggggataaatagggtttggggccccttaaatggatgtttcccgggtgtttttttttcggcccaataaactaaagaattgggtta

SEQ ID NO: 724047 - DNA, 247 bp, Homo sapiens
ctgtgttcatcgctgggcaaactgaggcccagagaggtcggcacactggcctgcggtcacaccgcaagtctgtagggctgggagaccgagggtacgggcaaacggggtcccccgtgatccagccagggacagagcgggggattccacggtttaggtcccgaggacgacgtgcctccccacagatctggcacgtcattacgacacgggatactggtgacggctgacgactgggccgggaccacggctg

SEQ ID NO: 724048 - DNA, 254 bp, Homo sapiens
ccccaagaagagtactccaagagtatggacgggacatgaggaagaagattcagaagattacagatttcatctcattcttccgagataacgatacttgcccaacctgcacccaacctattactgaagacttcaaggcgcaagtcatcgaagctaaagcaaataacagaacagaacttcagagtagccttgaaaatcttaatgcgctacttcaaaagacagaatcagaaatcgaaaagctagatgaagggtaccga

SEQ ID NO: 724049 - DNA, 190 bp, Homo sapiens
ggggttttttgaccctaaggaaaccaggccctgggtgatttttcaaatttgttccccctcggtgagcaacagtttcacccatgcaaccaggacaaaatggttattgggtgcccttggttagctgtgtttttcctaggaggtaaaaaactttgggaaactgtggttaataaaaacaaatgtttgggggtca

SEQ ID NO: 724050 - DNA, 152 bp, Homo sapiens
tgggagacagcagcaccagcgtgcagagaccccagacatcaagctctttgggaagtttagcaccgatgatgtgcatgatcaatgacatttccctgcaggattacttgcgtgaaggagatgtatgccaagtacctgcctcacagtgcaggcgg

SEQ ID NO: 724051 - DNA, 1140 bp, Homo sapiens
  misc_feature (900)..(900): n is a, c, g, or t
  misc_feature (1005)..(1005): n is a, c, g, or t
caagaaactgatcctggagatcgagaccatcctggctaacatggtgaaaccccgtctctactaaacatacaaaaaattagccgggtgtagtggtgggcacctgtagtcctagctactcgagaggctgaggtaggagaatggcgtgaacccgggaggtggagcttgcagtgagcggagatcgcgccactgcactccagcctgggcaacagggcaagactctgtctcaaaaaaaaaaaaaaaaaaagagggactcctttttttgtggggcgcaagtggggtgtagactaagggcattgtgattctcagaatttttaaaaattttttggaagtggggtgtggctaatatattcaaattttgggacacaagaaaccttgaggttctcgaaaagaacctcttaaatgaggtctagaagtgaaccgttgtggcccctaggaggggtaaccgctaacaagacaaccatgtgggcccccttagagttttctattaccccagggttattcgtggtgaacatgggagaatctcccggaataatggagatggcgcgtgtccctcagtatgggacgccatattgcttggataaccaggtcctggaagatcgcttaaaaaatggcccaaggtcactcaagagggacaattacccatatttccaagactctgagctggttccccttcttaccaacttcttttttggccaaattacgctggtttagacagggggaggttcttcacaactttttttcacgcaacgctgttgacactctccacggtaatttggaggccccctcaaaggtaggcgagccggggaatataacactctgtgtgtgaccaaccgtgtgggactccccaatttgcactcagagaccccgtggggcgccttaacaaatcaggggggccggggnccccagggacactcaacacgagcacacctgcgggacaccccccaggggggcgcaaactggcgtcgtgccgtcaacccatctttcggagagaaagacccctcgggngaaaaaggggcgccaatactactcttgcacaacacttcgccacattgcgagaacaagtagaacaacgccaggcggcgaacacagacaacacggaccagcccccacgacagggcgagcaaacaatacacgcagacg

SEQ ID NO: 724052 - DNA, 284 bp, Homo sapiens
  misc_feature (29)..(29): n is a, c, g, or t
  misc_feature (34)..(34): n is a, c, g, or t
  misc_feature (58)..(58): n is a, c, g, or t
  misc_feature (93)..(94): n is a, c, g, or t
  misc_feature (98)..(98): n is a, c, g, or t
  misc_feature (105)..(105): n is a, c, g, or t
  misc_feature (137)..(137): n is a, c, g, or t
  misc_feature (142)..(142): n is a, c, g, or t
  misc_feature (167)..(167): n is a, c, g, or t
  misc_feature (170)..(170): n is a, c, g, or t
  misc_feature (190)..(190): n is a, c, g, or t
  misc_feature (209)..(209): n is a, c, g, or t
  misc_feature (220)..(220): n is a, c, g, or t
  misc_feature (224)..(225): n is a, c, g, or t
  misc_feature (257)..(257): n is a, c, g, or t
  misc_feature (271)..(271): n is a, c, g, or t
  misc_feature (273)..(273): n is a, c, g, or t
accacacctactgagattatttgtaaganttggngcaatgttggcctatacgcccttnatgagaaagccttgcattattgttgggctatttgnnatgntttcctnaaatatctggcaaagaattctgcatctctctntactnccagtgcattacaaagtggcttctnctnagtaccaccgcaaagccctntgagcgtctacagacagcncaccattttgntccnntatctgtaaacactttttgttcttagtctttntccttgtaaaattngntgttctttaaa

SEQ ID NO: 724053 - DNA, 152 bp, Homo sapiens
tggacagcacaggtaggacggatggcagcagagtcttcgaaagcagaaaccgaggtggccgggggcacggtgtcagtagctgagggtggagtcatcccactccagctgctgctgccgggttgcgttctgggggtcgccctgctccccctcct

SEQ ID NO: 724054 - DNA, 202 bp, Homo sapiens
tcagatcataagggttttttaaaaaaatcttaccattatgaaagttaaaaaaaatatagcactcgggacagtgaattactgcatttaatattcaaacactcaaggcgcatttctcacagtttacatgtgagaattgagcatgatccaaactgaaatatccgttggtcgtgtctttcaatgtctgcagcaaacactggcttag

SEQ ID NO: 724055 - DNA, 1126 bp, Homo sapiens
  misc_feature (1126)..(1126): n is a, c, g, or t
tgagatggagtctcgctccgtcgcccaggctggctggagtgcagtggcgcgaatctcggctcactgcaggctccacctcccgggttcacgccattctcctgcctcggcctcctgggtggctgggacttcaggcgcctgccaccgtgtctggctaatttttgggtatttttttttaggtggagaacggggtattaagcgttgtttggccaggagtggtcctccaatcttccgtgaccctcggtgtatcttgcccgccctcggccctccccacaggtgcgtgggatttacagggcgtgtgagccaccagtgtcccggccacctcatttttattaacagtggaaagttttgtggaacagatgatacagtataccgagggttttgccatttcaaattttaacgcctatattttgaaatctcacactattttatacccttttccctttcttaggaaaagctgatactgaaacataggaactacggttggggggggaatatgccaattttgtagctcccccaaattcccaaatcacaggtatggacttgctccgaaaagcttagttatacccagagctggggtattcgaagaagctttgtgctataatctcgtggacccgcggtaattaaatgggtctgggagtcttcatacagttgccaaaggagacccataattttagtttattcacaaatccaccattttactcacagctaaatttatgaagcttgtagagcccttagtacccttttaagggggacaacatgatgacctttgggaaagagcccgcggtatataacagacatattggcaaattgcggctacaggacaaagggaggtatagggcgataaccgaaaagcaaaggacccgctatttggggtatcccccgtgaggaccaccaactttgggaacacaaccggcaagaatatataagccgcgggtatataaaacaacggggaaagacgctcgtttaccaaaaaaaaataacagaaagaggaggaggacacagagagatgcaaatcacgctccacagcgaatacatacgacacatactcaggcaacctcgttgtaacacaaagaacggtgtcaaactagcatgatctgacctacactgagaaatagtcatcgccagn

SEQ ID NO: 724056 - DNA, 146 bp, Homo sapiens
cgcaggcttggatcctccaccattaagatagacaataacgcttaatgtctagatctgggtgtctaatattgcattagctagtagcatgtcctctacactgtagtgggtgacccgacgtacattatatttgtataacagaacatttg

SEQ ID NO: 724057 - DNA, 289 bp, Homo sapiens
tgagagaccgtgtagcatgtgtgtttaaggcacgacgccagtagatccgtgtacacccatgtgccaataagacaatgggcacagcacaaattggcaggagaaaaatggggactataaatggcgtgtggaaaaggccttaatagttaagttacaggctaagaatgtcatgtctggggtaagaatttccattttaagcaccggtcaactgtatccactttaacatctaatgtcagcaccttgtctccaggcagaacaacaaaccatccaaacattttaaacatttggggga

SEQ ID NO: 724058 - DNA, 756 bp, Homo sapiens
gcctccctcttggcctctcatccattggctctgcagggcagggtgaggcaggtttctgctcataagtgctttggaagtcacctacctttttaacacagccgaactagtcccaacgcgtttgcaaatattcccctggtagcctacttccttacccccgaatatggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggccctgggtgggctagggcctgattcgggaagatgccttttgcaggcaggggaggatacgtgggatctaccaattgattctggcaaaacaattctaagattttgctttatgtgggaaacagatctaatctcatttatgctggatttatattcttagttgtgtttgaaacgtttgatttgggaaaacttaaataatatgg

SEQ ID NO: 724059 - DNA, 294 bp, Homo sapiens
tggggaactatagagagaatcatcacccgccgagggagcgtattaattgtcaagggtgagctgcacctatgcctcaaacactgcccattgggctccacttaaacatgggggagcaaatcttaactttagcttgggaggggccacgtatctaaaccatagcagagtctctttgtgatgctcttgagatgacatggtttgggccttggttcctgagcaggggtcttgcctttcattcagccagtcatatttgatactcagcataaaattcttcactcatcctttaaaccgtggggc

SEQ ID NO: 724060 - DNA, 867 bp, Homo sapiens
ggaagggaaggggccttcactaaggaccaatgagcataagcaggagacaaatgtcacacagcacacatgaggcagaccgagggttatgaggactggcaagcgttggatgaggagtcagtggagggagaggagtaagagagggctctgagatgacaagtgcaggtaaagtgtagagatgtgtgggtatgtgttgcgtgtagctatggtaactaaagggctgggatgatcacagtatgttgggcaccatatatttggaatgaccatttgattttcagggacatcacaaccttgacagaattacctcagctgtgaggtcctagcatattccagcatgctcctgctccctttgttcccagctacagaaatacaagaactcacgggctgtacttcccatttcacaatcctctggcatctcattaacatccaccttgtattctacacagatccactcttcactctgagagagttaaataaatacattctcaccaaggtcattgcagagcttacatagaaaccatcctatatcctgaagatcctgcagtatgcagttttaggaagcttgtttttgtcttttcagggtcattatgaccaaagaatttgatgcttggtagctaattttcaaaggctacttggattctgttactgcgaccacacagagagatcaggaggatgtacttcccttgcctatcttttcatttctatgtgtatatctgggctctggagaagtggactttggacttctcttccctgctgtgctccggggcttgtgcatttgaattgaatggtataataagctcttgaaggagcgggtgtgctgggagagtttggagttcctgatgaagcgtgcacaaagaactgtagggggtg

SEQ ID NO: 724061 - DNA, 108 bp, Homo sapiens
  misc_feature (40)..(40): n is a, c, g, or t
ctcagaaggagacgctattgctgcgatgctgcgtcacagngcgggaagcaattatccccgctgttggaactgcggcggccatggggccccgggcgggaggacagggtt

SEQ ID NO: 724062 - DNA, 326 bp, Homo sapiens
ctcccgtgttcacgccattctcctgcctcagcctccctagtagctaggaatacaggcgcccgccaccacgcccggctaattttttgtatttttagtagagacagcgtttcaccgtgttagccaagatggtctcgatctcctataggcacgtgctactaacccctggctaatttttgtcttttaagtagagacggggttttgccatgttggccaggctggtctcaaactcctgacctcaagtgatcctcttgccttagcctcctgaagtgttgggattacaggtgtgagccaccacacctggcctattttgagttagattttttgtt

SEQ ID NO: 724063 - DNA, 150 bp, Homo sapiens
gaccccatcgccccggcggagaagttcgaaacgctcaaggtcaagctgggcgacggctttgtcgggaccaccttcccggatgaggtcgccaatcccgatggcatgatggccaaggggcgcaagccgcactcggtgttcaccggcgctgtg

SEQ ID NO: 724064 - DNA, 353 bp, Homo sapiens
caggacaagatcctctgatgccaaaaccagaggctcataatagtctcatcttcatttagcatgctaatgaaaatagccgagtaagtaagagaccgtgcatatatatcaagcacttataattatgatcacaggctctcatcagcgtaagtgcatatgtccatagcaagcgattcatcctggacctatatcattagaccggcaacaggtccccattctatttattgcgtatatacacacagaagtctacagttaatcagttatataatatgtaaagtatattactagggtgaagttaatgacacgcatatttcgtgaatctgttgctgttccacaccgttatttgtacatgacac

SEQ ID NO: 724065 - DNA, 166 bp, Homo sapiens
ctccctcccccctcccccccgacatcccggaacaaataaataaataaggcgcgcgagagaggccaacacgtcgcggagggagatgttgttattttttgctgttgtgcgtccctgacgtcacatccacctgctgggtaaacaaccgggctcccagaaaaaaaaaaaa

SEQ ID NO: 724066 - DNA, 349 bp, Homo sapiens
taccggaccgaaacttatagtgctctatctatatgacaattacagctatgacccgctagctcgagtggacggtacggggaaacaccagtgtgtacggtattaccacaatgacctgaacggactgccagagtacctcactgagactgatgggctcatagtttggcaagcgcgctacgaagcatggggcgcgccccttgaagaagtgcgagaagcgtacttcatcgaggagcaaaacctgcgattccagggtcagtatcttgatcgagaaaccgggttgcatttcaataccttgcggtattacgaccccgacgttggccgttttacgacaccactataaggttcggctgta

SEQ ID NO: 724067 - DNA, 124 bp, Homo sapiens
aggccgttgtcagtgggaacattttagccctgccactcaaagtgtgatccaaggaccagaagcaacagcacagcaacgtcaaccagtatctcaggagcttgtaagacatggagaatctggggca

SEQ ID NO: 724068 - DNA, 155 bp, Homo sapiens
atcgagttataaagcagcatagacatcgtgatgttgaaagggcttactcttatccctttcaggtccttcacgtgagaccaaagaccgggtcaggggatgcacaaatcactcaccgacgtggccctggagcaccatgaggagtgtgactatgtgtg

SEQ ID NO: 724069 - DNA, 692 bp, Homo sapiens
gccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgccctcatgatattgttgcatctgaagatgggactgtgtacattggaagatgctcata

SEQ ID NO: 724070 - DNA, 105 bp, Homo sapiens
gcggccgcctactactactactgctcgaattcaagcttctaacgatgtacggggacatgccactgcactccagcctggtgacagaacgagactccatcgcaaaaa

SEQ ID NO: 724071 - DNA, 776 bp, Homo sapiens
acactgaagatcctggggtcgccatgggccgctgccccggccgttgttaccggtgtatggtgagaacaagccgtacccaaagtctcgctatctgccgaggtgtccctgatgccaaggattcgcatttttgaggctggggtcggaaaaacagtgcaagaagtggatgagtttccgcctttgtggccacatggtgtcagatgaatatgagcagctgtcctctgaagccctggtaggctgcgccgagattatgttggccaaataagttacagtggtaaaaagttgtggcaaagatggcttccatatccgggtgcggctccaccgcttccacgtcatccgcatcaacaagatgtagtcctgtgctggggctgacggggctccaatacaggcatgcgaggtgcctttggaaagtcccaggcactgtggccagggtttcaactatatggtccaagttatcagtgtcgcatccgcaccaagctgcaggaacaaggagcatgtggattgaggccctgtcgcagggccacagttcaagtttcctggccgtcagaagatgcacatctcaacagaagtggggcttcacccagagttcaatgcttgcatgaatctgagagacatggtggctgaaaagcggctcatcccagatggtgtggggtcaagtgcatcccctagtgcgtggcctctgggacgagtggcgggccgcatttcatgcacggctgccaaatgttgctgcccgctctttatactcatgcattcatgctactgcgggtctaaaaaaaaga

SEQ ID NO: 724072 - DNA, 229 bp, Homo sapiens
acaccaatcagtgaccgtgtgtgggctggcggctctttcttccccaccaacggaacccctggtgcaccaaccttccccagagctccggagcgccctctcctcatttgcaggttttggagcaagagcgtgcaggaagcccgcacccagcttccttctggcgttcagttcaattggtcgcccgtggagaaacctgtttttctttaactaaaaatatcccaaatgctaaaaa

SEQ ID NO: 724073 - DNA, 930 bp, Homo sapiens
  misc_feature (24)..(24): n is a, c, g, or t
  misc_feature (110)..(110): n is a, c, g, or t
  misc_feature (116)..(116): n is a, c, g, or t
  misc_feature (126)..(126): n is a, c, g, or t
  misc_feature (139)..(140): n is a, c, g, or t
  misc_feature (142)..(142): n is a, c, g, or t
  misc_feature (146)..(146): n is a, c, g, or t
  misc_feature (149)..(149): n is a, c, g, or t
  misc_feature (171)..(171): n is a, c, g, or t
  misc_feature (192)..(193): n is a, c, g, or t
  misc_feature (198)..(198): n is a, c, g, or t
  misc_feature (201)..(201): n is a, c, g, or t
  misc_feature (230)..(230): n is a, c, g, or t
  misc_feature (237)..(238): n is a, c, g, or t
  misc_feature (246)..(246): n is a, c, g, or t
  misc_feature (257)..(257): n is a, c, g, or t
  misc_feature (273)..(273): n is a, c, g, or t
  misc_feature (277)..(277): n is a, c, g, or t
  misc_feature (309)..(309): n is a, c, g, or t
  misc_feature (347)..(347): n is a, c, g, or t
  misc_feature (460)..(460): n is a, c, g, or t
  misc_feature (499)..(499): n is a, c, g, or t
  misc_feature (508)..(508): n is a, c, g, or t
  misc_feature (518)..(518): n is a, c, g, or t
  misc_feature (535)..(535): n is a, c, g, or t
  misc_feature (600)..(600): n is a, c, g, or t
  misc_feature (747)..(747): n is a, c, g, or t
  misc_feature (754)..(754): n is a, c, g, or t
  misc_feature (765)..(765): n is a, c, g, or t
  misc_feature (916)..(916): n is a, c, g, or t
gaggagcggcggggcggggggggnggtcgaaagcggagtgaaagagggaggcagggagccggagagccggaaccggagtcgcagcggggagacccctgtgcggtgcggangggggnggggcccgantctgacccgcgcnngnggtnggncatgggggagatcagcgacctngaccggaagatcgagcagctnngtcgntgngagctcatcaaggagagcgaagtcaaggncctgtgnnctaagggnagagagatctnggtagaggagagcaangtgnagagggtggactcgccagtcacagtgtgcggngacatccatggacaattctatgacctcaaagagctgtncagagtaggtggcgacgtccctgagaccaactacctcttccatgggggatttgtggacgtgggttctatagcgtcgaaacgttctcctgctgtgggacttaaggttcgctatnctgatcgcatcacactgatccggggggaccatgagagtnggagatcanaaaatgtatngtttctacgatgagtgncgtgcgcgagtacggctcggtgagtgtgtggcgctactgcactgagatctttgactatctcagcntgtgagccatcatcgatggcaagatcttctgcgtgcacggggggctctcccctcatcagacctggataatcgacatgaggaagcagagtgctcatgatggcatgtgtgactctctgtctgagcagagaacacagctggggtgagccngaggagnggctactattngagtagtgtgccattcagcagcatacataatgatctgcgtgcacaatgtgatgtagtatagtgagtcatgagagtgtatgttgtcgacactatctacgtgtggattgacatttgagtgaggattcagagatatattttagtgtcgagaaangggatcatcagagc

SEQ ID NO: 724074 - DNA, 818 bp, Homo sapiens
  misc_feature (24)..(24): n is a, c, g, or t
  misc_feature (110)..(110): n is a, c, g, or t
  misc_feature (116)..(116): n is a, c, g, or t
  misc_feature (126)..(126): n is a, c, g, or t
  misc_feature (139)..(140): n is a, c, g, or t
  misc_feature (142)..(142): n is a, c, g, or t
  misc_feature (146)..(146): n is a, c, g, or t
  misc_feature (149)..(149): n is a, c, g, or t
  misc_feature (171)..(171): n is a, c, g, or t
  misc_feature (192)..(193): n is a, c, g, or t
  misc_feature (198)..(198): n is a, c, g, or t
  misc_feature (201)..(201): n is a, c, g, or t
  misc_feature (230)..(230): n is a, c, g, or t
  misc_feature (237)..(238): n is a, c, g, or t
  misc_feature (246)..(246): n is a, c, g, or t
  misc_feature (257)..(257): n is a, c, g, or t
  misc_feature (273)..(273): n is a, c, g, or t
  misc_feature (277)..(277): n is a, c, g, or t
  misc_feature (309)..(309): n is a, c, g, or t
  misc_feature (347)..(347): n is a, c, g, or t
gaggagcggcggggcggggggggnggtcgaaagcggagtgaaagagggaggcagggagccggagagccggaaccggagtcgcagcggggagacccctgtgcggtgcggangggggnggggcccgantctgacccgcgcnngnggtnggncatgggggagatcagcgacctngaccggaagatcgagcagctnngtcgntgngagctcatcaaggagagcgaagtcaaggncctgtgnnctaagggnagagagatctnggtagaggagagcaangtgnagagggtggactcgccagtcacagtgtgcggngacatccatggacaattctatgacctcaaagagctgtncagagtaggtggcgacgtccccttgaaaaccaaattaccttcttttcagtggggggactttgtggtgggaccgtggtggtttctatagaggtcgaaaactgttcctccgtgttggcttgacaacttcaggggttccggttatccctggatcgcattcaaccattgatccgggggcaaccattgaggaagtcgccaaagaattcacggcaggtcttagtggatttatacagaatggatttgccttgcgcaaagttagggcttgcggatgaacttgtgttgtgggggctattggacttgaagaattttgtgagttactttaaggcgtggtaaggccattattcgaggggaaagaatctttttgcgttgaaggggggggccttttctccccttcctattcaaggaccgtgtgttcaagatttcggacacattcgagccgaaagaagagtggtgcgtctattgtgttgggcccat

SEQ ID NO: 724075 - DNA, 332 bp, Homo sapiens
cggcagtggcatgatcttagacatcactgcaaccttcaccttcacggttcaagcaattctcctgccttagcctcctgaggagctgggattacaggtgcatgccaccacgaccggctcatttttgtatttttaatagagacagggttttgccatgttggccaggctggtcttgaactcctgacctcaggtgatccactcacctcggcctcccaaagtgctgggataacaggcatgagccaccgttttcaggttgtcataactacattctaattgactgcatatttttaaacacaaattaaactagttatgttctccaccctactcagttttgg

SEQ ID NO: 724076 - DNA, 826 bp, Homo sapiens
  misc_feature (40)..(40): n is a, c, g, or t
  misc_feature (94)..(94): n is a, c, g, or t
  misc_feature (102)..(102): n is a, c, g, or t
  misc_feature (104)..(104): n is a, c, g, or t
  misc_feature (117)..(117): n is a, c, g, or t
  misc_feature (125)..(125): n is a, c, g, or t
  misc_feature (147)..(147): n is a, c, g, or t
  misc_feature (149)..(149): n is a, c, g, or t
  misc_feature (174)..(174): n is a, c, g, or t
  misc_feature (178)..(178): n is a, c, g, or t
  misc_feature (189)..(189): n is a, c, g, or t
  misc_feature (192)..(193): n is a, c, g, or t
  misc_feature (199)..(199): n is a, c, g, or t
  misc_feature (212)..(212): n is a, c, g, or t
  misc_feature (217)..(217): n is a, c, g, or t
  misc_feature (222)..(222): n is a, c, g, or t
  misc_feature (233)..(234): n is a, c, g, or t
  misc_feature (236)..(237): n is a, c, g, or t
  misc_feature (241)..(241): n is a, c, g, or t
  misc_feature (246)..(246): n is a, c, g, or t
  misc_feature (250)..(251): n is a, c, g, or t
  misc_feature (263)..(263): n is a, c, g, or t
  misc_feature (272)..(272): n is a, c, g, or t
  misc_feature (288)..(288): n is a, c, g, or t
  misc_feature (304)..(304): n is a, c, g, or t
  misc_feature (309)..(309): n is a, c, g, or t
  misc_feature (318)..(318): n is a, c, g, or t
  misc_feature (326)..(326): n is a, c, g, or t
  misc_feature (346)..(346): n is a, c, g, or t
  misc_feature (362)..(362): n is a, c, g, or t
  misc_feature (367)..(367): n is a, c, g, or t
  misc_feature (376)..(376): n is a, c, g, or t
  misc_feature (386)..(386): n is a, c, g, or t
  misc_feature (411)..(411): n is a, c, g, or t
  misc_feature (436)..(436): n is a, c, g, or t
  misc_feature (473)..(473): n is a, c, g, or t
  misc_feature (600)..(600): n is a, c, g, or t
  misc_feature (626)..(626): n is a, c, g, or t
  misc_feature (628)..(628): n is a, c, g, or t
  misc_feature (654)..(654): n is a, c, g, or t
  misc_feature (659)..(659): n is a, c, g, or t
  misc_feature (792)..(792): n is a, c, g, or t
aaaataatatgaaatgcagacttgtttaaattctcttgcngattctcttgaagacaatgtcacccaatgtcatggcctgaaagccagacaaganattatgangngttcatctgacgncgtattgnaaaaaacaaaattaagcctaananacaaaattaagcctaaaaaacagcnccanatatgtcggcntannacacanttcaaaaattcgnctggnttccngtaggaccggnngnnaggntggcnatgnnttccaaaatccnatgccaagnctttgtcacttctccncctcacctgggaagtnctccngcctttggntgagttcntttctacatcaatgactgtnatagcgagggcatccnggccngcccaatcnaatttctcanaatttcattgagtacctactatgcnccaaatacatgttgagcaccaaggntacatgtacatggccacaactaggcacacagcctggnaggcagtgcggtcgtgcataattgtcctcctatagctgtgaagcatataaaaacagtggatgcatcagcttttgagtttttaaggatgtttcctccacccctgccagttctcttgaataagactgcnggcatgacataccatgtcatcagggngnaaaggagcccctcagtttcagcagcnatgcnatagttgctgcttgatgggtttgagccctggatttaacatttattagctgatgacttggacaggtcaacctgtctattgaatccctcatccagcctccctcgaaggagacaggaggattaggtgagatggaanctatcaaagggcgttggccaggacttactgcagg

SEQ ID NO: 724077 - DNA, 260 bp, Homo sapiens
agcgagttatagagtgaccaagtagctcctctttaaccctctatggtctcaattactacagaagggctaggtgggaggatcgcttgagcctgggagttcacggctacagtgagctgtgatcgcaccactgcacctcagcctgggcaacagattgcgactctatctaaaacaaaacaaaacaaaaattaccccagggatcggatttgatggacatggtaatggcggtggtggagagagggacagtacaatctgacggtgga

SEQ ID NO: 724078 - DNA, 150 bp, Homo sapiens
gcacagaagatatcattcgatgtaggattcagcagagaaatattacaactgtaggtggaaaattgcaggtattgcctcccgctgctagagaatgtacagagataggtgtagagagacagagtgtagatatccacaaagggtatctatatc

SEQ ID NO: 724079 - DNA, 234 bp, Homo sapiens
gatctagaggatcccgtggtagggctgcaagcttataaacaaccagatcccacaagcgctcactcaatatcacgagaacagcaatggggaagtcggcccccatgagctaatcacctcccaccaggtccctcccacaaaactgggaattacaatttgacatgagatttgggtgtggatacagagctgaaccacgtcaagggtagttcaaccgctgagagggatcttctgcacgat

SEQ ID NO: 724080 - DNA, 1598 bp, Homo sapiens
  misc_feature (1377)..(1377): n is a, c, g, or t
ttcgtaccgggagggacctctatcagcctggactcggaggaccccgagcccacgccagcaccccacacatccgatcctccgggagatagtctctgtccctcggacagacgaaaaagtactgattccccacatgactccatggcctctagggatgcagatgatccagtacactgactggtagacctgggcacctgccttcccacaggcccacgacgcacttgacgacacacctatgggacacgacacgacgacgacaaccctgcaacgacatcaccaacaccacggcaccggttcgccgggacaacagacggacgcgacgacgacggtgtgacgctgtcggtgtggtgtgtatcttatgctacatagaaccagcctggtagctgtgcagtgatgtgtgataaatactactatgacagcaccctactagacgacgagtgtggtgtgttgaaaacatactatgaaaccatactactataggagatgagatgtgtgacgtagtgatgtatatatcaaatacgaaacaaccatacttcagaacgaacacatggaacatgacatttatatgatgaagattcatgcaataataaaacgaactgacagaagactagtcaaatcagtatataacacagcgacacgcggagcatgctaacacaatgataagacaacaacagcacggataagacgcacacacgaacagtctgaaacaggagaagacacggccacagacaagtacgctagccatacacaccaccaggacactcggcgaaaacacatgacaacaggaccacagtcaacggagggtacgacgcgaagcccccaatccaggctccacgcagacccttgatccgcccatcaaccagagccgaccccgtcgcacaaagaacagtcccatacaccgcgacagcatccacacactaacaccgccgaggatggcacatgacacacgacgaggcggcactcacaacagggctcgatcataaccccgacatcgacgcgaaccctcaatcggggcggcacacagaggcttcaccatatcacgagcgagtgcacgagcacgacacgaagacgccaccagggaagagagataacaaaacagagaacgaaacacaactaagatgacaaacacacgcggacacatcatctgcacagctacccagcgaaccccaacagcccaggtggaccgacgagggcaggggacctgtgagagactgccggggagcacaacagaccacaccacaagacacgacgcaaaacaaaaacaacaccacaatatacagagccgatgcgaaatcgagcggtggcgagacagactgaagcacagaaggcagacacggagcactgacaaccccaaacgcacaacgacatagagtgcgcaanctatactaagcacccgcaggcgcccagcccagggcggagctaagcacgagcgccaccgatgcgacgcggagcgaaaagacaaggtacatagacggtcagcagcgacgctacgtccgacatgcgacaccagatacgaagagagacgtgacagcgagcagccacacagcagcgacgacgacaacacgaagccacagagggcaccacatcaatacgatcccccg

SEQ ID NO: 724081 - DNA, 359 bp, Homo sapiens
tttatttatttagagacagagtctcactcttgtcaccaaggctggagtccaatggcatgatctcagctcacaacaacctccgccttccgggttcaagcaattctcctgcctcagcctcccaagtagctgggcctacagcagccaccgccacgcttggctaagttttgtatttttagtagagatggggtttcaccatgttggccaggctggtctcaaactccggacctcaggtgatccacccgtctcagcctcccaaagtgctggaattacaggcatgagcaaccgtgcccgtcagcttatttcttttaaaaatcagaacaaaacttggtttagatgtaagaaatgtggaagaaaagtag

SEQ ID NO: 724082 - DNA, 221 bp, Homo sapiens
tgtgtaccgtcatacgcaaattaagcagtgtcatacacgacattcacaaaagaaagtcaaaacatcatatgatcatctcaatagatgcagaaaaagcatttgacaaagtccaacatccattcatgatcaagaccctcgccaacagtgggtatagacgggaacactccctgaacattgatcactagtaacttagtgacaaaccccagcatcaaacgataact

SEQ ID NO: 724083 - DNA, 123 bp, Homo sapiens
gtttcacgctggggcttcgaggacttttacctgaggctgcacaaacaaaccaaggtatccggacccgccaagcagcattggagaggggccgaaccccagagcaggtgtactattccaaccttt

SEQ ID NO: 724084 - DNA, 699 bp, Homo sapiens
  misc_feature (1)..(1): n is a, c, g, or t
  misc_feature (633)..(633): n is a, c, g, or t
  misc_feature (640)..(640): n is a, c, g, or t
  misc_feature (681)..(681): n is a, c, g, or t
ntggccgggggcggcttgtttattcacactcagactggggggcgcatttagtaccacacacgccgacaataaccacagcacaaactcacgggcttcgaaatggacattcatcttttcgtgactacagctgcagaggccatatcaattcatgcgcaggactctaaagctacactgtacctttttataacgatgacgaggggggggcaagttcaccgacgatctttttctcaggttctatggatataccactaagctccttttcaataaaagcttgctttgaaaaatatagctataagattcgcgaggtaaccaagacatgggctcatagtcacagctgtttttaaaacagatgcggagctaaagccaataccaacctggttgataactttaaactggcaaattatgacctcataacggagaaacccatttctaaatcaacaaaaaaagttacgggtgctaaagattagacaaaaacttcctggcgggccttcccacaacccagaaaaaaggggcaatttatggaccctttccctttttatagaaagacccaataattctttaagtgtgtaaacgcaaccttttatccacccccctcctcataaaacagacccctgttatttccctctattgccngaggaanaccgcgacttaccccgggcttttgaagccccaaatttaaanaaacccccccacaaccct

SEQ ID NO: 724085 - DNA, 80 bp, Homo sapiens
caggggctgaagacagtgttggagcatccacagactggtttgtctcaagaagcatgttactaaatatgaaatagcaaaaa

SEQ ID NO: 724086 - DNA, 1728 bp, Homo sapiens
  misc_feature (1728)..(1728): n is a, c, g, or t
taatttttaattttcgtggggcccatagtttattggaaaattttttttttttgtggaaagggcgggggctcctcattatgtgttcccccagaactatagaaggtgcaggggctatattctcacggggccccgctctataccgcactatacaaccttataaacctccggggcctcaagcaatttcctccgtgccctcagcccttggggaagttaccgtgggtattatcacaggtgtgccccgcccacacccgcgccgcgtggtctctgtgccgcaatatactttctctatatctcgagcctcgtgctcgagtgtgttccagtgtggtcttttctcctctccatatcacaaaaagagttctattctcactctctctctcgagtgtggaggtctcaggtctccctgtgtgacaccctcttctctgtgtgtctcaccgagccctgtgtgagagtgtgttgtgtgtgtgtctctcaccagctgtgatagacacagagagcgtgtgcgcccgctgtgtgctctctctcacacttttctctgtggccacgagcgctattctcgagggtctctcgaggctctcctatgagcccgagtgtttctctctctatatattttatctccgctctcgcgcgctgttggcccccgagagagagcgctgtggcgcgtgggggcaattctcccagtgtgtgccccgcgtgacaccccctctctctctacgaggcccccgagggggttgttagagagcctctgcggtgcccgccgttgggggagttccccccagaggagagcactcttttctcccgccggaatctggggggggagactctgtgtctcggtggggtgtgcaccaagacccccgcggggtctcccgagagtctctcttttctccgcggggtctcctcttggcccgagtataacaccctgggaggggggggtggtactacacaaaacccccgcggtggtgataagacgccctccctcgtgggggagactgtgtccgacgcggtcaacagatgtgtccccccacgggtggggtgctcccccctacaacagaagagggggcgcccaccctggggtctcatacaacgcctcgtgtgagacaaagaaaaccctcgtggtccatgacacgacttgtttggcacagcccaccgacactttttggggctggttgcggcatcaaaccacaacgcacaatgagggagcgccctatataagactatcaccccaaggggggcgccccaggaaatcattcctgattgaaggaaaaaccccacaaagccttttcccccccgaggaagggaaccgccctttaacacgagcgggaggcagccaccaaaactgggcgatgggcgacacgattgggaggcccccctctatacaaaagagagggagaaatcccccgcggggaagggaggtggcgaaccaacgataacagaagagcgcacctctggaaagagccgcccacgagtatataacacacaccgcgcggggaccacatgtctttaaccaggggaggccccagaaataagagcccgcccccaaagggggagccactacaaaagagggccccggggggcaccacgagcacgacaccgggggagggacactcacccacgaggggtctctatatagatagagacccagctggatacagtaggcccacagaaaggagcatcacggccacatcctggtcgaccgcagacaacatagtggagtgattttacacacccgcn

SEQ ID NO: 724087 - DNA, 277 bp, Homo sapiens
  misc_feature (9)..(9): n is a, c, g, or t
  misc_feature (192)..(192): n is a, c, g, or t
  misc_feature (206)..(206): n is a, c, g, or t
  misc_feature (245)..(245): n is a, c, g, or t
cggaccacnaagagagccagggctgctgtttcgcgactcaccagcacagatttgactcagaaaactctgcccaagattgggcagaagttactttaaaaagaacttggttcagctggtcaacgagtgtcacgcctgtaatcccagcactttgggaggccaagccagatggatcatgaagccaggagttcgagnccagcctgaccaanaaggtgaaaccccatctctactaaaaatacaaaaattantcagcagagacgagactctgtctcaaaaaaaa

SEQ ID NO: 724088 - DNA, 426 bp, Homo sapiens
  misc_feature (426)..(426): n is a, c, g, or t
tttttttaagagatcacgtttagggcacttgtaataacagtaaagtttgaaaggtaacaaaggctgcccttggggagagactttttttatatatgtggactggagggtggcctcggccttacagggggtggaaaggatcgtgaaatagtgcacctcataatacaacacacatcatggtcttgagggaaggaaccttacttacaagttatttcaaaattgggggagagtttcaatgacaaaaatttgattattttactcgggccacgttaacatccacaggtgataacaccaacgcatttacataaacactgtgtaccatctgctgatatagtccagaaaacaaaactgtaaaccagtattccttctcgaaatctataggctcaagcaggacaatcgcttgaacttgggagactgaactcgcagtgn

SEQ ID NO: 724089 - DNA, 124 bp, Homo sapiens
gggaaaacaagaagatgtcccagccaggtcaccctccccaaaaactcctacaccctccactccagggacacgcagcccaacactcctgcacctgtcccacctgctgaagatgggataaaaatag

SEQ ID NO: 724090 - DNA, 81 bp, Homo sapiens
gccgaggacacggctgtatattactgtgtgagaggggactattggacgggcccacaaggagttgactactggggccaggga

SEQ ID NO: 724091 - DNA, 400 bp, Homo sapiens
  misc_feature (168)..(168): n is a, c, g, or t
gggatttgcatttctctgatgattagtgatgttgagtatgttttcatacatttgttgaccatttgtgtatcttcttttgagaaatgtttattcagatcatttgcctattttaaaatcagattgtttattttttgctgttgaaatgtttgaactccttgtctattctgnctattaacccctgtcatatgaataatttgcaaatattttctcccattctgtaggttgttttttcactctgctgattgtttcctttgctgtacagaagattgttagtttgatataatcccatttgtttgtttttgcttttgttgcctatgcttttggggtcttattagcaaaatctgtttctagaccaatgtcctgcaagttcctcccctatgttttcttcctgtagttttat

SEQ ID NO: 724092 - DNA, 297 bp, Homo sapiens
tcaaacatataaaaagtcaaatgctacaccaggactcgggctatcattattacatcattagaaataacgagtacaccttattaagattctgcaaagctagcacaatgaagatcttgccttctgaacatatctacaaacacacatacaaaaaaaccatataatttatctttacaaaaattacagccaagcaatagaaaagaaggatgttcatgatagaaatagcaacacatatgtttagtacatctatcttacaccttgaaatgctacatcttataccctgatatgccattcttgcag

SEQ ID NO: 724093 - DNA, 383 bp, Homo sapiens
ctgaaagagatccttagtatctgtattcggtagtggatgttacatacaggaacgttccggtttattcacaatgaggtgagacatctaccaggctttgagaccaagttcaatcttttcctatgaatctctatctctaaagcacgtcacagggaaaaaaagggtttaaagagaaataacttctccgggcaaaaactgaggttagcgggcctatcagctgtttcttctcactccaccactgctgctgactggaggagcagcctggaaagcagccgccctcccgcaaacaggtaaaccacattacctattcctgtggcggaggcaaatggatggtcaaacctaacggggtagtgctgaagttcggggacaaaagcccatcggggagt

SEQ ID NO: 724094 - DNA, 716 bp, Homo sapiens
  misc_feature (124)..(124): n is a, c, g, or t
  misc_feature (165)..(165): n is a, c, g, or t
  misc_feature (171)..(171): n is a, c, g, or t
gtggagaccttggcgcccctggccctctggagcaagaggcgagagaggtttccctgagagagcgtggtgtgcaaggtccccactggtcctgctggtccccgtggggccaacggtgctcccggcnacgatggtgctaagggtgatgctggtgccctggagctcccntagccnggcgcccctgccttcgggaatgcctggttggaacgtggtgcagctggtcttccagggcctaggggtgacagaggtgatgctggtcccaaaggtgctgatggctctcctggcgaagatggcgtccgtggtctgaccggccccatttggtcctccgtggtcgctgctggttgccccttgtgtgactaacgggtgacgaggtggtcccagcgggcctgcttggtcccactggagctcgtgttgccccgctggtaggacctgctgtgtgattcctggtccgccccggtcgcttgctggcttctgcctggtccccctggttgctgctacgggacaatacctggttggctagtaggggcgaatactggtgatgcctggtgcctaagccggctgatgcttggtcccgccttggccctcggctgtgatcccggctggaacccctgagcccatctggctggacttgtttggtggctccgtgagagccatgggctgctcgctgggaagcgtcgggtaccctcgtggtgcctactgggtttccactgtgtgctgca

SEQ ID NO: 724095 - DNA, 613 bp, Homo sapiens
ggggggcgaacacgccgcggtcctcgtcgatggtgagcgcagccattcaggtctggtccgtggagggtggggctgtaggggaaagttgctaaagaattaggttgagggctcttgacagacgggtttacaaaaacgaagtttaatcgaaattcgggggagtatagtggtttacgacagattgcttgtcggtttgcagaatcagacagcaagtgtggtacaaagactgcaaaatgttaagagaattcaagcaggactctgcagcaggcattgcaacagtattttaacctaagagtgaaattcaaataaagacgtgtggacatgtgaaacgcatcaggtgaaatgtgtgcctttgaaagtgggaaaaagctgccagggcggacaacgcttatttaaaggccaaaggggagaacgggcccggggttttggcattaggagggaggactccatttgttgggaaaataacaccgccgaatgatagaacggacaacgaaatagtttggggccttgtggagaatttcttgtacacgaaagtcttggtgtagacaaacttctttaacaagggaacaccatttgataggcgccgaaaaaaactctaattttttaaaagaatcac

SEQ ID NO: 724096 - DNA, 857 bp, Homo sapiens
tgcgcgaaccggttatcgctgacgtccaggtccatccggacatcctggccgcattggaccggacggccgccaccttggagtccatgggccacgtcgtcgagcagacgagtgccccgttcggcccgcgtgagtgggactcttttcggtgcgtgtgggagtgggggcggcggcgataccggtcctgtccgaacgtgaggagctcttcacacccatgtctcgttggctgcgggccgggggccgacgtcgcagcggagtcgagctggccgaggcgttggccggtatccagatggtggcccgtcaagtcgggcagcattggcagcggttcgacgtcattgttagcccgaccttggcccagcctcctttgccagttggggctttgcgggacgatgaggatccggcggccgattttgacgcccagtgtcgcttcacaccgtggaccagcttgtggaatatcaccgggcgcccggcaatgagcctgccgctgcacaacacgaggatcgatggtgtcgagctgccgatcggcatcatgattggcggtcggctgtacgacgaggccaccctgctggcactcggatgtgccctagaaaatactcgggactgcgaacgcagctgccgatgatcaaaactcccgccttacctgcggtggcagcactgacatgcctgcccacgggcccgggcgggagtttttgcatgtcgacctgtgcgcagccacggccgcgcacaatgacgtgacgtgacgaaaatcgtcacttgccgcgactgccgcacataatgatcgccccagaaccgaaacggtcctggggcgaatgtgggtcagggttgtaagtaagacctcagtccttcttcatggtgccggt

SEQ ID NO: 724097 - DNA, 390 bp, Homo sapiens
aatgatatcagaatatactactggaagtacctaaaatactcagtcaatcgagggttatctgtaaaggctaacgctgagcacaaggcaagagcaacgtcggtctctatatagaatgtgaggcatgtagaataactggcttatatcaagaattgattacaacaggtgtatacattcgcatttaatttacatagacatatatcaattgttacaaaagaaaatcgtttactttcatttccttaggaatatgagaataacagacacgttgagaagaaaattggcagatcatggaccccaaaaagaaataacagaactcattcctctctagggcctaacatcaaagctctggagtgattttaaaatgtttttaaaatcgctccaaagcctgttagg

SEQ ID NO: 724098 - DNA, 141 bp, Homo sapiens
tggcgttaagataaggcttcaagcagaaacaaaaagaggagcagaagaaactcgaggagacttaagcgaaggccgcggggaaggggcccttgcgcacaggtggaattaagaaatctggcaaaaattaagctgttccttgtg

SEQ ID NO: 724099 - DNA, 235 bp, Homo sapiens
gctgtgaggggcggtgggacccaggcatcaggagcgggatccacctgagttctcaaagaccttgtcggcccgtggcccttcctgtccggcctccagggggcacccagatctccacccatgtgcgtgaccacccgcctccccaccaatccctcagcgagattctagcagagtgggagagagccacggggccgtggggacccaaggagtgagaaaaggggctggcagacgagcaggg

SEQ ID NO: 724100 - DNA, 455 bp, Homo sapiens
  misc_feature (282)..(282): n is a, c, g, or t
tgagcgcgcggcggccgacgagatcgccgtggaccgcgacgtgccctggggcgtcgactcgctcatcaccctcgccttccaggaccagcgctacagcgtgcagaccgccgaccaccgcttcctgcgccacgacgggcgccttggttggcgccgcccctgagctcggcccactggctacacgcctggagttccgctccggcaaggtggccttccgcgactgcgagggcgttacctggcgccgtcggggcccagcggcacgctcaaggcgggcaaggccaccanaggtgcggcaaagggaccgaatgctccttgtgctctggacgcagaagctggcagcccaagggatcagtgctggcaggcggccaacgagaggaacgtgtccacgcgccaggtatggacctgtctgccaatcaggacgaggagaccggaccagcgagaacctttcccaagcctgg

SEQ ID NO: 724101 - DNA, 307 bp, Homo sapiens
  misc_feature (45)..(45): n is a, c, g, or t
gggatgactgtggtggtttgtcgctaaggaggcaacagtagggtnccaggcggcggggcacgtagagcagttagcatggatccatggttattccttaggtcatgagacagtgtcggtgcacctcatgagctgtgcatttgttgttcctgggcagtcctgtcggccagttaatccggcggctcttaggaagtaaatacggatttttttctttccttttttttttgttaaagattttatactgcgtcttgttaaagtcctagggatgtgtgtgtgtgtgtgctattaaaactgctttttctgggtggga

SEQ ID NO: 724102 - DNA, 216 bp, Homo sapiens
  misc_feature (209)..(209): n is a, c, g, or t
tgatctagacatccctaagctggtctgggtcggggatgggcaggagctgagacagcaggctgcacagcggacagttcagaggcaagggttctaggcccttgagaatccacagtgccaaacagacccagatagctacggggtttggtaccctgggcgaggccttaggacaggcagaaagtcccagaggcgagggcgatctggctgcgacnattctgt

SEQ ID NO: 724103 - DNA, 111 bp, Homo sapiens
cgactctagcaggatccccacatacttctatgtggtcctggtcaaaagtggtgcactatatagggaatagggtgcaatttgagatgcaaacagagtttcagtgaagaacaa

SEQ ID NO: 724104 - DNA, 992 bp, Homo sapiens
  misc_feature (51)..(51): n is a, c, g, or t
  misc_feature (76)..(76): n is a, c, g, or t
  misc_feature (84)..(84): n is a, c, g, or t
  misc_feature (111)..(112): n is a, c, g, or t
  misc_feature (120)..(120): n is a, c, g, or t
  misc_feature (140)..(140): n is a, c, g, or t
  misc_feature (149)..(149): n is a, c, g, or t
  misc_feature (167)..(167): n is a, c, g, or t
  misc_feature (172)..(172): n is a, c, g, or t
  misc_feature (201)..(201): n is a, c, g, or t
  misc_feature (208)..(208): n is a, c, g, or t
  misc_feature (212)..(212): n is a, c, g, or t
  misc_feature (225)..(225): n is a, c, g, or t
  misc_feature (229)..(229): n is a, c, g, or t
  misc_feature (250)..(250): n is a, c, g, or t
  misc_feature (252)..(252): n is a, c, g, or t
  misc_feature (254)..(254): n is a, c, g, or t
  misc_feature (257)..(257): n is a, c, g, or t
  misc_feature (268)..(268): n is a, c, g, or t
  misc_feature (280)..(280): n is a, c, g, or t
  misc_feature (283)..(283): n is a, c, g, or t
  misc_feature (289)..(289): n is a, c, g, or t
  misc_feature (298)..(298): n is a, c, g, or t
  misc_feature (304)..(304): n is a, c, g, or t
  misc_feature (311)..(311): n is a, c, g, or t
  misc_feature (315)..(315): n is a, c, g, or t
  misc_feature (317)..(317): n is a, c, g, or t
  misc_feature (319)..(319): n is a, c, g, or t
  misc_feature (323)..(323): n is a, c, g, or t
  misc_feature (331)..(331): n is a, c, g, or t
  misc_feature (341)..(341): n is a, c, g, or t
  misc_feature (344)..(344): n is a, c, g, or t
  misc_feature (364)..(364): n is a, c, g, or t
  misc_feature (379)..(380): n is a, c, g, or t
  misc_feature (390)..(390): n is a, c, g, or t
  misc_feature (397)..(397): n is a, c, g, or t
  misc_feature (403)..(403): n is a, c, g, or t
  misc_feature (406)..(406): n is a, c, g, or t
  misc_feature (408)..(408): n is a, c, g, or t
  misc_feature (412)..(412): n is a, c, g, or t
  misc_feature (426)..(426): n is a, c, g, or t
  misc_feature (429)..(430): n is a, c, g, or t
  misc_feature (445)..(446): n is a, c, g, or t
  misc_feature (456)..(456): n is a, c, g, or t
  misc_feature (458)..(458): n is a, c, g, or t
  misc_feature (460)..(460): n is a, c, g, or t
  misc_feature (463)..(463): n is a, c, g, or t
  misc_feature (466)..(466): n is a, c, g, or t
  misc_feature (476)..(476): n is a, c, g, or t
  misc_feature (480)..(480): n is a, c, g, or t
  misc_feature (486)..(486): n is a, c, g, or t
  misc_feature (492)..(492): n is a, c, g, or t
  misc_feature (507)..(508): n is a, c, g, or t
  misc_feature (511)..(511): n is a, c, g, or t
  misc_feature (563)..(563): n is a, c, g, or t
  misc_feature (573)..(573): n is a, c, g, or t
  misc_feature (577)..(577): n is a, c, g, or t
  misc_feature (579)..(579): n is a, c, g, or t
  misc_feature (599)..(599): n is a, c, g, or t
  misc_feature (605)..(605): n is a, c, g, or t
  misc_feature (610)..(610): n is a, c, g, or t
  misc_feature (615)..(615): n is a, c, g, or t
  misc_feature (626)..(626): n is a, c, g, or t
  misc_feature (629)..(629): n is a, c, g, or t
  misc_feature (665)..(665): n is a, c, g, or t
  misc_feature (734)..(734): n is a, c, g, or t
  misc_feature (778)..(778): n is a, c, g, or t
tctcttcataattgaccccaatggagtcatcaagcatttgagcgtcaacgntctcccagtgggccgaagcgtgaanaaaccctnccgcttggtgaaggcgttccagtatgnnaaaccaanatgaaaaagtctgcccagcnaactggacnccggattctcctacaatnaagcnaagtccagctgcttcaaaagagtactttnagaaggnaaanaagaaaataaccnatgngaatctgcaccttctaaactnananaanaaccacagttnaaacctgctttnatnattttnaagatggtnatttgnagaaggnaagnancnaatnatgcttgnattcaaaagnatnactcaaaatgttttgttttngaaattctggcaaanncctttaaaanatggtangttgcnagnanaagnaatcgtttattggnaanntcttggtggctggcnngctagtttcnananaanaanatttgcctcnaaanaacgcnactctncactcatcactcaannganacactcctctcccttaccctcaccccaccctcccctataataaactagagcnacacacaccnaacncntctcatcaacgccccccacncccccntcttnaatcnctttctattanacncaattttcttttaagctaacaaagatcataatttcnaatgattagccgtgtaactcctgcaatgaatgtttatgtgattgaagcaaatgtgaatcgtattatttnaaaagtggcagagtgacttaactgatcatgcatgatccctcatncctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatatttaaaacatttgcattttaccacc

SEQ ID NO: 724105 - DNA, 210 bp, Homo sapiens
atcaactcggtgcaggcactgctcctgtacaatatcggtgacaaggaactgaccgccggcgagttgcgcacccgaggctactatctcggctccaacgtctcctacaatctgaagaagctcgtcgagctaggcttcctcgatcatcagcgctcgcgcgtcgatcgccgctcggtgcgtatccgtctgaccccgcagggccaggaagtccgc

SEQ ID NO: 724106 - DNA, 685 bp, Homo sapiens
  misc_feature (47)..(47): n is a, c, g, or t
  misc_feature (235)..(235): n is a, c, g, or t
  misc_feature (259)..(259): n is a, c, g, or t
  misc_feature (358)..(358): n is a, c, g, or t
  misc_feature (427)..(427): n is a, c, g, or t
  misc_feature (471)..(471): n is a, c, g, or t
tgtaaacgcaagggcccatataagcgtgtattcaaaagtatccctcnaaatttttggttttgggtaattggggatgagacttttaaacatggttagttgttagtcaaagaattggtaattgataacatctggggccggcaacgctagtttctacagaacatatttcgcttatataaaaggtattcttagctcatgtctcaatgaaacacttttctttttagccttacttaattcntgcgtatattaaagtagaccaccncacattgaaagcttctgatcagcggtcctgaaattttcatctgaaatgtctttgtattaaactgatttttcttttaagctaacaaagatcataatttcnaatgattagccgtgtaactcctgcaatgaatgtttatgtgattgaagcaaatgtgaatcgtattatttnaaaagtggcagagtgacttaactgatcatgcatgatccctcatncctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatatttaaaacatttgcattttaccacc

SEQ ID NO: 724107 - DNA, 457 bp, Homo sapiens
ttttttttgagacagaatctcactccatcgcccaggctggagtgcagtggccaatcccggctcactgcaacctccacctcctgagttcaagtgattctcttgcctcagcctccacagtagctgggactacaggcacccaccaccacgcctggctaattttgtaattttagcagaggcagggcttcgccatgttggccaggttgatctcgaactcctgacctcaagtgatccaccccctttcggctcccaaaatgctgggattacaggcgtgacgaccactcccgggcttaagacacatttttatgtgaacaaaaagttacaaactacagatagaacatgattctatttgagttatttcgtgtatatacataaatatacactatataaacagggggttcagggatacaccaccccaaagtattggcacgtcgacgcgggcgcaattttagtaataata

SEQ ID NO: 724108 - DNA, 954 bp, Homo sapiens
gcgtgagaggtctgtcggatgtggccattatcatggaatgataagaccctgtgtcttgaccttgcgtcgtacctcaggagacccgcacccctgaaaatactccttggcgtgaagaagtgaccagtctctgtgaccttccttgaatccgataccgcattggaagtgaccggggagacaggagggtcatcgcatcagccagtctgctgaatggtcgtcgggtgaaagactagcggctgttacggcgtcttcgtcaacgaattcaagtattggctccgcggaacgcggccaggtcaaccactccagtggtggttccaagcaccggggacgaggccccaagggagctggaaaagcatgtgacagcgtgtgtccaggccacagtctgagtactagtctgcaatggaaccagtagggacaaccttgtaccagggttcaacatgcctgggtcacagcgctaccagtggtgttgggcgcagacagcgcaaaccggtcgacacgaatagaaccgcagggatgtgcagggatggagcgcgtggcagcggatggccactcaaaaggtggagaaaagccatacggaatattactgggggtccctgacggttggtttcccagagaaggatgcggggatggaatcccctggaatcttgggagtagtgaacaacccgggactgcgcgagcggggcgcttattcataaacaaggtactgtgaatctgggaataggtagagggtacaaggtacgcttgctataatacatgatgttccaaccaacataagaatatatcggacccagattgttaaaagtgccacgggccctcgagcctgccaataactggttactagaccccctttgttagagtccataatataataatgtaagatcaacagacacctgaatcacactgtgtgaagctagagatgatttgaaccaaaggagtgagacacgttgctcaagggcc

SEQ ID NO: 724109 - DNA, 453 bp, Homo sapiens
  misc_feature (22)..(22): n is a, c, g, or t
  misc_feature (44)..(44): n is a, c, g, or t
  misc_feature (126)..(126): n is a, c, g, or t
  misc_feature (195)..(195): n is a, c, g, or t
  misc_feature (239)..(239): n is a, c, g, or t
gctcagggaacctctcctagcntactgatctgctatataagtgngcaccccttgaagctcgatcacgtccggactcctgatgtcttgaaacgattttcttttaagctaacaaagatcataatttcnaatgattagccgtgtaactcctgcaatgaatgtttatgtgattgaagcaaatgtgaatcgtattatttnaaaagtggcagagtgacttaactgatcatgcatgatccctcatncctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatatttaaaacatttgcattttaccacc

SEQ ID NO: 724110 - DNA, 114 bp, Homo sapiens
ggtgatctaaggatccccaactggtcgagtcgagacagctgacacatgtgaacctgttctactaaaaatacaaaattagcaggtgtggtgtggcgagcctgtaatcccagctaa

SEQ ID NO: 724111 - DNA, 695 bp, Homo sapiens
ggtccatcgatccttgagtactatggctctagctagatgaacgatgatggtgttatcgtgccttctggacacaggacatatgcagaaataaactcagtagcctgagtttatctggcacaatacgtggacagagcatgagagagacggctccggctgggtaggcaggagtacaaatggcaagtacggaggcaggacgccgcagggaaggatgctcaaatattctcatgactgttccaccgcgcggaggactcggttacgagtgccaggtgggtccaagtgaggacagacgtgatgggttgagccggatcatggctcaagtcactagaggtgtcactttcgtcattcaaacggtttgccccgtggtgatccccctacgataagcacacgtacgatagtatagaggcgatagtggcaccatggagtatgcccgtagcctcgcgacacgtacatgactggttgaatctactcattcacaaggaaagcttactagctaagaggcaagaccgaatacgcattgaataggtgagctgcgcttagagggccttgacatacaataggtcctaagtacattgtgacctaccgttgcgcagggtaactttgaagtggaaccccccatggcatcgcgcagggcgttcatcaccttagggcactggttgccgtttcaccatcacacacccaagttggtggtactcttc

SEQ ID NO: 724112 - DNA, 576 bp, Homo sapiens
gtacatcgatttactcagacttacgtcttaaataggtagctaacattagctgactatctacagatgtgtgccactaaatctcatgtgccagaatagaaggttttactcgactcctatgaacacaggttaaatagcatattttgttgttgttgtttccgtgtatgctgttacagaaagttacttaggtccattcatttatccccctatatatgaaacaaaattctgctttcttacaagccccttttcagttaatctcaggtggctatcatacttaaaattgtggagaattattttcatccataaggcctgtaggaagatgcccctacctcaaaacttattgggataaagtcaaaaaagggtcatcctcttaaaggtaaaacaggaaaatataaatcaatcctagatttggaacaataatacactgtgcaatagagtctggacatgtgtggctggtgggtggagattctgcaaagccatgagtccctggaaggtaaccagcagactaattttacagtgtgacatagcttatcacaatagcggacaggaacctgggttaaaagaggactcacttgggca

SEQ ID NO: 724113 - DNA, 91 bp, Homo sapiens
tttttttttaagcaaaggagattgcctgtctaagagtcacaggggcaaactgggggcctgaaaagagtgaataacttttgtatgattccta

SEQ ID NO: 724114 - DNA, 406 bp, Homo sapiens
gactttttgggttctgtttgctcatgccttccaaaagttaactgaccacattatattacaatttaaaaatatcccatccacaatgatttgatactgtagctttggaaatattatctttaaagtatttctttacaaccaagaaaatgataaatatggagcaacattagtatttaccaaatattggccacatagagtaacagaattttagaaatgaagggggaatcaatgcttatcagttagctgcctcactttacatatattaaactaaggctcagaaatttaaatgacattgcaaggttgtagaaccagaaagggaacctaggtctcttaatttttaacttcaatgcttttggctctcagtaatgttaatatcagaattcatactggctaaaatggttaccttgac

SEQ ID NO: 724115 - DNA, 818 bp, Homo sapiens
gagatatcgacttcgcgaggtggtgtggcgcacggtcccattgccagaatgatgaggctctggtcaaggtaaaatgcattgataaggactactaccatactgcatcattagacgaatgtacattgataaacatgattgtaggatgaggaatgtgcatatagtgatcaggactatatggtctgtagcaggcgagtcataacattaaacagaccatagttccttgcgagagtgcgactgtacctcattaaatatcgatacgtggagattttccacagataaagatatgtgggatcaaaatgttgaacaactttcctgatcattataaagggaggaggaggaaaggcttttgtgcaagaggggttggatatcatgagtgatcttcagagatagcttggaagaaggcgaagatactagtaaagtatatgcttccaagatatattctttgagtagaagcaagtatcattctgaactacatgctgttgggctctcttgtgccatgtaaaactttattgttgcaacattagttcatggatattacaaagtggcgtgggggggaggtgtggatcgttgtcagatccaatgggccaaatttgcgagtggtgtacagcacacaaggtgtcatttttgcttatgcgcagaaagtgcacataggacttgttgcggtgcatgtgggttggagggttatttgctttgtccacgattccaaggaaatagtggaagaaggttccttgcgattaatcaggattcagagtaaaaggaaggaggatgtgtacagagcaaggacttgttaggcacttgaaagattttgaaaagtgggc

SEQ ID NO: 724116 - DNA, 539 bp, Homo sapiens
tcagtcggtaccatgtaacatctatgagagatatgggcttcacgactgtaggacagctgtactcagaagtcatgggctctggtgatccgccgtgcctcacctttctatcgtgctgggattacgaggcatgagccatagctgctggccctttccaattctttcatgctctttgcactaatagaggacagggtatcattatatggcccaggcgggtctcgaactcctggcgatcaaagtaatctgtgcaccgttggatcgtcccaaagtgctgggattataggcatgagccatcacacctagcgagttttgtgtaatgctgtcacgtgtatgtaccaggggaatcaaggtattgaacagattgattagcacaagggtcccaatgtgctactgacttagagccatagttaatctcttcccccatcttggccacctgataacccttcatctgtctccatctgtggtttcgtcatttcaaaaagttacacagatgaactcatggtatgtagctttccctgggtggcttatttcacttagcatag

SEQ ID NO: 724117 - DNA, 259 bp, Homo sapiens
ctttatactcgtgaggtatttgcagcttcctggttgccctgatgcacaagaaccggcggaaggaccggaatgctaggggccatgtctcttcaccattgcgcttcgccactctacgaggttccctaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtca

SEQ ID NO: 724118 - DNA, 742 bp, Homo sapiens
gggcaggttgcctggatgcctcatgagggttgcgaggcggccacacggctgagtctgggaaggaggtgaggaagcctggggagcgagaaggcctgctccagacgttgggatggtctggagtcccctccgtgcacctcagggtaagtgggatcgtagacccgcctcgcattgagcacgggaacacaagttcagagattacactcgtcaaggtctgagaaggctggagggaggatggtggatgttggtggacaggtgggcccacgagcccgggctctttgatcagtcttggtacactgagacaccagagtgtctggacactgtggtgttggcgcctgaacacaggaacaggcactcgccaccggcatagtccgccggccatgctggccacgggccgggagcatcaagccacacctatagcctcctggatggcgtcgcacaagcgaactttcgagcttttcgcgtggaccgctttgcgggaggcgaccgaattctcttgctaggtaaccattcgcttagggcgggcggtttaagttcaatggggcgctcggcttaaacccattgtgggggtaaggggacctaggacgtaggacccccaagcggtcctgtaattgatatccgccttagacaggcagaaccacgagaagtaggcaagtcctctcctggatgaagctccttccacggagtggccccccggcaaccgtatgattgtgaggaacggccacctgtgaactggaaccattcg

SEQ ID NO: 724119 - DNA, 719 bp, Homo sapiens
agaaatagcgtgaggcgggtgttctacctcaccccacacaccatgcttacatggatcaccgcgatcaacatccacatccgtgacctccaccacccaccatgtcagctgcagcttagcacacacactgttctggtactgatgctgggtctgctgcataggattaagctgctgggggatgtctaaaggcaggaccactcataaggacttaatgcgaagcccaggcgtatgcctacacgcccaaatacatatacactatgaccctgagaatgggcatcactgtgaacatggggatcatgccaaggcgcttgtcagagactctgacagtgctccatagaatgacacagactatacaggtcggagagactctttgaacgtccatgacaccgcaagatgaggactcccactgtgcaccagctggaccatccgcgactgtggctagtggtgaatggcccactgggtgctgaacatacatacactgagagaatacccacacactctgtgacgagtgtgtcgcccgcaatatgactatacacgtatcataccaagacttggcgaatgaaacacatggctaccagatacactacccaactgactaactggatctatgaatcgaagtgccaggttactggaatactaaggcttcagaatgcgcgacccatcgggaacagagagcaccgcaactctcaagacatctaagaaggctgccataacaggacgct

SEQ ID NO: 724120 - DNA, 157 bp, Homo sapiens
tgtgtggcgactctagaggtcccaacgtcagcacctcctggccctctagaacttggccaacaccacatgctgccaacacggaccaataaaaaaaaaggtgggttttttttttttttttttttttttttttttttttttttttttttttttttttttt

SEQ ID NO: 724121 - DNA, 123 bp, Homo sapiens
caaagcttgttgttgatcagattcactgtttcatcatatttattgtaaaaaattttttgttttgtaaatatgttccaacaaaatgtgattggtctaaaatatttgtaatgtatataaggttca

SEQ ID NO: 724122 - DNA, 1207 bp, Homo sapiens
gttctttatctgctctctctctcttgctttccctcttaggtatattgtgcttttcttcttccttgtgttctttcgtttcttcctctctttttttgtttgtctcctttcgtctccttgattctccctggtcctctcgtcctttgtcacgctgttttgttcccctttggtcctcctctccttgttccccctgttttctcttcaccacctttgtctccttctctttttctatcctttttctgtccacgatttctcatgctcgtgccgcaacaatgttattgtgtctggcttccccaatacctttatatttaaaatccctcttttgggtcccctttgtgactctccttaacccaatgtcgaagccccccatcctgcgtcaataaggactttccccagtactcgtgtaatatacgcgggctatggtataatactccctcacactcattctctaaccccctggccttacactttgcctaccccttgccttgtgactatccctatgagccataattatcaccagcgtccatcttgcctacgacacttaccagaccttaataatccgctccattgcataactctgtcaatctacgcccaccattaggccctctgtagtacaccacgcccattttcgatcccaaaccccctttgaagcttctcacccggccgcacaatcaattcttccataaatccgccccccggacattacaatccctccattacgtattcttgctcctagcccaactccacaatctatcgaaaacgccacactcaccacggtcgccactcactaagtcctcttctccaaggaacttcacaaacttctaactccccctaatagcctttttgaatgaactttctagccaagccttcgctatacctcgcccttacgcccccccacctatttataccctatctgggaggaaactcttctgtgtctatgtaacccaccgtttctcctgagtcacaaataatcacacttctcctaacttaccacggaactcacacacatactagtcaccagccctataactcccgtctacatatgttaccaccacacaccacatggggctcaactcacccacccaccacttaacacaccattaaaaccctcattcaccaccgaggaaaacacccctcaatgttcaaaacccctatcccccattttcctcctatccctcaaccccgacatcattaccgggttttcctctta

SEQ ID NO: 724123 - DNA, 750 bp, Homo sapiens
ggccgccgcgcgccaagttcctcagccctggctcctgcccagatgtttagggtgttggcggagcacaaaggggacagagtcatcgccgtgtcggggctaggatatgatgggtgtgttctgtagttgctgctaagcgaacgcccgttggagcttacggaggccttctgaaagacttcatctgcgtactgacttgtctgaatgggctgccaaggctgcctgtctgctggcaaagtctcaccatgaaacagttgacagtgtgagttatgggcaatgtcctgcagagttcttcagatgctatagtatttggctaaggcagtgtgggtttgctgtgtgggaatcccgaaaggagacccgcagctctcactgattaataggctctgtggtgctggtgttcagtccattgtgaagggatgtcaggaaatctgtgttaaagaagctgaagtcgtttatgtggaggaacggaaagcatgagccaagctcgctagtgtgtcagaaatgtgcgtctgggaaccaagcttggatcagatatcaaggctggaagattctttatgggtatcattcccggatcagcatgtccagctccccatggcaatgactgcagagaatcttgctgtaaaagacaggaataagcagagaagaaatgtgacaaatatgccctgcagtcacagcagagatggaaagctgttgaatgatgctgtgtactttaatgatgatactggcaccaatgtgatgtgaagagaatgataggaa

SEQ ID NO: 724124 - DNA, 186 bp, Homo sapiens
gccatctacctgcacgttatgtagtaaagtacaaaaatccagccaggtacgtggcaggcacctgtagtcccagctacttgagaggctgcggcgggagacctgcttgaacctgggaggcggaagttgcagtgagccaagatggcgccactgcactccagcctgggcgacagagtgagacgctatctc

SEQ ID NO: 724125 - DNA, 368 bp, Homo sapiens
  misc_feature (174)..(174): n is a, c, g, or t
  misc_feature (203)..(203): n is a, c, g, or t
  misc_feature (218)..(218): n is a, c, g, or t
  misc_feature (299)..(299): n is a, c, g, or t
  misc_feature (301)..(302): n is a, c, g, or t
  misc_feature (321)..(321): n is a, c, g, or t
  misc_feature (360)..(360): n is a, c, g, or t
ttttcgaaatggcttttccactagcgactcttttgtgtgattgtctggttaagttaagcagaaaaaagcacgctaccgccccaggctcaacagctacctgaatactgataacgcacttactttgacgtgctagtgtatcatttctttcgcagcaatccgacccgaatgattttnatacacaaaatatactttaatcataaaantcaaatagataaaanatagcatttcgataatgtcagtacggctatgtagatttgaaaatggggcgagtttcaatgaatcgcataaaaatacaaaananntgaagatgtagcggcagancaacggttgtaccaacagcttggccttaccggcgcacgnggtgaagc

SEQ ID NO: 724126 - DNA, 193 bp, Homo sapiens
tagaggatccttataaagcgttcaggaggcttgggattgagcacatgttcaggtcccagctgaagtcaagtgtcatctgtccctaggcccaggcatgggtatgatggggaggagaagagcggtgaagtgatagcttcgggcctggagaagtgggatgaacgtgaaagtgcgaaacaacttttaattcgaaagg

SEQ ID NO: 724127 - DNA, 160 bp, Homo sapiens
cagctcaaatagagtgcaacaaattaaagctttgtctacaagttgtagggtaaggaaagctgtaaactaatattaaaaagcttccctcaaggtcatcctccagaaatgaaattaatcaaaatgctttttcatgcgtacacattttcctacaatgcaactt

SEQ ID NO: 724128 - DNA, 166 bp, Homo sapiens
gtcgctctatcacgctcacctagtccagtaatcagatgtggggagaagttacacgcagatggacctataccctagttatccggctgcggcacaacgtgattcatacaggtgtacgcatatcagcctctcctattcccgaatctccttggctgacatcgcccagaat

SEQ ID NO: 724129 - DNA, 141 bp, Homo sapiens
ggtcgtgcttgctgctggtgcctccacgtgcgcgcctgcctgctgtcctgtgcatcgcagcgtgttccctggccagcaaagttgcctgacgtcctgcctgcctggctgcccatgtgccgttctcgctgctctgcatccagt

SEQ ID NO: 724130 - DNA, 249 bp, Homo sapiens
  misc_feature (168)..(168): n is a, c, g, or t
cccagcagagtccagccctgacgtcaagaccccaatggctaacgaagctaacccttgcccatgtgacattggtcacaaactagagtatggtggcatgggccacgaagttcaggttgagcacatcaaggcatatgtcacccggtcccccgtggatgcaggcaaagcgtngattgtcgtccaggatatatttggctggcagctgccaacaccaggtatatggctgacatgattgccagaaaatggatacac

SEQ ID NO: 724131 - DNA, 103 bp, Homo sapiens
  misc_feature (49)..(49): n is a, c, g, or t
  misc_feature (86)..(86): n is a, c, g, or t
ttctttcccactttattgaaagactacaggtagggataaaagaaaactnccaagtaacagatctgaaagtacaaaatatttttaancatgacctcccccctcc

SEQ ID NO: 724132 - DNA, 328 bp, Homo sapiens
ggggggggggaccccccccccccccccccccctttttaaggggggcccggggccccggtttgggcccccgggggggggggggggttccccccccccccccccccccccccagggggggggccggtttttttaaggggggggaaagggacccaaaattttttttttttttttttccccccggaaataagggggggtttttttttttgggcccccccccactttttttggggggggggggttttcccaaaaagggggggttttttttcccccttttttttcccccccccccggggttttttttttttttttgggtttttttggggggcca

SEQ ID NO: 724133 - DNA, 1117 bp, Homo sapiens
  misc_feature (225)..(225): n is a, c, g, or t
gctgccaatctctcgccactctgttcttccgccgctccgccgtacggcgtttctctgaccggtacgcaatggaagaagacatcgccgcgctggtcattgacgaatggctccggctatgtgctaaccgctggtttttgctgggcgtacagacgctccccgtgcccgctcgtttccttccatccgtcgtgcgtcgccccacgtacacccaccgggcgtccataggtngggccatcgtgcgcctatgaatgcgactcctgacgttgggctgaccgcaggccctagacgcacagcagtggcatcactgagcgcctgagaaggtaccgcccagttagagcattggcatctgtgctccaagcttgggacgatcatgtggagaagagatcttggtccaccacacgcttctacaatctggatgctgcgctgttgcgcccacggatggacgcaccacaggtgctagctagaccagaggccccccctgagaccccaagtgccaacagagacgtaagatgactcagtattatgttatgagaccttcatatctaccccggctcatgtacgtggtccatccaggccgtgtctgtccctctactgtcctctggtgcgcaccgactggtcattgtcactggactctggagtacggggtcacctcacgacggtgcccatctacgagggctacgcccttccccacagcctatccgtgctgtcttggacctggctggcctgggacctgaccgactacctcatgaagatcctcactgatgcgaggctacaggcttcaccaccacgagcccgagcgggcaagatcgtgcgcgactatcctggccgaatgctgtgctacgttcgccctggacttccgagcccgggagattgccctccggcgcatcctcctctcctcttggagcaagagctcacgaggctgccggatggccgaagttcatcgccatttggcaatgacgcggtcccggtgtcccggaggctcgctggtcccaaggcttcctttcctgggtattcgaatcttggcggatccccgagaacgccttttattccatctgaagttggcttgacatcccgaaagacctgtaagccaacccggtgctttggcgggccccatgttccg

SEQ ID NO: 724134 - DNA, 437 bp, Homo sapiens
  misc_feature (2)..(2): n is a, c, g, or t
  misc_feature (66)..(66): n is a, c, g, or t
  misc_feature (68)..(68): n is a, c, g, or t
  misc_feature (75)..(75): n is a, c, g, or t
  misc_feature (83)..(83): n is a, c, g, or t
  misc_feature (94)..(95): n is a, c, g, or t
  misc_feature (106)..(106): n is a, c, g, or t
  misc_feature (114)..(114): n is a, c, g, or t
  misc_feature (165)..(165): n is a, c, g, or t
  misc_feature (209)..(209): n is a, c, g, or t
  misc_feature (269)..(269): n is a, c, g, or t
  misc_feature (278)..(278): n is a, c, g, or t
  misc_feature (284)..(284): n is a, c, g, or t
  misc_feature (286)..(287): n is a, c, g, or t
  misc_feature (302)..(303): n is a, c, g, or t
  misc_feature (309)..(309): n is a, c, g, or t
  misc_feature (320)..(320): n is a, c, g, or t
  misc_feature (326)..(326): n is a, c, g, or t
cnggcacgggcacatgagcggaggtgccaatattagggtgactttccttcttacgggctatgattngncctctgnttggatgnggggctacccnnccccatgctgnactatttnggtcaaagaacctctatagaagcatctgtcttcaaaggcattccagtttgngactcaattttagaataaggcataacaaatatgttaacaaaagncatacacaaagtggtggggggggggttctataattccccacatactctgaacctaataanacaaatctnggtttngnntttaaacaattgccnngactgngatcaaaggtnaatggngggcacaacagttttgctctggttgttatctgggttttggggatttttttgctttttgtttttttacaaatacaaattaaacatgaaaaaactacttcaaaaaaactaaca

SEQ ID NO: 724135 - DNA, 563 bp, Homo sapiens
ttatgaatctcatttgtgaattggataacaacgtatacctttgaaaaaatgtgtacaacatttgaaaacaagccctttaagactgtacttaaccaatgacatcccatgaagcagaactcaggttccatagaatattaggaaaatatggcgacttggagaataagaactgtcttacttgctgggtactctgaagagtccaggatccaacggtctgctactaacgtagccttcttattgagcccagcattttgatggcgcgatcccagattcattctctacggtactaccacaattaaagagagaggttcagaatatgatcttctttattgtttacgacgataaacgatattgcttatgtataaaaaagactactaatgactaacaagcgctttaatgtgagagtaaatgctaccaagaggattgctgttaagggatactgataggatttctgtagatcacatataaagagcctattgataaaattcctacggagacgtgtgatggtgactgtaagctcatgaagcaaggaatgacaccagacagggataatcatggtattctgg

SEQ ID NO: 724136 - DNA, 339 bp, Homo sapiens
  misc_feature (55)..(55): n is a, c, g, or t
atagtttcaccgcgatatggtttggatctgtgtcctacccaaatctcatgttganttgtgatctccaacgttggaggaggggcctggtgaaagatgactgagtcatgggggcacacttcccccttgctgttcttgtgattgtgagttctcacgagatttggttgtttaaaagcatgtagcacctaccccacctctctctttctccttctccagccatataagatgtgcctgcttccccttcaccttcctccatgattgtaagtttcctgaggcctcccagccatgcttcctatacaccccgcagaactgtgagtcaattaaacctttttttttttaata

SEQ ID NO: 724137 - DNA, 1128 bp, Homo sapiens
gcgatcgattgacaaggaactggtctgttcacacttgctggcttgcgcatcaggactggactttatctcctgacctcacggtgccaagcgctgcactctgtcaagcgttaagttcggtcggcccacagcgcttgtgagagtcgctaccagggccccagcaggctgcgatcccctcgatccttccacaggtacctcaggctccgcgtggacgctagaagtaactaggcactccatagggagctactaggttagtagggcttccgttgctcgcgtccggtacctaggcgtctcggctcgtgctcgtcatgtcgtagtgcgtgaccgcagcatgctcgcgatgctaggcgctgtgtactggacctttcaattcggactagcacatcgagttcgtccatctgtctgcagtaccgagtctgaatatcgtgcctaattgcactgaaccatgcggtgttgtagcatagtcacacggccagatttgcgaattgcaaagttgttgctacttcgcgtgctggtcacgtgccgcaggacctgtccggcgtgcgccgcggacccatctggtctatcatccatccatctatctgctgcgcatgcatcgtgcgtgcggtgtcgtgcatgttccagctgcgttggcgtggtgcacatgtgtacccaaactgctcttgtgagcgattgaacattggcgccagagggccaacggacccatgactctgtgcgacggcgctgttggtagttccttgttggcctggccttattggtgatatgtagcctgtgtgtccttggacgtgcaccaccaacgatcatccaacgtacttctatcgatcgcgctggtagtgcgctccgcgtgcagaaggcgggatgattggcgtgcctcgctctactgtcgtgctggagcccgctctcgggcttgctgtctcctttggctggggggctagctttgctgggaacttgtaacagccccgcatcagaccaaagccttttactccggccaaggtaattcttgctgccccggtcctgcttgcttgccaacaaagatacgtgtaagggtgcccccgggtttccaactcctgttcctctactggcgtttggtcttaccttgggactgaagtcaagggaaggttgttgaaccca

SEQ ID NO: 724138 - DNA, 254 bp, Homo sapiens
acaggatctgcaggcgtgtcagtgtataaaaggactattaattctacagcagaatgtctagatattcaaaatattaaatggtcattctgcatgatgctggaagtcactatatttcttagaaataacttctttatgcacaatcctttaggccacggaattatgtaccttgcagacattagataactatgggcaataaccatgcttatggcctaggacagttattgcatcctatccgtttgtgtatgacaacgttg

SEQ ID NO: 724139 - DNA, 84 bp, Homo sapiens
gcggccgcctactactactactactgctcgaattcaagcttctaacgatgtacggggacatgggttatttagtttaactctggc

SEQ ID NO: 724140 - DNA, 600 bp, Homo sapiens
  misc_feature (11)..(11): n is a, c, g, or t
  misc_feature (34)..(34): n is a, c, g, or t
  misc_feature (58)..(58): n is a, c, g, or t
  misc_feature (78)..(78): n is a, c, g, or t
  misc_feature (84)..(84): n is a, c, g, or t
  misc_feature (128)..(128): n is a, c, g, or t
  misc_feature (162)..(162): n is a, c, g, or t
  misc_feature (179)..(179): n is a, c, g, or t
  misc_feature (199)..(199): n is a, c, g, or t
  misc_feature (212)..(212): n is a, c, g, or t
  misc_feature (222)..(222): n is a, c, g, or t
  misc_feature (245)..(245): n is a, c, g, or t
  misc_feature (280)..(280): n is a, c, g, or t
  misc_feature (318)..(318): n is a, c, g, or t
  misc_feature (335)..(335): n is a, c, g, or t
  misc_feature (398)..(398): n is a, c, g, or t
  misc_feature (448)..(448): n is a, c, g, or t
  misc_feature (598)..(598): n is a, c, g, or t
aagaacagtanagtttctgcccattgagctatancccttgacattgaagtgaattatnccttccgtggattccaaaantcccanatttctctgaagtgggtttcattgtgccacaaaaaagacattgntgccctgtataggaaaggaagtggctcttcaaancacccatatgtggtganttgagggcaaagctgtgganaacgctgggtcanagggttgtanaaagagtgaatcaaccctggaancatgtgatggggatcatgaggactcaggaaacaanactcctggactacagccaagaagaagttagaagtaaancctatgcggtggctganacctgtaatcccagcactttgggaggccaaggagagagcatcacttgaggccaggagttcaanaccagcttgggcaacatagggagtctttgtctctataaaaattagctgantgtggtgatgcacacgtatggtcccagctacttgggaggctgaagagggaggatcacctgtgactgggaggtcaaagctatagtgagccatgatcacgccgctgcactctaacctgggcaactgagcaagatcctgtctcaaaaacaaanaa

SEQ ID NO: 724141 - DNA, 334 bp, Homo sapiens
  misc_feature (11)..(11): n is a, c, g, or t
  misc_feature (24)..(24): n is a, c, g, or t
  misc_feature (43)..(43): n is a, c, g, or t
  misc_feature (102)..(102): n is a, c, g, or t
  misc_feature (126)..(127): n is a, c, g, or t
  misc_feature (160)..(161): n is a, c, g, or t
  misc_feature (164)..(164): n is a, c, g, or t
  misc_feature (286)..(286): n is a, c, g, or t
tttcagttagnttattacttgggncaaataccagtacacacancttcttacaatgatagagaatagacctattgcaaatgtcatcatatacaattccataanctgcataattctaaatttccccannctacaagttgaaattgaagtacttatcaccggnngancttaacaactttagtgaagagattgagagtcaaatctgccaagatgttgatgttggataagagaatctctctccccacctctaagttgccaccctcctagactacctgtggacaacctgctnagatacatcaacatggagacagcactcaagtagaatataaagaagatc

SEQ ID NO: 724142 - DNA, 412 bp, Homo sapiens
  misc_feature (7)..(7): n is a, c, g, or t
  misc_feature (97)..(97): n is a, c, g, or t
  misc_feature (99)..(99): n is a, c, g, or t
  misc_feature (140)..(140): n is a, c, g, or t
  misc_feature (146)..(146): n is a, c, g, or t
  misc_feature (151)..(151): n is a, c, g, or t
  misc_feature (174)..(174): n is a, c, g, or t
  misc_feature (212)..(212): n is a, c, g, or t
  misc_feature (258)..(258): n is a, c, g, or t
  misc_feature (273)..(273): n is a, c, g, or t
  misc_feature (289)..(289): n is a, c, g, or t
  misc_feature (326)..(326): n is a, c, g, or t
  misc_feature (379)..(380): n is a, c, g, or t
gggggcnggggggcctgcccccagcagaaacagcgggtctcggcggctacatgtgctttagggcttggctggggggcaaaggtgggggggggggggngnccggcctcttggctcggctggtcgggcgttagggggccagntgctgnccccnaatccccggcggcccccctggcnaatgggtctgtttcaaggattctgtccggctggttttnggggtggggggcacctttgggggctttatttattgggcggggggcngggggtgtggcgggntcggggggtggctgtncggccggcggcctgggcctctggcgcccctgcgtgcnggcccccggggccacctgccctctgtggcccgcgggtctccccgggtgggttnngtggggtgctctcctgccggtctcggcccctc

SEQ ID NO: 724143 - DNA, 241 bp, Homo sapiens
  misc_feature (32)..(32): n is a, c, g, or t
  misc_feature (155)..(156): n is a, c, g, or t
  misc_feature (236)..(236): n is a, c, g, or t
cacgtaatgtacacttcagcttcttatgatgntaggagtatatatttccatccatctagttgaactatcacgagtagacacttatattatcgtaatagtcactatgcctgggtttaatctaccatcttattttttaattggtccatgtgatcttnnagtccctttttcttattggctttgattaaatttgggcatttaaatgattccattctatcatataagcattgttacatatntacgg

SEQ ID NO: 724144 - DNA, 274 bp, Homo sapiens
agatcctcgtctctgttcaaaatatacaaattagccggatgtcgtggcacacacctatagttccagctactcaggaggctgaggtgggaggatggcttaatgagcctggaatggcagaggttgcagtgatgccaatgcagccaaggatcattccactgtcactccagacctggagtgacagtccacgaccctggtcccaacaaatgtatatgatactacaaaaaagttacagcgaaaaaagtgaacaacacatttaaactttagaattaaaaga

SEQ ID NO: 724145 - DNA, 143 bp, Homo sapiens
tgggacggtcctactttccacaggtatctattcactgaaatttgataaaacattaaattacaggagacattggtgtatttctttaaaaataacttctacatgacagccgctctatttttctctgagggaaaatacttcccata

SEQ ID NO: 724146 - DNA, 378 bp, Homo sapiens
  misc_feature (17)..(17): n is a, c, g, or t
  misc_feature (134)..(134): n is a, c, g, or t
  misc_feature (360)..(360): n is a, c, g, or t
ccagtttggtgattctnttctgtgtctgctgatctattggcgtgagaagctgaaagtgaccagccaacagccataactttatgtttagtgagactcataatgggtctcctgctggaagatctcccctctaagantcagtaattctagacctgcaaagtttgaagttgtaagcatgggaaacacaaattccccaaataggtccagatagtgatagagaataagacacttacttgcctacttccatttctcagcccagatattctacctatagtggacatgcccatgcaatgggctattgggtttgaggtatacattgcacggttgaaggacagtgcctcatccttgcaggggtgccctttnccagttggcaccacagct

SEQ ID NO: 724147 - DNA, 279 bp, Homo sapiens
cgcagatcaatgtagctaatgagttagttgtaggatgatgcattatgtaacgagtaaagagacttgccatgtcacgagattgacctagctattgagatactggcaatcgaatctcgggcaagtaacataccattgccaaagggaacaacgtatgttgttatgcggttcgaccgaataaagatcttggtagaatatgtaggagccaatatgagcttccaggtcccgctatgggttattggaccagagccgtgtctggtccatgtctacataagtactcaa

SEQ ID NO: 724148 - DNA, 257 bp, Homo sapiens
ccagccccgtgtgcaggaagatgaaccgctctggcctcctgccttacccggtgcccagagaccaggcttccaagcaacagccctgttccttagcactcctattcccaaaccagtgcctggactgaccaacctcaaacgagagccggagcttggagcaggaccagaactttgccaggatggccccggcaccagagggccccattgttgctgtcccgaccccaggatggggactttccactgtccgacttacccccatt

SEQ ID NO: 724149 - DNA, 104 bp, Homo sapiens
ccagtaattcattcagtagcaattacatagaatactataatattccagagaaatgaaaagagccaaagtcctcgccttaaagtagctcacaaactcatgggagg

SEQ ID NO: 724150 - DNA, 1742 bp, Homo sapiens
  misc_feature (1)..(1): n is a, c, g, or t
  misc_feature (1169)..(1169): n is a, c, g, or t
ngctatgtatgaagaatcggtggtagttgaataagacgtagtgagatgtgtcgcctccctccctcgcgtgacctccgtcagacccctctgttcgttgcccgtgccttcccccggctgacgccgcgggggtatccctgataaaactcgatgatactgttgtgattggtgtggttcgggtgtttgtgtgtgtttgttttgtgctgctgtgaatgtctttgtggtgttggacccaccttttgctcccgtagtatgatgagtgacgttgtttgtgtcggtgttggtgtgttggtgtgctcccccgccccgcgcgcgccccggtcgccccttgcttattgtgctgtagtgttttgccggtttttgtagtgttctcgcctggtgcgccggggcggtgtgcgtcctgactcccgtgccgtcgaagcgacgtatcccctcgaatacgcgttgggactgcggccctcgaaacaccggaggcgcgttgcgctcctagcctagtaaggtctctctcttcactgcctcctgttctgagttccgtatttgtgtctgccaatatatgtgtgtttttctccgggcctgtgtgatgtcccgtgttgcgttccccgccccctttcccatggtctttgttggtgacgggactttaccctttgtcgtgtggggggggctaaaacaaccccatccatagcggccgaaccctttccggtgggggggttggcacgcacaaacaaaaccggggggcttgtataatccatttaggtgtggagtgaccgtccctcccctctcttgggtgggccgtccgtatgtaagctaacgcttgtggttgggtgcaatcaagcgaaggcttccttgctggaaattaattaaggtactgtctctcctccctatgcgtgcccgccgagcgagccacgcatgtttgtgtgggagggcccgccaaccaaccaccaaccaaccacggacgtccttgtatctttcataccttctgggggacgacccacccccgcgggttgttgaagaccttcctgttggttccgctccttctccccaccagaactatgtgagaagtgcccccctcctcctcctcgggtggtgccttcttgtgcttctggaaagagcggcccctcatcagcggagttgtgtggccccacagcagcccccactactgttgttaataatgnggagttttctctctacacacggcagtatagggccgacacacaacacacccttctgtgacgacacaccgccctgagaggagttgtggcgttgtggggagagacaactctcactctctacacaccgcgccgcctctgcggtgggtgcttgttttcacgagaccgctctccattacactccccttcattacttcggggcttcggtggtgggctttggccacacacagagtcctccactcgacactctcacacagagttctcgcgcgagtttatatagagaggtgatacatagagtcccacatcttgtcatagagtggagactctcgagaacccacagagaattaatccagtatcccagcccacccatagagccagtaacccacccccaggtgccaccctcccctggccctggtcttgtctgtatggcccagaacatcttgttttgcctggcataacccggacacacacacctggtgcgcaatttgccccgtgacccttggcaccccctagaaatttatggccgagacctttacccaattaaaaaaaaactggcctaaaacaaaaggaaaaaataaa

SEQ ID NO: 724151 - DNA, 147 bp, Homo sapiens
gaaattatagataataatacctatgtctcctaaggatgctggtaggattagtcagtacttagtaagtatagctattattactactagtatcagaggtgtttttttgttgttttttgtttgtttgttttttaagacagagtctcactc

SEQ ID NO: 724152 - DNA, 603 bp, Homo sapiens
  misc_feature (124)..(124): n is a, c, g, or t
  misc_feature (368)..(369): n is a, c, g, or t
  misc_feature (382)..(382): n is a, c, g, or t
  misc_feature (394)..(394): n is a, c, g, or t
  misc_feature (405)..(405): n is a, c, g, or t
  misc_feature (411)..(411): n is a, c, g, or t
  misc_feature (445)..(445): n is a, c, g, or t
gggcgaggcatgtccttggtggaccatctgctctgcttgctgtgacttatgagagatcgaatgtagcctccgcatgtaactctctctaccatggcgtccggtgaggaatacgcaacagatgtgntggcgcacgccaatcaaagcgcgacaagtacgtagtgagattgtctacggatgtagtgcaaggagacgctactgaacagtgcaagacgtgtggaaataggcttcacgtgactgcttcaagctgcctgccctagtcgcaggtcatagtggacgagaacaggatcttactgctgatcatcggtatggcctgtccccggatcgctggcacgtctatgagaagcgatgattgcgcgaggcaatcgatnngcggttcgctacnagcaatgctagncccattgaatnccaagngcgaccctgtgtctgtgttgctgtagccctcgcnttgattggcttctagagcgctctcgacgataggtggaccggtgccaaggcgtcatcgcgcgtgcggagcaacgatacgtgggggtcatcttttacactttcggagtccgaggtggtgtgccaagttcctccataaagacacgaccttggacctcatct

SEQ ID NO: 724153 - DNA, 890 bp, Homo sapiens
ctcagtggtagcttaatgggaagcaggactgtatctcaccatgtgagagccgtcctctcgagatttcttgctccctccattcagggacgtttgtggagccaccccttcatatttttaaaaaaatgtatttctctgtgacctgactgtgcctgtgtggccttctttgactgtgtcattgatgtgtcttatgcatatgtgtgccatgtcacgctcctgatcactgtgtcctgcgtgatgtgtgagtgtgaatgtgaataaagcatgtgtgctgattgatgcttcatctgctctgccaccaccctgtggtgcttctatgtgtgctgcagtgtctggagccttgtggattgtgtgctctgtgccttcccctgtgcccacttgtgacttttgagaggctgaacacgattgtcgctggcattcactgcccatggcatgacattgtgactgtgaagtgatgcattggccagcactctttactgaggaccataagaacttgcagatgtgaatggcttcctcaactttatgatgacacaatcgcgcggtaacgactgcctctaatggatttattatacaatgggtaacatggtgagccatggagacttgacgtgatgtgtgacattgggctaatgggccgaagcctactactacagccctatcattgccaccccaagacaagcagccattacaagatgatttgagcccatataacgcatcccacgaacgaaactcccattgaacagcctcctttatattggacggccacattgacagggtaacctttgaagacaaaaaacaggactttacttcggcaacaagccccaggttggccactaagatgaaccccttgccaaccgtggccacctgatgtgccccttagcaatgggagaggccaa

SEQ ID NO: 724154 - DNA, 539 bp, Homo sapiens
atcatgagatagctgggtcaaatggtattactggttctagaagcatgtgacatttatcacagaggcctgaatgaaatgagataagacaaaccaagtggatatctgtggagcaatctttgcagacagaaggaaaacagatgcaaagagtactggaggcaagaatggacttgccagatgattgatgcaaggcagggactagaacagtacatctacaatttaccccacattaaccttactccaatttatgagtactttaatgaacataatgattgcttattagtccatctgtaagaatgtcaacaagatcaaagccattctataatggtaagataagtctttggctaagaaatgctactccaccatgacaatagaaattctaactatggtcctatcattgattgctatattaaaatcctttattctaaataacctcttctacttggtccagagctatgggagaaagaattcgagggtggataagcagctggctagaggcagaggctcagacagaagccgcagagctgagggctgcagcaagc

SEQ ID NO: 724155 - DNA, 272 bp, Homo sapiens
ctcgttgagcagtgtcacacagttcacattgcatgcaaatatgctgagctgcaggaaaagattgatcgccgttctggtagatagctggaagattggccttaattcttcaagttcttggtgatgctgcctttgttgatctttttcctggcaagcccatgtgtgtttagagcttctcagactatccaccttttgggtcgctttgctgtgcgtgatttgatacagcctgttgcgctgggtgtcctcactgcagtgcactacaaggctgctggagc

SEQ ID NO: 724156 - DNA, 235 bp, Homo sapiens
aaagcctgcaccatgctcgagtatttggaacgagcacagacgatttttaaagtcgtgactgggacagcccgcgggtcctcaggagatggaacgaataccaatggacagccttggatcccctatttcttcacgatcgttctgattcagagcgagaggagattgacgtggatgttgaaagcacagagttctcccatggagaagtgcgacatataagtaccaccagcatcagtgacat

SEQ ID NO: 724157 - DNA, 1595 bp, Homo sapiens
tattggttatttagttttaatttcataatcataaacttaactctgcaatccagctaggcttgggagggaacaaggaaaaacagtggaaacccaagagggaaacgtgcagcgaagaagcacaaagaatatcataggaatcacgtggcaagacaaagtgggggtgggagggggtgcctcctccgggagtctacagaagaggaagtgactcggggtggtatagagaaataaaacacagagtctcaaaccttatattctcgagttgtgctcccacgaggctcagcagagggggtgaactctttcgtgtggcgtgggctcgtgtggccatctcgcgtggacacccaaagaggcgccctccgagtgggccctcacaaaaaaaaatatcagagtagccttatctttatctcacactgtgtgtggccaaaaacacaacaacccactagagtgtctgtgtgccccaaacttccacacacccccactctcagcagtctctgtgtggggcaagagtagtgaccccagaaagtgtcaaacacacactgtggggaacacacccaatgtgtgcgtgtgttggtggggggcctctccgaggccaatatgttagtgctcagaggtgtgtagacacaaaagaaaattgtcgcggaggagagcaccccgcgtgttaagtgtcctttatatgaggagagaagtgacaagaagtttctcctctcttaatcttctctccaaaaaattgtttctcttccccccgccaatgaggagaagttgtgccgactcgtgtggaccacacccccgactgtggtgggcccacaaaataataatgtggcgggccggtgttggggtagaaaagtcttccaccacccagcgctccgttgagaagccacaacatattaataaaccgcggccggtgggagggagaataatataacctcttcggtggtgcgtggaacaacagcggcgcaggtgagaaacacccccttttattattattaaaaccacccaaaaaatctaccccattgctaatcacgctactctcccacgaaggagggggccctcacaagaagaggaacgcacgcgacaaaaaacaatatttatatccgtggggcgcggggagccacattatgtagggggcgacaccccctctgggtgttgctgttgtgggcaaaaaacagacagaggaacgcaccacacaccagcagagggagaagacaaacacgcggcgcgggcccccccacaagaggcgggggcgccatccagcgcgcggtacgtcacggcaactagctgaccacacattagtctgcttcgacaaaaaggaaaaacaccagccggcgcgtggtggtgggtggtgatgtatgaccgaccccaagagggcggcgataacacaagtagagagacacaaccacgcggggtgaatatatacccccactccgagggagaaggggaggaggccaggggaaggaaacgggccccaccactccagggtggtatatagagcctccaaactgctacggggagggcgcgggcgaaaccaaccacagaagtacacaaacactcacccgcaagcagacagcacgatactagtggcagaccaaacaacgaaagac

SEQ ID NO: 724158 - DNA, 1180 bp, Homo sapiens
ggcttgctgtggccctgtcaggaagagtagagctctggtaccatgctccgcgcagggatgggaggctgtccaccagtgccgtgcctgcgtgcagctggcagctgagtggtcttgtccaggtagtgagaccgaatgaccggtcactcgggctccagcagcatgaaattatgagcgagccgagttaagatgggttcgtgccacggtgagtcaatcgttttccgtacgtttgagcgtttgcattctgggtgacgtgacacagctgtagccagcgggaaagagccctgtgcatcaagttcttgtgcaccaccagaggtgaacggggaatagcagagggtgaagagacggacgatcgctggagcaactggagtgacagaagttggtgcaccagtgtcttggagaccgcagaacgtacagcttccctttgcaggggaactctttcttcggtgatgacaaactttcgtcaaaacagacggccaagagcagcggttgtgtcccgagtatgccagaccgcaggactgcgtctgatgcctcgtgaccgaggtttgtaaaaaagggatggatggacccgcagagcagaggaatcagacgcaattgaatgtgagcaaacaacaccccaacgtgaggggacagctagcaggtgtcacccccttgaaggtgtcctcaaagatagacgatgatacccgagagaatcggggaccgcaaggtccgcacccgaacagggcgccgagaaaaaaagaggcaaaggacagggccggaccgccatcaaagagtgaccggggccacacggccactggagcaacgttgatgaaacaagggacaccgtaacgctacatgcgagtgcggaccacaagtggggcgaacgaacaccacgggcggatacaagccacccacgcgaccaccacgacgcacacaacgaaacaagcgggacgcggcaccgcaatgatgcggtccaacgaaatgggacccggacaccacaacagaagaaataataggagaaggacagaaaaataacacacagagagggacagcggccaacgccgacaacaccacgagcaacaaagcagcgccagaaggacgcacgacaacaaccaaccggcacagagcgcaagcaacgcagcaacacagaaaggacaagcacgagcagagcaccagcacccgacacaacacacaccacaaccca

SEQ ID NO: 724159 - DNA, 318 bp, Homo sapiens
ttattttttcaagaacagcaacctaaaatactcatacagttagctctaacaatgtttacaagtcttaaaactattcctgcaaattgttgtattacataaatgttattgactcctcaaccatggttttttaaagtaatatttgttaattataaagtaagaaaatacaagccgggcatgatggcacatgcctgtagtcccatctactggggaggctgagtcaggaggattgtttgagcctggagtttgaggctacagtgagctatgatcacattattgcacgttagcctgggtaacacaatgagaccctgtctctttaac

SEQ ID NO: 724160 - DNA, 712 bp, Homo sapiens
gcttgcttgtgataaattccgcggatcccacctccagctcctgcagaggtggaaggaataggagaggcactgggtcctgaggagctgaggctgacaggctgggaacctggggccctactcatggaggtgagccgccgcggaggagctagagatcggcaagccgatgccaggatggagaggaaggacaggacacaccccagcgcatcgcgtcgagagggcgaacgggagtgagcgcggtgacagtagggggcatgggacagaggagaatcagagagtaaggcacacggagagaagaagccagagagacagagtgcagaacacacgcaagagagcacaatgcaacgggaaaatgatagcacacaatgcgagaggacagagacaagacaaacaggagagagagaaacgagaaacaaagaacaggcgcacagaagagagaagaaaggaaaacaggcaaaccacacacacaaggagacataatgagcagtggaggcaggagactccacgccacaggcaaagaagcataagcggcagggggggagtacgatccaatgagggaggacgacaagatgaggagtggagacgacaagaaagacagaagcggcacagagaaaacaaaggagcggcgttccaaggggacgggaagacaggacatggagccagtggagaggaaggggacaggtgacgcggaagggtgaagcagaaaggagacaca

SEQ ID NO: 724161 - DNA, 300 bp, Homo sapiens
  misc_feature (168)..(168): n is a, c, g, or t
  misc_feature (207)..(207): n is a, c, g, or t
  misc_feature (227)..(227): n is a, c, g, or t
  misc_feature (265)..(265): n is a, c, g, or t
  misc_feature (280)..(280): n is a, c, g, or t
  misc_feature (295)..(295): n is a, c, g, or t
acttggagaaactgcccaagtttactggaaaacccacaataatgtcatttatccagttgatggaagtaaatccttcaattttgatcgtgtccttcatggtaatgaaactcccaaaaatgtgtatgaagccaatagcagcaccaatcatccattctgccatacaaggcnccaatggtactatatttgccctatggacagactgcttcnggaaaaacatataccatgcntgggttcagaagatcatttgggagttatacccagggcnattcatgacattttnccaaaaaattaagangtttc

SEQ ID NO: 724162 - DNA, 216 bp, Homo sapiens
tctagaggatcctctagatagatccgccatagtctagaggatcgccaagtgaggaaattccaccaggaaggattcaaatatttgctttgtaccacttcctctacctcacacgagcaagccttgatcctacgcacggctaacacgaggtgacgattcgtgagtacctaatctcccagtggctgactcttgaacctgttcgttttagtagggatgttc

SEQ ID NO: 724163 - DNA, 148 bp, Homo sapiens
agtctccccacttcggagtcacagcagttcaactagacaggacgtatgcttatcaacctgggaaatacccaccagacatatcccagcttcgttctcgggaaatttgttactgtggatagttagtgtgagctttcatctatttacatgt

SEQ ID NO: 724164 - DNA, 612 bp, Homo sapiens
ggggaagaggtggttgtgaggcagacgaactcgcggttctccggcttccgaggcttccgagtagtctggagtgaagggggcgggagcaataagaagcccgccggatccggtcctcagtcgactcttctgacctccgcgcgacgtacccgccgccgcgttggctggagcatttgacattgtgcagcaatagaaatggttatggagaagccacagtccgttgcgttgtagggcgggagttgtagaggcaatattatagctttgctgaataagagctcgccggaatatgtagcacaggtttatggcaggaattcttccgtatgttcatggtggagtagatgctagtggaaagcccaggaagctgttgatgggcaaaatgatatacagcatggagtagttatctctgagacttcgagctgaatgtcataactaaaattcgtcatgtggatgctcatgcaaccttgagtgagtggagtagttgtccaggtcatgggtttgctgtctaacagtggagaatcagatggaaagtttatgcgaaacttggttctgggctgcctgaaggatctgttccaaataaatttgatgtgcacaaggatatgttgggcatgaggatga

SEQ ID NO: 724165 - DNA, 466 bp, Homo sapiens
  misc_feature (124)..(124): n is a, c, g, or t
  misc_feature (138)..(138): n is a, c, g, or t
  misc_feature (170)..(170): n is a, c, g, or t
  misc_feature (182)..(182): n is a, c, g, or t
  misc_feature (313)..(313): n is a, c, g, or t
  misc_feature (337)..(337): n is a, c, g, or t
  misc_feature (344)..(344): n is a, c, g, or t
  misc_feature (354)..(354): n is a, c, g, or t
  misc_feature (371)..(371): n is a, c, g, or t
  misc_feature (373)..(373): n is a, c, g, or t
  misc_feature (383)..(383): n is a, c, g, or t
  misc_feature (386)..(386): n is a, c, g, or t
  misc_feature (395)..(395): n is a, c, g, or t
  misc_feature (400)..(400): n is a, c, g, or t
  misc_feature (403)..(403): n is a, c, g, or t
aaggacagagacgctggctaggcgccctccccactgttaccaacatgaagctgctcgcagaactgtgctactcctcaccatctgcagccttgaaggagctttggttcggagacaggcaaagganccatgtgtggagancctggtttctcagtacttccagaccgtgactngactatggcaanggacctgatggagaaggtcaaagagcccagaagctttcaggccgaggccaagtctttacttttgaaaagttcaaaggagcagctgacacccctgatccaagaaggctggaacggaactggttaacttcttnagctatttcgtggaacttggaacncaacctnccacccagtnaagtgtccagaccattntnttccaacccnagntggccttanaacanccnctggccagtcctagagctcctgtccctacccactctttgctacaataaatgctgaatgaatcc

SEQ ID NO: 724166 - DNA, 418 bp, Homo sapiens
ctttttgtagtgtttgtatgtgaatacatttatagtctcacatttggtgcccattgtgttagacatagaacattctcaaaactatatttgaaagctgaatgtctggaagttgaacaataaacttacattataaggtcttgaaaaaaaaatatatatatatttttgagacagagttttatttccatctctcaggctggagtgcagtggtgcaatcttggctcactgcaacttcagcctcctgggctcaaaagatactcctaccttagcctcccaagtagctgggaccacaagtgcccaccagcatggccagctaattttttgtagagatggagttttgccatgttgcccaagctggtctccaactcctagagctcctgtccctacccactctttgctacaataaatgctgaatgaatcc

SEQ ID NO: 724167 - DNA, 180 bp, Homo sapiens
ggacgcgtgggtggtgttggtaatgctatcatcatttgaagactgaggtaatgagaacacgaaaggttggccaacgtgtctagtagcacacagctggtaactagttccccaatccggattctctgtcctagagctcctgtccctacccactctttgctacaataaatgctgaatgaatcc

SEQ ID NO: 724168 - DNA, 200 bp, Homo sapiens
cctgcgaagcattgaaaaatactgatccctggcaggtgtgatggctcacacttataatcccagcacttgagaggccgaggcgggtggattgcatgaggcccggcgttcgagaccagcttggacaacatggtgaacacccttctctcatcacaatcaaaaaattagccaggcatgttggcaggtgcctctcaatcccagct

SEQ ID NO: 724169 - DNA, 403 bp, Homo sapiens
ctgagtctgaccacgtacaatgaccaacaccacagggtgacttgtacaacagaccatgcctgcatagactgaagtactgcttacatcctacggttcattacctattatttcacacgctaataccggattaggacacatgagagaacaaggatcagatgttcgaacccatccctcatagaagactaagaatggtaacaaataccatagatgagaatttacctctctggactgtgcaatttatgatggactatgtgtcagcctagctttacccaacaggatacatattggctaacatcgttcatacaatcacgctcactgactctgctgagtatgtactagaggaggcctacatgctattcatgagaatgcaacagctacatgcagccaatgccgacagtgggtg

SEQ ID NO: 724170 - DNA, 181 bp, Homo sapiens
tctagatcacatgcgactgcagagtgatgagagctgtagagttttgatttgtgacagagtctgaaatgcgatcagatattgagaccgacttcaaagacataggatctataaggtcatgcatgtgtgtaacccgtgagaaataatcgcttgtcttatgtgaaccactttcctatcttgctag

SEQ ID NO: 724171 - DNA, 354 bp, Homo sapiens
ttacggacagagggacatttgaacaccatacatacttgacacttacatcgaacaagaaacggagagactgagactgtgacatgggaagggtacggaggacatcacctgactcactggagggaaggagcgggacgcgaacaaggacttggcaagcgggtaactaacttttgaggggcatttaaaacaagaaccttttgggctaatggcggcaacggctttatttttaggggacaatcggcaggggggactaccaagcctactgggaacactttcagtaccaagctctctactgacttggggcttgcgactcacaaggattgacatcgtacccaactgctaactttgggggcgggg

SEQ ID NO: 724172 - DNA, 137 bp, Homo sapiens
cacgaggtgtacctccctgctgccgctggaggacgtggggtctgtagtgccgcatgaggactgcatcactgacgtgaagaatggcctatgtgaacttcctgacccactgctatgtggacacggaggtggagatgaag

SEQ ID NO: 724173 - DNA, 333 bp, Homo sapiens
tgatgctgctggtctctctacaggatcccccttgccaagaacctcattcttgctgtcatcttaaaggatctgaatttctacttcttttttcttcttggaattatattttgtatttgtgaacaagagactattaaatattatttcaaacgtacaccttatcaaatgctaacccccactttacattcacctattttatcaacagcaatggttgagaggactcatagtacatttcttgtagaacattgcattgtatggcattgcctcaattaatcagtgagttggaggtatcagtaatctcccaatagctttttagggtgagggtctcttggctag

SEQ ID NO: 724174 - DNA, 833 bp, Homo sapiens
  misc_feature (480)..(480): n is a, c, g, or t
gagcttgggtcgcctctgaaggagaaccattttccagtctctttcatagttttttcccccagtcagcgtggtagcggtattctccgcggcagtgaccagtgaatgtgttggtctctttagccgaagacttccgccctcgatcaagatggtggttggacggcttcctaacctttacggggcctggcggtgctgacgcctgatctggtaggggtggacgcaggtatggacaaacagtcaatagtgcagaagctgctgcgcgggagctcggccactggactggaaagaagttctgcgtcggcgcctagcgacgcccaacacctgtccaaacaaaaaaaaacgtgaagcaagaagttagaacagatgagaagaaatggattaatttacaagatttattgactcggagtggaaaggaggtagaataaaaccactaagatgaattttataagatccattccccggtgagaatcataggttgtgtgnctgaagatgaggtcttactacagaaattacgagaggaatcaaatgagctggcttatcgtacgaagaaataggcagtagaactggttagatgaattgacagaattgacagaactcatggttgaggcgggagcaaacacccagatgaccacctatgatcgggaggaagcgactgactcattttccgacaccttcctgaaggtggtgagaaggctgggagcaaaggtgcagcgattttcccagcgaaggtctttggctaaaactccttcgatacagcattcatattggaagactcgccatcatgcagtcttgttatgtcctgacgacaagttgggttcatccaacaagaataggct

SEQ ID NO: 724175 - DNA, 199 bp, Homo sapiens
atagattataacaagcagcatttgccttcgactgacagacgtaaaaccgcacatggcatactcttcaatcggccgcctatgccctcgtagtagcagtcattctcatccgaaccgccctgaagcttcaccggcgcattcattctcatagatcgcccacgggcttccatcctcattactattctgcctagcaaactcaaac

SEQ ID NO: 724176 - DNA, 1128 bp, Homo sapiens
gggaggctggatgtgacggcccgttatgcagccgacggcaggatactgcaaaggcaaaaagcaggagtggacgctgtcttttgaaactgctgctctttcacttactcaggcgtcaccgagagctcagcacccaggctgaactctgtaccatgtggacagaactgggaaagctgatgcatctgtggacatgtgtaccaaagtccctggagcatcacagcttgacttatcaggaacatacccaaacactggctgccaaggaacaatattgagaattcatgacacattccaaaacacactgggactcacgaatgcgacttgcggcgactgacctgggcacaacgcccgtttaccaggcacatacgagactttcccagggcacataacggggaacaagcttcaaagacgacaggaaaccgaaggaacttggcctttcctacaagggaccattgtgcggaaataccacggagaaacattccctaagttggcaacggaggagcttatctgtttccaacgcacacggtcaacgcgaaggcagttgacacacattgctgcgtcatgcggcattatatcttacctgacgcactttcccacactttccaggcttgtcaaaagattaccttaagaaccaggcaacatttctggaccaaagttatttgggttcccaaatgagaaggacgaagcccttcggggagaaccccccgaaacttctttgtggcaaagcgtgctgaacatttgcttgacaacaaaagaggcccaccaatatgtacccactttaggcacgaccacataacgttgggggattatccacaagaggtaaattatcccgaaacacataagccaccactgccttagacacccgacatgaggcgacaaacgccgacaacgacagctaactcgctaaggtccggcggcgcttaaccttggcgcctatcaggaaaaaactccacggcattgcgcttacagcacacagaacacctttccacgcacgtgagacgacctccgggttcataccccggacgacatctttaatttcaacgcgtgcgaactttaagtgggagccagccaatttcacgcaccccgaacgcgaagttgggcacacagacgtctacacagctggcacaaaactat

SEQ ID NO: 724177 - DNA, 275 bp, Homo sapiens
  misc_feature (161)..(161): n is a, c, g, or t
acgcttctggtcatttcaggcaagatcaattctcccagacgacgaggaccagaacccaaaaatcgaaaatcatttgctatcttcatcagactgcaggcaggtagtgttcatggctccacgtgagctcaaccatgagcgtcatgagcagccatgagcttcanattttattccggagacagtgacaaataggcaatgcctgtaatgtgcagccacttttggcagcaacccttttctggcaaaggccaagttctactgtatttaaaccgttgtaccaa

SEQ ID NO: 724178 - DNA, 208 bp, Homo sapiens
  misc_feature (6)..(6): n is a, c, g, or t
  misc_feature (56)..(56): n is a, c, g, or t
  misc_feature (62)..(62): n is a, c, g, or t
  misc_feature (89)..(89): n is a, c, g, or t
  misc_feature (98)..(98): n is a, c, g, or t
  misc_feature (101)..(101): n is a, c, g, or t
  misc_feature (104)..(104): n is a, c, g, or t
  misc_feature (107)..(107): n is a, c, g, or t
  misc_feature (113)..(113): n is a, c, g, or t
  misc_feature (128)..(128): n is a, c, g, or t
  misc_feature (131)..(131): n is a, c, g, or t
  misc_feature (144)..(144): n is a, c, g, or t
  misc_feature (148)..(148): n is a, c, g, or t
taaagntccaaaacattttttaatgaaaaaatttttggcacggggaggctgggganaggctncccccaggcctggctgggtggccccantgcaggctnggnctnagngggggntaccactcacgtggnggngatggagcaggtnattnccatcctcatcctcgtgggcctcaaccacagtcactgagcgcaccagcttgcgcatggcc

SEQ ID NO: 724179 - DNA, 853 bp, Homo sapiens
agctctcaccatcgctcttctactatgaaccccccctccccatacccaatcccctggtcaactcaacctaggcctcctattatattctatggcacctcatagctctagcctgttgtactcaatcctactgatcacgtggctgaagcactcaaatcatcatagaactacgtcaccctgcatcaggacagtcactgcgagcacgatacgcccaatatcatatctcagtatgcaagttactacccgtagccatcatctcgtactatctaatcatttactaatacatgtggcttccttttatacctcatccacctctttatcgaccaacagcaaagtaactacactactggaattacttctctgtctcagtacaaatgcacccctttgggtccactaaataattgagtcttagtcattccaacaccgtatggcaaggagcacccaaagcccgagaacaccgcccctttgcagaacgctatggccggaaatgggtgagcttcactgtacatcataagctcattcaaagtgacttgtctacaccatttccgcacactaaaccgtcccaggtccacaggggcccccacattttctgacccccttactttccctatccaacttactgtcacgggacaattaaccatcacaaaaaaccaattttcactttcacttaacatttcaaaaaatctatcccactttctgaccccaacttaaccaacattgctttttcaccttatgcggatagcaaaaaccaataacttagaacttgtcaaacttacttgcaccctccattgaaaatcattccttcaacaatccaaacccaattaatatttagggtaccaaccccaatagacctccg

SEQ ID NO: 724180 - DNA, 489 bp, Homo sapiens
tcacttatatttactctctctctctttcctcctttccccacttcttacttattttttagaaatgcaatgatagtggccaggcacggtgctcatgcctgtaatcccagcactttgggaggctgaggcgggcagatcacgaggtcaggagatagagaccagcctggctaacacagtgaaacctcgtctctactaaaaatacaaaaaattagccgggcatggtggcgggcgactgtagtcccagctactcgggaggcagaggcaggagaatggcgtgaacccaggaggtggagcttgcagtgagccgagatttgccactgcactccagcctgggcgacagagcaagactctgtctcaaaaaaaaaaaaaaaaaaaaaaaaagaaatgcaatgatagccttccacctcctgttcaccagacactccctacagggcaagctcatctatccatgtgcttagaggctcagagcagaactcgcctgcaggaggccgc

SEQ ID NO: 724181 - DNA, 205 bp, Homo sapiens
catcactcggaccggtagagcggctgggtattgttgtgtttggtactgttatggtgggatgttgttggagatgataaagccagcgaagatgcttccgattaaaaggcgtttaatagagttaattagtagggggttattttcattaattaggactaggggtgggaaacgtggttgtcctgttagtaacagtatgagaccgctctta

SEQ ID NO: 724182 - DNA, 135 bp, Homo sapiens
tcagtcgcccctctttacccatagcacaggtagaaggcaggtacactggaagcaggcaggtgggtgatgggtgtgggtgcttgtggaagttacatatttattttaatatgcattaggtaaaataaccatatcaaa

SEQ ID NO: 724183 - DNA, 1967 bp, Homo sapiens
  misc_feature (39)..(39): n is a, c, g, or t
  misc_feature (64)..(64): n is a, c, g, or t
  misc_feature (930)..(930): n is a, c, g, or t
gtcatgaaatcgggtcaggagacagctcttcctggttgntccctgtatcgcgaggagcataagncttgtagtcatgtgcggagacagtgaagcctcatcacgcacgatggcagactggccccgaggaattggcagcggcgatcacacgaggaggcgactgaccgctacctcggtcacagctatctagaggactctcactcgcgcgcaaggagagaacgtcactcacagggaaggagttcgatagcacgacttgcgtacacaacgtgaccggaaccgcatgcactgtccccttggccgatcaaggtaccagagcgcgatgagaccctctgcatcgcgcgtcacgtcgcttgcgcgggatgtataccgtgacagagaacacactaaacttgttccctcaaacgctctgatagagtcggcgtcgtgtctgtagattggactttagctgggttgtcatagacctctcgggacctcatctcgcggccgtgcgcctggcgtaggtaacgacttagttaaacctatggatctcgagcgcctttgaggcctgtagaggaaagcacagacttgtacaaaaggaatatagctatagaccaggattgtcgttaggcctcggatggcggagtcatgggggcatctggtgggtagggtcctcactgggaaaggcactcttgagggacaattctttcggttggcccctccgggggtggtatattagaattccctggtaaaggttagcaaatctgcttgctggtctcaccgggcgggcacaggtaagtaataatgcgtaacccttaatttccccttggggaccaatttatactccgggttaagctgggagcgggtatacatgtgagaccgggattctaattgggggaagtctagagagacggaaaaagccaaacgttgtgtaacgctttaatccaagtattgcgnttacgtgggcccagcgcactttttttacacaggggggagctcccaattaggcgtcttccccttcggaggcaattctccaactctggagggtataacaagaagctgtgttaaaccccaaagaaaaaggccgggaaacacacaaacgcacttatgtgtcaccctccgttgcggcaggcacagttgggggtaccacctttcgtccaacaggcaaaggttcccacaaagcgacaccagggcatcgcatgagggcgataccgttagtgacctctggcggtattggcaccccacaattcgcccttagggtagacgcggtccagggatagcacgactaattgtaaacaacacgtaccctattggataactttgtgcacccattaggtataacagggagttccgcgacatactaagagcgggcggcgcctcgatagttggtttcacaaccgacagcgatctataggagtccactatccatttaaagcagccgacccatagatgacggtttacaacgcaactatctatgattaatctggaaccgcttataacaaatttcacttaagaggttaaagaaacttggtggttgggaaaaaatttgttgttaagaaggggttacaagagagtatatattttttgagctaaagcagaaaaacgacttgcctctaatgggtagtagcagagccacattttaaccttataaagagatgtaagcgaggtgttcgaaaaacaaaatattgaaacgcgtcttcccttttcccgtcaaacacactgttgtacattacgcatcagtcatatctcatacagtgcactccacacatatgtatgttacaccgtcataaatatttgatagccggcaaagcagaccattaattaatcgaggaacagacatgcctcactagagcacgaacagtgttacacaaagtacgccagagcacacagaaggattgctggttgcagcaccagagcaagtccagctacgctcagtcagctagaaacagatgcggtacgcacacgagctaatcatgatgaccacatagcgagca

SEQ ID NO: 724184 - DNA, 946 bp, Homo sapiens
caaggtgtaactctgattcccatttcggcaaaatttgacagtaacttgtcacaatcctaagacattatcgggagcagtgtcttccataatgtataaagaacaaggtagtgatcacctaccacagtgtctgtatcaggagacagtgatctccatatgtgacagtaagggtgtaagtaatgatcgggaacagtgtttccctataatttatcttcatgcaatgacgttctacaaagcttgaagatctgttagtatctcatcgatgtatcccgaactcctatagatatcccatatcttgcagttgttagttgcagaacacatatagtggtcgattaagcatagggtgggtaaatgcaaccactgtaaaatgaaattacgtacaaaatttgaaatctagcttgggtttttggttacctttatggtttctccaggtcctctacttaatgagactagtagcatacgatttataatgtttatgctattgacacacgtcatttctagcttgtatcacattattctgtatgtagacctcctataaacttagtgcggacaagtgttaatccagaattgaccttttgacttactgctgatggactttgtctacgaaggttgggggcgtggggaaggagagtcccctgaaggtctgagacgttgactagccattcgtggtgatcgacttaatgtagttgaataggtcgaagctcgtaggaacgatcatataaaggagaccagacgttgtatagggggcgggaagggcccaagggaagaccaaggggcctccggccctaaggctgacgcaatagcggccttgggcgacccacgttaacaaggacaccccacaatgcgcgaacagcaagaggaggagacactcgtgtgcccataagtgttgtaacaaaaatggtgtacaatgaaacgacaaaacacagctgagcgtccgtcacaaattcct

SEQ ID NO: 724185 - DNA, 492 bp, Homo sapiens
  misc_feature (20)..(20): n is a, c, g, or t
  misc_feature (30)..(31): n is a, c, g, or t
  misc_feature (47)..(47): n is a, c, g, or t
  misc_feature (116)..(116): n is a, c, g, or t
  misc_feature (170)..(170): n is a, c, g, or t
  misc_feature (209)..(209): n is a, c, g, or t
  misc_feature (349)..(349): n is a, c, g, or t
gggatgacaggtgtgagccnccgcgcccgnncctgagttctatttgntgtcaagcctgaaaagagactccttttctccaccagacctctccaaactggcgagtagaatacagacantatgagaactggaggctgcaggggattctaacaatgctgagggtatggacgttnctgtttgtggttcagatttaagagacagaaggcagaagntagggatgatagctgccttccaccaggatgtgtagcgacacccagaccccgttccagtcagaaggttacgggattctctaggtcggaaccctggttgctgtgttaccactggtgccaagtagttgaggtgcattcgtggnaaagaatgccagatccacgctgcttgttgaaagcttgcccaccctcaccatgcccaagtgcccgttgtttgccattgcattatgatcaggtaatcagtagccccagagatacctgctatagctgttgagaattttacgcatat

SEQ ID NO: 724186 - DNA, 233 bp, Homo sapiens
gcgtatctagaggatcccagcactgtgcagctccttggcactttttaattaggcgttggtctttttattactgagttgtaagagttctttatatattctggattcgagacccttatcaggtacgtggttggcaaatattttctcccattctgtgggtggtgttttcgctttatcgataatgtccttagacatataataaattggtattttaaaagtgacttgattgggctgtg

SEQ ID NO: 724187 - DNA, 172 bp, Homo sapiens
tctagagttatcccctccataggtccgcaggctacgacctgaggacggctctagccaacagtcagaacaacgccaggatccctcactatgagagccacgaggaaatgaattctgccaaacaatcctgcagtgagcttggcaagcttgatttttccctctagtttatgtttcc

SEQ ID NO: 724188 - DNA, 139 bp, Homo sapiens
gggcccaaagggggggggaaaatggggggccccattgggggcctggaatttaaaagggccccccctcccccccccccccggtttatttgggtttagggcccaaaaaaatggggttttggcccaaggaaaaaccctttta

SEQ ID NO: 724189 - DNA, 1301 bp, Homo sapiens
ggctgatgtcccagcacctttcgcgggtatcattcggtttattgttgtccgacacaggttcccctccccggtgtcaaccggctgttgtgtaacagcacaatgtgttctttggggaccgctgtcccacgaagttcttcgtatccaaagtggtgtgatttccccccctggggccgaatgttctggctcataccctggggggcacccccctgggaggttgggggaccctttgtcccacaccttgggccgagaggccccttcgcgggaagcttccaggtgccccgggctggtgtgttacttctaccgggaactcttgtggggggcccccttgggctgtggcgattccctccggcaacacgtgggaacctgggccccccaccttggggggaaccctgggttttcacacgggcgctggggaaaacgccctaatttgggagtcctttttttggggcttgtgacccgaggagataaaatttcggggacccctgtgtacaacggggaaacctgggagaagctttgagttgggacccccgcacccccaataggaatgaaatggtctggccccccgaccccgacagtaaaatgggagaacaatatgggagaacacttccaccacttcccccaatttttctgagaccacgagcgctttcactgtctctctagaagaccacgccttttggggccacggctgtaatacacccacgagaaataattgttgaaatctgagagttgggaccacacccgcagaggggctcgcccaccttggagaatgttgtctttctccacagggccacttgagagcttggcacgtggagactcgtgttaaggtgcctcgtgtgtggtaccacagtccacagggcccacacccccgtgcacacatagataaccacacaaggaggcctcgccctcgcctgcgtttttggctctgtgtgtttgaaacttctttacacttcttgctgagagcttcctataatggagaaaaagcttttctttctgaactgtgagacccttcttgagaactgagatcacgagcccacctggagaattcccacgagccgaggtttggctttgctgtgcctagttgaacggccaagctcggcaatctgttgggtaaccagagtccacgaacttgggccgagagcggtccccacgcccttttcacaagttccgagaagtgtatagtcttgagaggccctggtggccgcacacttttaagcatgttggtctcctttagatggggctatttttaatgagagaaaatctgttcttttcccgccatggaaaacctttagtctcctccaagg

SEQ ID NO: 724190 - DNA, 323 bp, Homo sapiens
cccgggccgttgttgagtcttcatggataggcctgactgacaattctgtattaatgtgactgggtaagggtatgacctaatactgataggctgagtggggaaacacagcaaggcctgtccaaattcttggcctctctgtgcagcattaatcttcctccaggatatggtgcaggaccccttttggagatcctgccttgggctggtgaaaggagggcaggagaaggtcaaagagagattcttttttctaagggctgctcctgaggcctaaagtgccccaacattatgtataataagggatatgggagtcatgagctaggaaccat

SEQ ID NO: 724191 - DNA, 169 bp, Homo sapiens
tgactgtaccgaacatgggatgaagaagcaccttgctgaagggcagctgccctgtagagctagggtccccgaacatgaccatgacggaccacccacagcacagcagaaggtcgctgccctgtttccaaacagtgacacgggggtagacaacgacgcaaggtgcgtgggg

SEQ ID NO: 724192 - DNA, 92 bp, Homo sapiens
gcggccgcctactactactactgctcgaattcaagcttctaacgatgtacggggacatgctcataaaaaaaataattaaaaagttgtactgc

SEQ ID NO: 724193 - DNA, 94 bp, Homo sapiens
gtctgctcggtccgaacactgacattgaggcaggctgactgtactaaagtacgcaataacgcattatcagccaaagctggaatggccccagcag

SEQ ID NO: 724194 - DNA, 101 bp, Homo sapiens
  misc_feature (14)..(14): n is a, c, g, or t
  misc_feature (53)..(53): n is a, c, g, or t
ttcactaaatgagnagtgactacacattatctctacttttatagcagaagagnaaatgaagaaatcaaggagatataattactgagactccactgtggatc

SEQ ID NO: 724195 - DNA, 208 bp, Homo sapiens
aaggctcatctgaattccatgatttaaatttaaaaaaaaaaaaaaaggtggattggtttggaagggcgtagaaggccaaaggtggttaacagtttcggccaggtaaaaagatttaccgggccaggcgtggtggctcacgcctgaaatcctagcacttgggccgcccgagcagaacggatggcctagagtcaggagtacgaaaacagcc

SEQ ID NO: 724196 - DNA, 467 bp, Homo sapiens
ttagactgtcgatcaggtagaaatttcccacagtgaatacgaacatctccagctagggatactcctatcacttagtgcacaatcccacaacggatagaagatgacagatgagtataagagactgtccagaagcaggaggaagacgactggcagacgtgctcagaagaagacggtcccaaggaagaggactgcagtcaggactgtaaggaaagctcaacagcagatactgaggctcggagacaggaaaaccccatagaagaggcagatacacaatattaaagccatctggtatccaagcaggagtaactggaagctactttaaggagctaacacactgggagaaaggtagaaagatgggcaactaacggtcggactggtgggctacccataatgtaggtaagagtacaacaatcaagaacatcatgggcaacaagaaagtatctgagtcagccacacctggtcacaca

SEQ ID NO: 724197 - DNA, 183 bp, Homo sapiens
tgggtagagtgggtggaagagggagcggagctgagaccgaggagagaatgaccttaggggaagataaggatcgggcggggaccgagagacgaatggtgcggaaacgcggtgaagtgagggcttaactgcgggtgatggtttggggaacgggacgtggctggggtgtatactgtagacggggta

SEQ ID NO: 724198 - DNA, 102 bp, Homo sapiens
gagacgacgtgcagaaatggcacctcgaaaggggaaggaaaagagggaggaccaggtcaatcagccttggccctcaggtgcttgagggagagatgtatttgg

SEQ ID NO: 724199 - DNA, 219 bp, Homo sapiens
tcacgccactacactccagcctggtgacagagcaagactccatctcaaaaaaaaaaaatctaagcaaactatctttgagtcaaaaaaagttggataactcatctatatttgaaataatgctgtctgaatggccaacatcccaagaatgtattaaaaacagcaacctgcctaccgttttgatgacctttttccatattaaacaagttgagaacaaaaaaa

SEQ ID NO: 724200 - DNA, 164 bp, Homo sapiens
accggttagggggtttgggttttaccagggaaacttaaatccaggcttttggttaaagggggtttttcccacttaaatttaaaagccgcctttttaaaaatttccaatccaaggtttttccggattggttggttattttttaaaaaaatcctggtcagggggga

SEQ ID NO: 724201 - DNA, 108 bp, Homo sapiens
aatgatgggtcacgatggacgaggatgaatggtggtacaggcagctatataatgtttaaacttttaagatcatcgaacctacaggcagaaaagatggtagatcgtgaa

SEQ ID NO: 724202 - DNA, 130 bp, Homo sapiens
tgccagcgtcgctctagcaggatcccccgttatagcaccgtaggtaaatatgttgagcggacgctatagcggcctgtgactagctatgttcgacgtccctgtactgcttggatcagctgatatttcgatc

SEQ ID NO: 724203 - DNA, 895 bp, Homo sapiens
  misc_feature (12)..(12): n is a, c, g, or t
  misc_feature (378)..(378): n is a, c, g, or t
  misc_feature (382)..(382): n is a, c, g, or t
  misc_feature (428)..(428): n is a, c, g, or t
  misc_feature (433)..(433): n is a, c, g, or t
  misc_feature (440)..(440): n is a, c, g, or t
  misc_feature (444)..(444): n is a, c, g, or t
  misc_feature (505)..(505): n is a, c, g, or t
  misc_feature (578)..(578): n is a, c, g, or t
  misc_feature (649)..(649): n is a, c, g, or t
  misc_feature (652)..(652): n is a, c, g, or t
  misc_feature (659)..(659): n is a, c, g, or t
  misc_feature (682)..(682): n is a, c, g, or t
  misc_feature (686)..(686): n is a, c, g, or t
  misc_feature (693)..(693): n is a, c, g, or t
  misc_feature (710)..(710): n is a, c, g, or t
  misc_feature (749)..(749): n is a, c, g, or t
  misc_feature (775)..(775): n is a, c, g, or t
  misc_feature (815)..(815): n is a, c, g, or t
  misc_feature (890)..(890): n is a, c, g, or t
tattcaaaaggntcacaagcctcacatcaatttggcttcaaaaagacctcatgtcttaaaactaagtcccgtgacaatcattttgccaccggtgaaagtctcacgtcgaaaaagcctcaacataaaaaaattacctccaaaacccactgagacattctcacataaaccaggatactgcacaaacaataaagtgctttcttcaatagtgaatcttttcaatttcatccatgtctgcagcgtggagtggcttaatactgccgtgaaagtggtcctggattttcatgagcgagggcagcccacctacttcaatcatgtggaaggcaaggccttttttcccaaagcgccccgtccgccccaggcggtggagggagggctcanagtncggctcccctccttgttttacagggagaccaaagtgcacaacaatngtganccgcctnacancaatccctcgggcacaaacattagtggtgatgagaaccttctctttcccatcccgaaaccnctgaatgagggaagcgcgccgcgccacggtcagcgccccgcttaacaaagacacctggcggccatcctgtatnatctccacggtcaaccacttagcgtttcgacgagttttgcagaagaagaaggcctgaccaatggtgaagcngcnataaatnttgcacagagcttggtatttgtntttnctgttcncacacagcacgtaatantgccggatgttgttcagtgttagcccctctttgcgtaanttgataacattagggtgagggatgantcgctcagcaaagtgccaaacagagttctcaaaggttgcngaaaagaggagcatttggcattcggagggtagagctctttgaatacgaatactatgatctgagaattcttgagtntgaat

SEQ ID NO: 724204 - DNA, 154 bp, Homo sapiens
atctaagatccgttgggtgaggccaccatgctcacagttgcgctgctggatctcggggtactccagggcactcttctccagctttcctgggaggcgcacttggatctgggaactcctttggtctaacaaaaattagaattcctcaaaagttttc

SEQ ID NO: 724205 - DNA, 114 bp, Homo sapiens
cgcgcgtattcaaagtgaataatcaagatagaatctacacctagggttgcgacagttagaaaattttacataaaaataacctatcccagcaaggagaaagtaagttacctatcc

SEQ ID NO: 724206 - DNA, 112 bp, Homo sapiens
ttcaggagtaagcccagctcaagtcctacgagccctttctgcacaagtcacccagcctttcttttatcctttacttatgttacttgttctttgtgagacggagccttgctct

SEQ ID NO: 724207 - DNA, 123 bp, Homo sapiens
catgcttccagggttattagtaagtttgtgaaaacaaaaaaagcctttttggtctttttcagttatttgaaggtccagcatcctgattaatgtctgacacattaatgaatgaccagcagcagc

SEQ ID NO: 724208 - DNA, 255 bp, Homo sapiens
agccctcacttacagatctctaacaactggtgggggtcttcgctccaactcttcttccgtaggtcaaagccactaccaatctgatgtgttagggatgggttctgatcggcagaaattaatcagctcccaatggagcccatggaactaagtagggcccaagaaaaaaaacgggagctatttcacaggggctgagtttcggccaaagtttcattcctcaaaagctttaagtgagggttaaattgcgggagtaacccg

SEQ ID NO: 724209 - DNA, 928 bp, Homo sapiens
tcgcatatctattgcatggttctctttgggtgctcggaaggcgcgcgatcttttgtggtagaccttgttacgtggatgacccgggaatgtgccctggagagcctttttgtagctgaagcttattttcccgctgtgtctgtcatgtaccctacgatgtctatgtttttatatccttccgtgggtgccaagagatccgcgtaccaccacggcgcccaagtcttggcatactctaattaggaccagaattggcagactcactttgtatacagaggctcgagataaacatggggctcacactgacgacatgagagccaagtagggctgcctaagttctggcatagacatgattgtgagactgctgcttgcgcgggctataccagtcctcgtgcctactggggcctcatgaaacagttgtatgactttatgggaccaaatttgaacacgctcacttggagttacgcacttcttgaagcactcaagaaacatgaagattctgcgtattccccggaggctagatgtgtctaataacgaaagacgttcagcgacaaccaagaaagagaaaaggaacttctaacatagataatgctgattcgctgctggagcaagagactttaaagtctaaaattctgaagtacagttttatacttctgtcacaggattacattaaattgccggttcttcatagctctagaaggctgaatactgatgtttatgcttcagttgacagagtttacccaccatctgtggtttttcagttgtttattcttacatgatatcgatctacacattctgtgtaagtagatcgaccttaactccacaggacggacatgtttagagtttaaatgattaaggctaatcattctgtttagtaatgtcatatttgcaaacttttttagtttggcctttaatactacaagcctattatgta

SEQ ID NO: 724210 - DNA, 214 bp, Homo sapiens
aactcagggtgactgggtagcgggactcgagttcacgcgggctgaggcggacacttctgtggagcgaagcagtgggagcatcgagcactagagtgcggcacctgggatcccctggctccggggaggtggggcgccggaccgggcaggaggggagggggcgatgctggaagccatggcggagcccagtcccgaagatccacctccgacccttaag

SEQ ID NO: 724211 - DNA, 354 bp, Homo sapiens
gagcctgcgatatgattgagatgggggctagtttgtcatgtgagaagaagcagccggatgtcagaggggtgcctgggtaacctctgggactcagaagtgaaagggggctattcctcgttttattgctatagccactatgcgtaagacataaccgcggccgcggatatgtcttacgggattatcttctttcttggtaaaggatacatgaaacttggaaatcggaccaatatatttactgtaatacttgaaatatcaagaatagcccaattagggtttatttcaacttattttcaaatttaaaaatcatgtatttcaatcatagtccaatagtttatgcgtaagacattaccacgg

SEQ ID NO: 724212 - DNA, 331 bp, Homo sapiens
  misc_feature (88)..(88): n is a, c, g, or t
  misc_feature (90)..(90): n is a, c, g, or t
  misc_feature (212)..(212): n is a, c, g, or t
  misc_feature (311)..(311): n is a, c, g, or t
cccttagtagcggccgcccgggcaggtacgcgggcaaaaagaaaatactgtaaacaactttacatacatgatagtttaagatgaatangncaaattctagaaaaccaaaatgtcaaaactcacccaagacaaaatagataatctgaaaatcctgcaactgttaacataattgaatttataattaaaatccttccaaaaagaactatccaggnaaataaataacactagttttatacagagtcttctagaaaatggatgaggagggaatacttcctaattcatcttatgaggctgctattaccttgatatcnaaattagacaaagacagtac

SEQ ID NO: 724213 - DNA, 115 bp, Homo sapiens
ccaggaaggaaccttaacggaactattctccctggaagatgtttcttactatccatgtaatataacatagctagttgggtacttgtctgttcaagcacttatgacccctacgcct

SEQ ID NO: 724214 - DNA, 161 bp, Homo sapiens
tgtgggaagccaccgtggtgaccgcagatatgtactggtcttcgccgttgcgtgaggtttgccagtcgggactgccagttacatggcgcgttcagctgctccagcaaggaggaggtgttgagcatcttccactggtaggactttagcagctcgttgtattt

SEQ ID NO: 724215 - DNA, 864 bp, Homo sapiens
gtaccctcggtttcccgcggtgtggctattcaccgtggcacagcgtacccgtgttcgtatcacaccgggctatgtttcccgccttgtggtctcggcggtggtatccttgctcccctgtccgtggcacctgagaatagtgcggacgccggtagactgatattcctcttgcccggccatgtctgttctgccccccgatggtcccgtctctcgtgatgcccgagctctgagaattgggggcgcacccgggccccaaggtttcccgtgccggcgggtggttgcgccgcgtgtgcttcaccgcggcctgtccgggattggggcggtcatattttccggtcccccccacgttattcacggcggtgcctactaggtatatgacacatgcggcggatatatgctggactatagcgtagtaagtgtatttcacacgtaatgcctgatggttgatataacctagcgtgtgtccacttcagaagtacatgaggtgaatgcatagatgtatcgtaggatcttctgctgttcgagagcctcaacgtgagcccgcaccttagtgagagcccctaaatttagggatcttcaaatacgtaatctccacccctcttgatcacattctaatgcaaggctcaattaccctaggcacttttaggcaaatcttattagcttcatgtaccccaacctttgcctacctttttacatctccagagacatgttatctggatctctgattacccaaattgtgaaaccatcactttgagatttaagaactaggcccagagataagacaaaacctcactctccagtcatgactcttaatatatctttgtcacgcagcacccccccccctggacacgccggacccccttgtcc

SEQ ID NO: 724216 - DNA, 201 bp, Homo sapiens
aaggcgcacgatggcgcgtactggtgaaaaaggagagttctcccgccctcagtgttggcttcagtgtggctggagacactgctttactctggagacgctgcagttgccagtcttgcgggtcacagtggacaattggtgctcacacattacaatggcctcgtggaagccctggcccaatgccatgccaatggggaacactct

SEQ ID NO: 724217 - DNA, 552 bp, Homo sapiens
ctagtccacgctcggagccatgccgtgccaaaggtccgctggcagtcggtgcaggtcttcggacgcaagaagacagcgagcagctgtggcgcactgcacaacgcgggaatggtctcagttcaaggtgaacgggcggtccctggtagatgattgagccgcgcacagctacacgtacaagctgctggagccagttcggccttctcggcaaggggagcgatttgcgtggtgtaggacatccggtgtccgtgtaaagggtggtggtcacggtggcccacgattgatgctatccggtcagtccagtctccaaagccctggtggcctattaccatgaaatatgtggatgaggcttccaagaagggagatcacaagacatcctcatccgagtatagaccgggactcctagctgggtagcatgaccctcgtcgtctgcagagtccaaaaaagtttggaggccctgggtgcccgcgctcgctatcagaaatcctaccgataagcccatcgtgactcaaaaatcacttgtataataaacagtttttgagggatttaatagag

SEQ ID NO: 724218 - DNA, 1663 bp, Homo sapiens
  misc_feature (520)..(520): n is a, c, g, or t
tccacccagtaggtgtctttatccatactggtggacatttccccatgggggaaggggtggaaggggagggggcagggaggggctggagcgggagaacgccagggctggagtttcccctccactccaggggaagaaagaagactcgagataggagccatgcataaggataagagggaccgggggaacccatctcacatagtggtgggcgtgagaagtgccgcggggcaggtgcacttcagaacaaacgcgtgagctcctttcgtgctcgagtgacaagtgcgaattctcatagaggtgagaacaaacaaaaaccaagaaccccaagagaaacaaaagacacagaggtgtgcatatcacaaagagacacaagcgggtgcatagagtgtgtagagaagagagcggtctcatagagggcacagaccaagaacgaggggcacaaagagacacgaggggagatctcgtggagagtgtggacaccacgcgggtggccgatgtgacacgctgtggtcacccagtgtgnccccgagatgggacaccaaggggatgtgtcgcgggagacccatcaccgagtggaccctctcttgagaggagacagcgagtttctctcccgaagtgagggccctcccgaggagggggtatctcgtggggtgagagcccctaccgagacagaggggtgagtctgaaaagagggaaagacagagacaggcacgtgaaaagtagggggtagcggaacgaagacacacacagaggggggacaaaacgtccccacacaaaacaggacaggggggagcagcgacgaaatagtaggaaacaaatcattatatcatacaagaagaaggaacctcaccccataaaaaagaagggggggggggcccacccgacaagagagaggatcgcgaggacgggagcacaacacttagagagagagaagaggaaaaagctgagtgtgcagcgcacgagagaggaaatagagaaatacacaacatgagcacgacaagtcacatatactagcacgtgggggagaacacacgcggggagaaggcaggagaaaccaacgaacccactcatgcgagagaaaacagtcgcaaaaaatatacagcaaacagtagataacgaaaaatgtgaaaaacaatctggatcgaatatagcaagagtacacacacagtatcaaagagcacacggaacgattacccaagacgcccaactgaggggagaccaccaaacaaagataccacaacgagcaccacgaggacataacaccaaagatgagatggacgaacaacgaaaagcgacgcagtgagagagcacacggagaccaccgaccacgcgacaacaccagggggaagaagagaagactagcacaacagacagcatgcccaagaaaagaatggggcgacccaataaaagaaataggaacaccggagaagaaatcaaagagcagcacgcaaccagcacgacgaggacgcagaccatcagaggaaatcgcagatcgcttcagaccgatgaaccaagacacaactacacatgatgtcaaaaaagcgacacagcaacaagactgacgcagacgaacgcaacgagcgaaaggaggcaagaacgatagactaatactgacatgctcagcggagcctccggtcagccacagatgcaaaggcaagacaaacaa

SEQ ID NO: 724219 - DNA, 102 bp, Homo sapiens
gtcaccgcacgtcaacttcatggatgagctgggcagttatgccgttcattcgttggctcgcccttttgagcaaggacgatccgcacagatggccccattcga

SEQ ID NO: 724220 - DNA, 449 bp, Homo sapiens
agcggagcctgtcgctccgggggccgcggcgggcggggctccggcggggcccggcctagtcccaacaagaaaaagaatacaaacagaaaaacaaaacaaacctcaagacaaacacagaagacacacagcatcacaacacgaaaccacacgagacccagaacagcgaccacaacgaggaagcattctacagaacaaaaccaacgccggcacacacaacagaccacccaacacaacgaggcgacaaacagagacacacacacaaagccacgaacaaacaggcagaaaagacaagaaaagaaagaaagaaaccaccaaaataagcatagccactcacatcaaggagaagacagaaagcgcaacacagaacacaatagagcgaacaacatatagcaacaactacaacgagcagaaacaacaacacagagagcaagcaagagacgtaggacaga

SEQ ID NO: 724221 - DNA, 277 bp, Homo sapiens
gcggccgcctactactactactaaattagcggccgcgtcgacaacgtaatgaggatgaactgagagataatgaatgatcatgaccctggcccaagtaacaagaatgaactgtgagataaatgaatgatcatggccaaaaaacccaactacaacacaacaacaaaataaagtgattacaaaatggacaaagaacatttaaccaaagatgcaaagatgatatacaaatagccaacagatacatgggatatatgagaagatatgtagcatcgccagtcat

SEQ ID NO: 724222 - DNA, 278 bp, Homo sapiens
gccccagccggccccgaccgggtcaggagcactgctcgcctgtacatactgttgccctagcccacctggtgccgtgggagccagccccaggtgctgggggcacagcccgtccccactccgggcacgcccgcaccacccggtgtttctgcctgtgatcctggacctgcgtcctccccagccatgggaggggtgtccttccatcagaccatgcccccagatgaattttcttaaaatacgacgaaacaaactgcacctggcaaaaaaacaaaaacaaaaaa

SEQ ID NO: 724223 - DNA, 157 bp, Homo sapiens
tagcatgaaactcaaggaatcgagcgcagtggatcatgcctatcatcccagcacttatgtgatgccgaggcgggcggatcagcagttcgagacacccctggccaacatggtgaaaccccgtctctactacacatacaaatataggcacggcatggtg

SEQ ID NO: 724224 - DNA, 109 bp, Homo sapiens
gcgaccgcgtgcttgatcccacccggccatcaccgtgcccagcggcttgtccaggcccggtacgcgcggttcttgctcctggcgctcgccgtagcccaaccggggatcc

SEQ ID NO: 724225 - DNA, 481 bp, Homo sapiens
  misc_feature (426)..(426): n is a, c, g, or t
cacgaggatcgtggcgcgcatggccctggtgccgcgcaccctggaggcgcgcggactggacgccacgccgctgatccagcacaagctgcgccaggtcggtacaccggacgcgctggccgccgtggcgatcctggacaccatcctgcgcgaggaagtgggccacgtggccatcggcaaccactggtacggctggctgtgcacgcgcgacggactggaccccgtggcgcactacgccgcgctggtccagcgttacgaagccccccgcccgaagccgccgctgaacgaggcggcacgccgcgccgccggtttcagcgaggcggagatgcgctggctgcagcacggctgaatcgcctccatccgcactgccatccccgagccatcgggggttcttccctacaatgccagcagcgatacgccacgccgctnccgccagccctcgcgcctgcggggggcatccgcatcgcccggtatcccgcacacg

SEQ ID NO: 724226 - DNA, 113 bp, Homo sapiens
ttggaaggacacaaaatcagcattatcaaactgaacagtataacattaccacggctacacagagttaatgtgcattattcggcataaaggctcttgttatcccaagtaacaca

SEQ ID NO: 724227 - DNA, 198 bp, Homo sapiens
ccagtatttgtcattcttctagataaaaggatagagttgattgaagttgactatttcccttcccccagattagttaggctctgataataccccaacaagttaggcttggttaactaatttaccctgagggtagaccttcttaaaaaaaacagaaagctctggcataattcaaaaatggctccttttctcctccccctc

SEQ ID NO: 724228 - DNA, 343 bp, Homo sapiens
tcgctcagccaacccaacccatcccagccacccagctacatccccagtgtcatcatgcccatctcttccccagctggcactgcacaggcctggtgtgggcagtggcagtgtcctccattggcatctccaccaacatccagccaatcccaggcccgggccttcagccaagcagctccttgcacagcctggcatgttgggccaggtgcacacagggcatgttttcctgcctccatggcattcattgggctccaagtgttggcatggcagctgtgcaccagggggcatcctctcagcagtctgcactgccagggcatgccccaagctatggacactaggcctgtct

SEQ ID NO: 724229 - DNA, 113 bp, Homo sapiens
gacgaggattgctaggatacttcatagtgactttctcgaacctgcatccgctggaattgggtacagatgcaacatgaaagagaacgacgtcatacaagttttgaagggacacc

SEQ ID NO: 724230 - DNA, 242 bp, Homo sapiens
  misc_feature (40)..(40): n is a, c, g, or t
  misc_feature (109)..(109): n is a, c, g, or t
  misc_feature (156)..(156): n is a, c, g, or t
  misc_feature (173)..(173): n is a, c, g, or t
  misc_feature (199)..(199): n is a, c, g, or t
  misc_feature (231)..(231): n is a, c, g, or t
  misc_feature (238)..(238): n is a, c, g, or t
tgtggataagataaagaacaaaacacatgcatctaaactnctgggcaatccagctgaatgtgttaagtgtttggaattccattcttacatttaaaagtcaactggattncccagcagtttagatgcatgctcgtgccgctcgtgccgaattcggcnggggccgccctcatcanggccgtgggcgtgcggttacgcaagnaggcaagcagctaagagtccgggatccccagnctactgnctct

SEQ ID NO: 724231 - DNA, 139 bp, Homo sapiens
  misc_feature (73)..(74): n is a, c, g, or t
  misc_feature (105)..(105): n is a, c, g, or t
  misc_feature (108)..(108): n is a, c, g, or t
cctgggccactgacgctctggcctctgtgggaatcacacttggctgccctggcattgggagagggagggaggnnggaagggagggaggggctggaagatactganggnttcctttttgaaaggtttttttttattgtaa

SEQ ID NO: 724232 - DNA, 1066 bp, Homo sapiens
  misc_feature (1066)..(1066): n is a, c, g, or t
agcgcgttgtacccgaggtaaggcttcttggagtcagagcaggagccggaactgtgggcccagtaggaagagtggggcccgacggcggaggccgcgcggccagggttcgctgcagagctccacgcgagggtcctgccggaaggaaggattttctagccgctgcgcttgggccctgccgcctctccttaagtgcttgagggacgttgcaaagagcgccagtcgcgtgcggcgccagctccctgtggctcgacagcaatgcccgggggcgtcatcgggtagctgtgctaagcctcctttaataagctttttttttttttatttgaaagattcaggggtcagggctcgggttcccagggtaagagtggcatttgggcgcagatcacagctcactggcagcctcgacctcctgagctcaagcgaacttccgggctcagcctccgtgagcttccgtgagtagctgcgaatacgggcacgtgccaccagtgtccggtaattagggatatgggtaaagagtgtctcgccatgttgcccaggcgggtttcgaactccggggctcaatcagtctggatgccatcggctccaaagtgctgcgcataaacaggtcctaatatttggaccagttataaaagctaattaccagggggcatatgtctgagtcctgtggacctcagggtaaatccaactctggaggcctgtgaagggttccaagggataacgacaacgctagggtcacgacaaattgggcaactggtggacagtttgagttggaacccagtttacggggggcacttgggaccacaacctgtgcggacacccttgaaaacccaggttgtaacaccaagaaacgagaaaggggaccctacatagagagaaaaggggggagtgtataaagattgggcgcaaagggagagccaattaatgggtgccacagagggtaaacagagaggtgagcgtttaaaaagaatctggcagagtggaggagaaggaagagccccggagatagtaatggggagagggaccatattaatgtgaggagaagtatctataaaagatagatgtcgtgagn

SEQ ID NO: 724233 - DNA, 101 bp, Homo sapiens
gcggccgcctactactactactactactgctcgaattcaagcttctaacgatgtacggggacatgtaataaaggtgtttattgttttgttcccacaaaaaa

SEQ ID NO: 724234 - DNA, 266 bp, Homo sapiens
  misc_feature (170)..(170): n is a, c, g, or t
aggctcccagaagggcgaagatgcgagatgatctaaaaataccgaagaaagagaggacaaccagaattccctttggacatttgtgtaattttgtcctgcgataatgtatagtattttcttcttcttcttccttaaagacatttaagctaaaggcaactcgtacccaaatntccaagacacaaacatgacctatccaagcgcattacccacttgtggccaatcagtggccaggccaaccttggctaaatggagcagcgacagcgagg

SEQ ID NO: 724235 - DNA, 176 bp, Homo sapiens
ggctatgtaccaggctgtctcaaactccttggcctcaagcaatcctcctgcccttgcttcacaaaggtgctgggattacatgtgtgagcctctgtgctcagcctctttttttttttttttggggagagggagtccccttttgtgtggcccagccgggccggcccaagccgggccgg

SEQ ID NO: 724236 - DNA, 230 bp, Homo sapiens
cttgattcattctctgctgactagacatgatgtactaatgcttcaagctgagaatctaaatgtcgcttgactcagtaccaatataataatgctatacttgaattacttgtgaaaaccacacattttaaagattacgtgcttcttggtacaggtttgtggatgaccaggttatcgtcctgccggttaggtggtgccattctaaattaaatatatattcggcacggggagta

SEQ ID NO: 724237 - DNA, 920 bp, Homo sapiens
ggtgagaaggagatgcggtgctgctggcctgttgggggtcctgctgagtgtgcctgggcctccagtcttgtacctggaggcctctgaggaagtggagcttgagccctgcctggctcccagcctggagcagcaagagcaggagctgacagtagcccttgtggcagcctgtgcggctgtgctgtgggcgggctgagcgtggtggccactggtacaaggagggcagtcggctggcacctgctggccgtgtacggggctggaggggccgctagagattgccagcttcctacctgaggatgctggccgctacctctgcctggccatgaggctcatgatcgtcttgggattctcactttgattactggtgattccttgaacctccaggaacgatgatgaggaccccaagtcccatagggacctctcgaataggcacagttacccccagcaagcaccctactggacacacccccagcgcatggagaagaaactgcatgcagtacctgcgggggaacaccgtcaaggttccgctgttcaggtgaaggggaaaccccagggccaccattcggttggtttaggatgccagggcctttcatggggagaaccgattggaggcattcggctgcgccatcagcactggagtctcgtgatggaagagcgtggtggcctcggaccgggacatacacctgctggtagaagaacgctgtgggcagcatccgttatagtagctgtaatgtgtttgagcggtcccccgacggccaatcctgcaggcgggctccgggcacaccacagcgggtgggcagcgaggttgagctgctgggcaggttgtaaggatgccagcccacttcagggttgagcacatcgtatcacggcagaaggtcggagccagacggtcccttttaagttcttagatgaagataaagtaa

SEQ ID NO: 724238 - DNA, 100 bp, Homo sapiens
ctggctgacacggcgcgtgtcgcaatacatgaggcggtgcatggctatatgtccctgctgcctccaggaacagacctcagggtccctcagtgagggtctt

SEQ ID NO: 724239 - DNA, 1214 bp, Homo sapiens
cgggtacagtggctcatgcgttaacctcagcactttgggaagctgaggcacgtagatcacttgaggttaggagtttgaggccagcctgccaacatggtgaaaccccatctctactaaaaatacaaaaaattagccaggcgtggtggcagtcgcctgtaatcccagctacttgggaggctgaggcaggagagttgcttgaatccaggaggcggaggttgcggtgagccgagatcgtgccactgcactacagcctgggcaacgagagcaaaactccatctaaaaaataaaaataaataaaaactagagtggctttaatgtgcgagcctgaatgcaaaacgcagctcaccgcctctacctggagatcaggaaccccgggccacacagggccatacgctgggtctctgtgggatccaaagcccctgtgggttgtgttgggggacagcagctcctgggctttccccgctaactgccaccgttgcttgtgttacagcgcgttccttcacctcgggcagaataactttgcagaagcccacaggttcttcacagagatcttaaggatggatccaagaaacgcagtggtaagatccccaagctgcaggatcctccatcctctgcctttcacagacgctagaaacatacacccacacacgtctcagcaggggcctgcgcgctctctctccagtccaccagctccaggcagtggctgtggcccttaggggaagtgacccaacagggccacctaggctctgcccagcagctctgcaccacccccaggcccctaacacggcccagcacgcagcctggaatgggcgggcgtctgtcctggttgtgtgggccaaccctgggcgtgtgctcctccctaggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 724240 - DNA, 185 bp, Homo sapiens
  misc_feature (73)..(73): n is a, c, g, or t
ccgatgtgactacgcggctggggtttcaccgtgttgggcggctggtctcgactcaggtggtctgccacctcangcctcccaaagtgttgggattacaggtgtgagccactgccaggcagccatttttttttaagccactttactgtccttttttccccagcaatatatatgccgtgaaccaacga

SEQ ID NO: 724241 - DNA, 257 bp, Homo sapiens
tttggggcccccccctgtgcccccaattgtgcctggccccaaggggggggtggggggttccaaacccccaagttttccttaaaatttggccgcccccccccggcaaggggccttttttttttgcaccccctgtgggggggggccaaaccccaccctaacctgggttttccccccaaacggtttgtggggtgttttaaaaaaaattttagggtttcaaaccaaattgacccaaaaaaaaatgtttaaaactttccgga

SEQ ID NO: 724242 - DNA, 1745 bp, Homo sapiens
  misc_feature (1083)..(1083): n is a, c, g, or t
gggttcctgcatcgggcctgagcagaactaggcgcgccgcggcccggcacgcgcaggcgtacagagctgcccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactccttcactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgngcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggcaccttactgcaggcatcttacagga

SEQ ID NO: 724243 - DNA, 84 bp, Homo sapiens
  misc_feature (44)..(44): n is a, c, g, or t
acctccactgcgccccacctccctgcctgtgtgtgttatttcanaagggaaaagaacaaaaggaataaattttctaagctcttt

SEQ ID NO: 724244 - DNA, 274 bp, Homo sapiens
cacgagggcgggggcagcggccggaaacggatctcccggttgcgggaagcgggcctcactcggtcccaggacaataaattttctctatttcatcaccaaaactcgctttaccccggggaacgccccccacaggattcttccaatccctgcgtggggacggtaacaggtacgttcacccagacatagcctatggcagcaccacgcacgccttcaagttccaacatggagtgattgcaacactggtctctcccgtctcaacggggtcctacattac

SEQ ID NO: 724245 - DNA, 228 bp, Homo sapiens
ggggggccccccccttttttccccagataaaagggggaattaaaaagggggggcctggggggttggggcccctttttccaaaaagggcccccccgggccccctgggggtggaaaaggcccccccgggaaggggggggggggggggttttctttttttttacccccgggttttcttcccccaagggggccccttttttcccctttaataaaccccccccttttttggga

SEQ ID NO: 724246 - DNA, 1438 bp, Homo sapiens
  misc_feature (57)..(57): n is a, c, g, or t
  misc_feature (59)..(59): n is a, c, g, or t
  misc_feature (78)..(78): n is a, c, g, or t
  misc_feature (90)..(90): n is a, c, g, or t
  misc_feature (123)..(123): n is a, c, g, or t
  misc_feature (154)..(154): n is a, c, g, or t
  misc_feature (821)..(821): n is a, c, g, or t
aagcattatattcatacttcttagaattacttcactccaacttagattccacctcanantctcttgacttgggtctanagggtcctcatnggacttgggactgagagggtcctcacttggacntgggtctgagaggatcctcacttggactggnaaagtagctgtggtgcgcaggtgcaagtccagcagccaagcacagacgaggggcctgtgcttggcattggggcagctgagcgcagggtggttctgcagtgtctgtggccagtcataggcctcggtgtcctggaccaaaggtcagagcccaaggtgatcagcaaggagaaagcctcagccactgcaggagtggtgggaagttgggataaaccagccaccccaggcaggacgaagggggacggaatgcaggaccactcaccgctatggctgagaggacctcagcaagaaccaaggtcacctctgaccgagttcccagagagcaggaacccagggcagggtggggagacgctgaggtggaagaagggaaggaagggccagggaagcgctgtgaagctgggaaagacttgagcacgttttacagaggggcacgaccccaggctccaggaggggtgcgggcaccttgaccgtctcgaccaggagggtggttttacgcacacagccacgtaccagcatccctcaggttgtacgatctgaagacatgcaggttcctgtacatcagccatagctcaacagagaccttcaaatagaaaaagaagagactgacttctggctgccagcctgagccgtggagtgtgctggctacagtcagggaaagagtggggagagcntcctccagcccctgccaccctgtgaggcctcatcatgctgatgtgacaccgaagtgcaagcaaaaagaaaatgtaggattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 724247 - DNA, 403 bp, Homo sapiens
gcggccgcctactactactaaattcgcggccgcgtcgacaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 724248 - DNA, 1131 bp, Homo sapiens
  misc_feature (22)..(22): n is a, c, g, or t
ggctagcagcaggcgctccggngcagtgctcgtaacacctcctgggctgttcgaagacagcgaccttaactcccacacccatgcggctttcatggggccaaggtcattcctgagcttgattttcagcaaggcagagcaggcaatttaccagcggagaactgtgctcacgggctctgtcatgaaccctgaagtggcagccctgctttatgcacggaccctgcagcatccccagaggtgactgtgaccccgggcactgctccgagcaggctgggtgcgggtatagattcacagccatcagtggctcaggcattccatcaggaagacgtgcagcccgcaccccggctttagcgcagccccagtgcccagtgcggggccgctgcctttgcgcttctgcgtctacgtcaggctggacgcacaaggagactcggcgtcctgttcatcctcggtagcaagcgaccgtgacgcagcctcgcactactgcaagcctcagcctcctccttaaaataagggcatagatctgagatctctgaaatccctcccagctctgacattcacacagctctctcctctccttcaacacactggataaaggaaattacggttttcaagttctgtggtttgctcagagcaggtttttcttccgctgccactcctgagatagtcccactgaggtcaggtggcccgcacaggtgctttgttctggtcctcaccctcctcccacccgcccccttcccttctccagccccctctggcttctgcagcagggcttgcccacctctgagtgggagtgaaaagtaggccctcctgctcccctgccctggtggcctcttcaccacccaaggcttggccagcaaccaggtgaccccgaagcacccggcctgacccctctgcctcccaaaacaggccattctccctgtgctgcctgtggccagccctgacacccccacctggcggtctgggcggtccacagtaggcctccacttgctgagggcattgtcagcgtcacctgaaagtcaccagcttgccggaacattcttatgcaaagacatgaagaatcaattataaattcacaggactgacgtttcactaatcatggggctaaaactccccagggaaggtaagctcctgttc

SEQ ID NO: 724249 - DNA, 963 bp, Homo sapiens
  misc_feature (57)..(57): n is a, c, g, or t
  misc_feature (59)..(59): n is a, c, g, or t
  misc_feature (78)..(78): n is a, c, g, or t
  misc_feature (90)..(90): n is a, c, g, or t
  misc_feature (123)..(123): n is a, c, g, or t
  misc_feature (154)..(154): n is a, c, g, or t
  misc_feature (821)..(821): n is a, c, g, or t
aagcattatattcatacttcttagaattacttcactccaacttagattccacctcanantctcttgacttgggtctanagggtcctcatnggacttgggactgagagggtcctcacttggacntgggtctgagaggatcctcacttggactggnaaagtagctgtggtgcgcaggtgcaagtccagcagccaagcacagacgaggggcctgtgcttggcattggggcagctgagcgcagggtggttctgcagtgtctgtggccagtcataggcctcggtgtcctggaccaaaggtcagagcccaaggtgatcagcaaggagaaagcctcagccactgcaggagtggtgggaagttgggataaaccagccaccccaggcaggacgaagggggacggaatgcaggaccactcaccgctatggctgagaggacctcagcaagaaccaaggtcacctctgaccgagttcccagagagcaggaacccagggcagggtggggagacgctgaggtggaagaagggaaggaagggccagggaagcgctgtgaagctgggaaagacttgagcacgttttacagaggggcacgaccccaggctccaggaggggtgcgggcaccttgaccgtctcgaccaggagggtggttttacgcacacagccacgtaccagcatccctcaggttgtacgatctgaagacatgcaggttcctgtacatcagccatagctcaacagagaccttcaaatagaaaaagaagagactgacttctggctgccagcctgagccgtggagtgtgctggctacagtcagggaaagagtggggagagcntcctccagcccctgccaccctgtgaggcctcatcatgctgatgtgacaccgaagtgcaagcaaaaagaaaatgtaggtaagtgggatttcaccaaaactaaaaactgttgtgctttaaaggacaccataaagaaaaaaaaaa

SEQ ID NO: 724250 - DNA, 368 bp, Homo sapiens
agcatgttgcaaagagatacatttgagtcagtgggctgggaaggcagacccagccttaatctggtggaccaatctaatcagctaccagtgaatataggcaggcagaaaaacatgaaaaggtgagactggcctagcctcgcagcctacatctttctcctgtgctggatgtttcctggcctcaaacatcagactccaagttcttcagttttgagactttgacaggctctccttgctcctcaagcttgcagacagactactgtgggaacttgtgatcatgtaatttaatatttaataaactcccctttatatatatacacatacatacatacatcctgttagttctgtccatctaggaaccctaatacgga

SEQ ID NO: 724251 - DNA, 735 bp, Homo sapiens
cggtgggtttcctgacatgcgtgataagagtgggtttgagtttggtttggcttgttttttacagttgaattctatattatttggtcaaaatattactttgcaatttgcaaatgtggtggcacctaccattttactagccacaagtaactcataagttgacgtaggccctgctcatattataccaatattttaagtattttatgtttcatcttattagttattcattttattttatctaatgctctgccagaattcattccaaaaggtaaaaattactaaactataagactcttaaataaggcgtgtatattagcaacttagtttctgacatatagaacattaacattccactgtatcttaaatgtcttttgcctttttattaaaaaatgattaaatggttactgaagttttcctctgcctgacatataaatgtcttcatattctaacatgatattagggaactaaatatatgagtatagacttaatatttcttttgtcaactaaactgactaaattttgtcaaagcagattggagacataaaaacagctgaaaagtattttcaagacgttgagaaagtaacacagaaattagatggactacagggtaaaatcatggttttgatgaacaggtaaatattttaaaactaaatatatgttttctcaaatttcccagaggcgttcaagccccacttactgagtaggaaagctccctagagaaggcgcttctccctgtat

SEQ ID NO: 724252 - DNA, 833 bp, Homo sapiens
tagaccattcttttgtggcgcgtcccgagtagttaattgttaacatggtcatagctgtgacctagtgagatcctgtcaatgatcatgctaggatctcatccaagtaaaaaagagcacggtggggagaaagtggagacgttgtggatacaaatccaagtatggagtcgtgaggtccatatagagggatctgatgtaagtagtagtccataatcaggagatcgtagatggaaatttatgtgtgtcaatgtaacagatgaattagttggttgggtgtataaaacagacaagctcaagattgtaaagaagattgagaaattccacatgtcaataatgcgaattatggtaggccaaggaagcccgcaattgtttacccattggaaaaccttgagtgaatggtttgaaatgaagaacttggtcgtgtacttaaggaagtaaatatcttttgaacttagagaaagtgttggggacagaaagtactttatgtaacctaaggtgggcttgttcaagaagcttagaggtcaattttttgtaaattttctttttaattactttaggagagctagggatgcaaattgtttcagttagaaaggcctttatttacttttgtggaaattgaacaagaaattgcatctgtcttacacactggagattattttgattgtgaggtaaaacatggtaattgttctctggccacatttgtatcagtattggaaatggaatttaggaaaaccaattcttctaattacgtatcttcttaaagacacttacttgaccatttggtcgttctggtttgggctaaattttctggtgtccctaatttattggttgggaca

SEQ ID NO: 724253 - DNA, 510 bp, Homo sapiens
  misc_feature (398)..(398): n is a, c, g, or t
  misc_feature (423)..(423): n is a, c, g, or t
  misc_feature (507)..(507): n is a, c, g, or t
aatgtgtgccaagtatgaatgcgtgctcagttatggcaaacaaactcactcagcactgattggattccaggctccatggtccccttctcgatgcgcatcttgcacgcggagcttcagcagtacctggggaacccacaggagtcgctggatagactgcacaaggtgaagactgtctgcagcaagatcctggcgctgtcattcttccctgccacggggagaacatgccctccacgccctccccacaggacatgcccgtgctgttccctgcccgtcctgccccatgcaccatccgctgcttctgccttcagaaggctaggtgaccccggtttgtgtggcctggtagtcgtggctcttgctgaaatcttttttagggatggtaagagtttctagcagagttngagtccttgtaattctttactgccntgggtactatgggaagctgaaaggcagagacatctttcttgccaaggctgccagctgaagcttcaaaggtcagtgtgccagacnagc

SEQ ID NO: 724254 - DNA, 865 bp, Homo sapiens
ggtactttccagcgaagagattgctcggctcaagggcccagctggaaaaacggtccattgaggagaagatgaggctgctgatcgataatgagaaagatagatggaggaccgtgcggcgggagaaggatgctgccgagatgctgggcgccgagatcatggccatggagacgtaagttgccttgttggaggaacaaatatatgtacgatcgatacgacatggattctatgcatgaaaaaatccttgcgaagcatgaatactggactatggtgataacttgcgacggaggcagtaaaccgtcgacgaaccgagaatgtccgagtccatcgaggactgagaaacgatcagagatgcagtgatgacctctgtgacttacatgagacatactacgctcaattggctaggcggagacggatggacattcaatggaccgatgtaaactcagttaaaagtctcttcctctcgggacttcagtgcgagtgaaagtgctgagcatccaatgagacgtctcacaggataggaaatgacagtcgagggtatacgccaggggagtctacgtagctacgcatgtctgatatgatgctcaacgcagggaaggctggaagagctcactgccattttttattcatacgatggagctattattgcactcctgggaagcactgcgaccggttcattatttgtgaagtaggatcactttccgttttgattgtaacgaagggaagtctcagtagggacagctcctgtacgtatgccctagcgatgtacgctgccaggcataatggtgaagtgctgccaggctggggtcaggggattctaagctgggccataaaagcgggagcaacaaagtcgaccttaagtacacta

SEQ ID NO: 724255 - DNA, 492 bp, Homo sapiens
aaatggtgaccagatgtctgaaggggtctcaaagatgcaagggaaccatggggtcaaaggggccacccaccacatctgatgatatgttagttttgttgttctttggggttttattcttccaggtatgttatgcactacagcctgatcttttcagtctaagacagcatggcttcactttcctgtgttatgagaaggtcacactttggaatactgaaggacaatcctgaagtgctgcagcgcatagtgaatgcctcttggtgttttcacgttcgtctgtgaggactcatagacttacagaatgatgccgaatggaatgttttgtgcatgaccttttaacctttgctattgccaattccccactgcaaaggggaaggcagattttatgaagagttttaggaataaatacattttatagaatggaaacccagtatggtactggggaagtttattcatgcttgcaatcttgtttggaaataaaatgggtccgtctgg

SEQ ID NO: 724256 - DNA, 2498 bp, Homo sapiens
  misc_feature (1083)..(1083): n is a, c, g, or t
gggttcctgcatcgggcctgagcagaactaggcgcgccgcggcccggcacgcgcaggcgtacagagctgcccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactccttcactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgngcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 724257 - DNA, 2529 bp, Homo sapiens
  misc_feature (1083)..(1083): n is a, c, g, or t
gggttcctgcatcgggcctgagcagaactaggcgcgccgcggcccggcacgcgcaggcgtacagagctgcccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactccttcactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgngcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactggaaaaaaaaaaatcgggctcggtggcctaagt

SEQ ID NO: 724258 - DNA, 227 bp, Homo sapiens
  misc_feature (209)..(209): n is a, c, g, or t
tggaattaatcctaagaggctactaatggatgaatgaataaaactaaaatgtgtcctataatgcaatggactattattcacacttaaaaaggaagaatattttgacacatgctataacatggatgaaccttgaggacattatgccagtcacaatatataaaaatattgtactgactgtactttatatgcagtacctagagtagtcaaantcatagaggtacgaaata

SEQ ID NO: 724259 - DNA, 126 bp, Homo sapiens
aggatcctcgaggctcacggaacttcatttatattactgtatgttcttttcccacatcttgttttttaatatgcaaagctttcctctcagattttcccgtccgtgcctcccaaagttccgtagaag

SEQ ID NO: 724260 - DNA, 222 bp, Homo sapiens
tgccgtctgctgaggtttatttgaatatgtgccgggcctacattgcaggccatgagctggacaggaactgggccaaaaaaggatgttgtgaggcagcagatgtgcctgtagacccagccaagaggaagaggtgctcctgctgaagccaccatgagttagagagtgcaccatgagacgctgacaggagtcaggagctgggcctgcaaaggtcggctgtgggag

SEQ ID NO: 724261 - DNA, 656 bp, Homo sapiens
tgcgcttccgagtgcgagcagcagctgcgccgggactacgtgcccgatcctgcgcagccgaggctgtgttagcgccaatggacttccagcagctgttagcagagcttgagcaggaggtggatgcggcggcagctggctggtggcaggatgtcatgcagctatgtgaaatgccctcatctgctgagttcctaccaccctggcactggcctgagtgtctactgactcactgcatggatgcagctctgtgcccccgagttcctggcctgtgactgagtacatgcgtgtccccagactgcagacctcaatgggccttctccagcggctggatgacatgtatctggatggagaagctgcatctacctgggtgcctgttttcacagcgcccttctgccaggccctgctggaagagctggagcacttcgatgcaatcggacatgcctaaggggaggcccaacaccatgaacaactacggggtgctgctgcactgagctcgggctggacgagcctgctgatgacaccactgctgggatgcgcttcctgcagcctgctgatggccctgctgtaccctgactgtggcggtgggccggctcgacagcaccgggcctttgtggtctaatactgcaccgggccatgacctggagctgggctgcactatg

SEQ ID NO: 724262 - DNA, 885 bp, Homo sapiens
ataatagtacaagtaattattatcgtatggatttgtggaaagtgggatggtgatattcctttgtgcatgcgagactattcaactatgactcgatgctggacaaacgtcactcatgctttgtctctcggtggcttcgcgattcctcattgcctatgcattcgaagtgtaacactttggctaccgccgaggttacttgctgcgaggacactgctaaccggaagactgacaggtatatagcaagcttgtccgagacccgctggctgcactaatccgcgttgctggcccaggtacagccttgtgcaagtgccgatcgcaactacataagtttgtaaagtgtctctttcatgaacagttaattggacgaaggggttctgtttttattgacggacatttctgtgtagtgtatgtagtgcgtactgtactggacctattcaatctagagcgtctccaaggggatattctgttatgtgttggtggccccgctagactgagtttacctccctgcaggggtggtgctcagggtagaccgcacaagaaggaactgcgggcaccgcgtgcggttcatgagaaaaaaactcacagacagcgttcccccgctttaacagtggtgctcccaatcgtgcactaattcccctggaaaaccggatgactgcaggactgagtgtcaggaacgggatgggtcgcttacagaggcgatgcctgtggaatgctaaagacgggggctcggaggaacaaaaatgcctacctgggctcttgcatgcgcaaaggggaccgcctgcggcctgcgacagtggattcaaaaaattgggccactaggggcactggagaaggggccctccagggcgaagggacacaattacccaacacgaaaccggaccctgatgg

SEQ ID NO: 724263 - DNA, 193 bp, Homo sapiens
  misc_feature (115)..(115): n is a, c, g, or t
ccaaactatgagaaggactgccccggtgaaccttcatgggggctggatcataatggctgtggctacaatggccggaatacagaagcagatttacaaatgaagagacagtgtcatnctgcttgagggtaatagtgggtgtcataatactctatgaccacgtacatacagtggagcattgctaaacttccaaatt

SEQ ID NO: 724264 - DNA, 136 bp, Homo sapiens
ccatgtctatagttcactgcctgtcactgatcagcatatactgactagtagccgtttagtgaacttacttcttatgtgtgctctattagtttgttgtaatggtcttcttgaaattgtgatttttcactgacagtca

SEQ ID NO: 724265 - DNA, 113 bp, Homo sapiens
  misc_feature (19)..(19): n is a, c, g, or t
  misc_feature (76)..(76): n is a, c, g, or t
  misc_feature (111)..(111): n is a, c, g, or t
gatcccttggagcaccttnatgcctggggtttctctccctaaagcttcttgcagtctaagccttatcccttatgtnccccattaaaggaatttcaaaagacatggagaaantt

SEQ ID NO: 724266 - DNA, 1182 bp, Homo sapiens
  misc_feature (1)..(1): n is a, c, g, or t
  misc_feature (357)..(357): n is a, c, g, or t
  misc_feature (360)..(360): n is a, c, g, or t
  misc_feature (441)..(441): n is a, c, g, or t
  misc_feature (457)..(457): n is a, c, g, or t
  misc_feature (534)..(534): n is a, c, g, or t
  misc_feature (545)..(545): n is a, c, g, or t
  misc_feature (579)..(579): n is a, c, g, or t
  misc_feature (631)..(631): n is a, c, g, or t
  misc_feature (642)..(642): n is a, c, g, or t
  misc_feature (701)..(701): n is a, c, g, or t
  misc_feature (722)..(722): n is a, c, g, or t
  misc_feature (778)..(778): n is a, c, g, or t
  misc_feature (860)..(860): n is a, c, g, or t
  misc_feature (865)..(865): n is a, c, g, or t
  misc_feature (890)..(890): n is a, c, g, or t
  misc_feature (944)..(944): n is a, c, g, or t
  misc_feature (1053)..(1053): n is a, c, g, or t
  misc_feature (1097)..(1097): n is a, c, g, or t
  misc_feature (1107)..(1107): n is a, c, g, or t
  misc_feature (1126)..(1126): n is a, c, g, or t
  misc_feature (1175)..(1175): n is a, c, g, or t
nttttttagttttttattaacccaggcgcataggacatgtggggccggagacgagcgggagcctcacccgacggcgacggaccatctactgctcttaactactagagagtgcgggcgcggggcggcggcgggggggccgtcgcgcaacctagcagacaggagagagaggagcggagacgagggagcaactggctaagaatacagaaagagcggcacgacaggaagagagagatagtgcagtgaagagatgatcgatataaaataaacaacaaagaacgatagaggtacagctcgctggtgggagcgatggagtgcttacataaagttatcaagagacggcgcgggccgctgtcggancangtatcgctgtatcgcgctggtgggtatctggcagcgtagacttataatttgtagaataataacatcaaaatagttcaaaangtatctatatatacanaagaaatattaaaatatagagaacatatagacgactcataacaacacagccacaaccagatacgaatagcagaaccntgcttagatcnccgccgcgcagcgcacgagtacgcaaggtacggngcgcgaccaaatctacccacacaacacacaatcacacacgacacactgatantcgactcacgntcaacatagcactatctactacatctacactctaataaccgacacctcaccacatttanctccgcacatcaccttcaccnacctactccaactatccgcgcgacaactacacgcagtgcgaaacacgcgtactatntcaataagacacgcagcgacgctgtcacacatccataccgcaccaacacatcatcaccacctacacaataatcatctaagtngatanttgtcattgtcaagcattctgaganacaacatctcgagtcagccagttgacgtcataacagcgcgcctctcccgacagnctccgatacacccaatcaccgctcacgtatattaacgacgcgtcatacaatgatatgtgaatcgcttagtacatagatgtcgcgagacaaccagttatgactatatatntgacagtgtcacgcgaaggtgtctcgatctcagcgacggctganagatgatgtngggagattacgtgtcatangactgtgcgaccgcacgcatctcgacgcgttcgaggtcagtcgtgcganatgcgag

SEQ ID NO: 724267 - DNA, 136 bp, Homo sapiens
tgagccagcctagacccagactttttccagtgccgctgtgcttcctttgtgactcagtctctcataaatcctgtaagccacaaaggaagcacagcggcactggaaaaaggctggggtgcagggtggatcctctaga

SEQ ID NO: 724268 - DNA, 227 bp, Homo sapiens
aaggatccccctagcacctctcctgtactcattactacttatagcattctccaggctaaaactctagcataattgtgcactcacggtttaataaaaactatatattctccccttccttctcctcaagtcacatgatatcatcactttgtgctgttacattgttgggagcttttaaattagacatctttccaggggtagaatggttattatggaaggttgctaagggt

SEQ ID NO: 724269 - DNA, 807 bp, Homo sapiens
atggcgggtgggaccctgtacacgtatcctgaaaactggagggccttcaggaggctctcatcgcgtgctcagtacagcggggctcaggtccaggtgtgctctccgtacacactcccacttccattttggccaaagcaaaccgatactccctggaattatcgtccgtcagaatttcctgtccggacaaggtcccagcatttgagggtgatgatggattctgtgtgttggagagcgaacgccactgtgcctactatgtgagcaatgaggagctgcggggaatgtactccagaggcagcagcccgaggtggtgcagtgggtgagctttgctgattcccgatatagtgcccccagccagtacctgggtgttccccaccttgggcttcatgcatcataagaaataggccacttgagaatgcgaaggaggaagtgaggcgaattctggggctgctggatgcttacttgaagacgaggacttgtctgggtgggcgaacgagtgacattggctgacatcactagttgtctgcaccctgttgtggctctataagcaggttctagagccttctttccgacaggcctttcccaataccaaacgctggttcctcactctgcattacccagccccagttaccgggctgtcttgggcgaaggtgaaactgtgtgagaagatggcccagtttgatgctgaaacagtttgcgagacccaactaaataggagacagccaggaaacgagaaggtccaccggaagaaaagcgaaagccaagctgaggggaaggcggggacaaaggggtgccctgtctgagaggcag

SEQ ID NO: 724270 - DNA, 341 bp, Homo sapiens
atgccctttccatttgggaccccccccagggggtttcccgtggaagggggagatttttccatttagctgggacctggggttagctcccgtgctgcctgtaatgggaaggagatgtcccccccccggccactccgggggtgccctggaagtccttgcctgcccataatttttgtttccgtccctgtttttgcccccccgagaaaaccccctgggcaaaaccgcaaggaaatgcctccttaatagccccctttagttttttttcaaggtttgttttggtccagggttatgggcccgtttcttttggtgttttggttaaccaattaaagtgggggcccctttta

SEQ ID NO: 724271 - DNA, 204 bp, Homo sapiens
  misc_feature (40)..(40): n is a, c, g, or t
  misc_feature (58)..(58): n is a, c, g, or t
  misc_feature (80)..(81): n is a, c, g, or t
  misc_feature (91)..(91): n is a, c, g, or t
  misc_feature (96)..(96): n is a, c, g, or t
  misc_feature (99)..(99): n is a, c, g, or t
  misc_feature (103)..(103): n is a, c, g, or t
gttcctgttgcagactgtgaaccaccccccgtggataggnacctcaagccagacaganaagtcaagccagcgcctttagnnataaaacctntgccngantggnagattacaagcccagttagatctccatcactaggagttttgctcgagactcttcaggtttccatgtccccccgaccagattcagtgcatagcaaacttcaa

SEQ ID NO: 724272 - DNA, 737 bp, Homo sapiens
ggtcattaggagggcctctacttaatgacctccggcctagccatgctgactcttcactctccacatccataacgctcctcatactaggcctactaaccaaacacactaaccatataccaaatgatggccgcgatgctaaccacgagaaagcacataccaaggaccagtcgacacaccaaccctgctcccaacaacaggccattcgacccagcgggactaccctccgtactgtaccccacccctcagcaacgctcacacccacctcacgccacagacccaaacacgagcagacccctcaccacccaccgtcccagaccataggcaaccaataaccgacccaaagctcaggacgggcagatagcgcccaccgaacagcgcgatacacgcccagggggaaccggtccccagctcacgaacgagccaagagcggcccctacgagacccagacagtgcacgcaacacacgcgcacgcgacacacgggaagaactccacgctccaccgaggaagcagccgcacaagagccctagggtgagacccaacgaaaaccgcgaaaacggcgaaacaccacaactcgcacgaaaacggccaacaacgaacgaacgccgccaccaggagcccccaaccaacagtaaagcccggccgctgacccaaagccgtcgcgaaaatacgcccggcggtcttgacacgcccgaggcgcagtcgtcacgcacgggcagtcgtaccgagactgcacccc

SEQ ID NO: 724273 - DNA, 723 bp, Homo sapiens
  misc_feature (19)..(19): n is a, c, g, or t
  misc_feature (68)..(68): n is a, c, g, or t
  misc_feature (76)..(76): n is a, c, g, or t
  misc_feature (84)..(84): n is a, c, g, or t
  misc_feature (101)..(101): n is a, c, g, or t
  misc_feature (137)..(137): n is a, c, g, or t
  misc_feature (202)..(202): n is a, c, g, or t
  misc_feature (224)..(224): n is a, c, g, or t
  misc_feature (242)..(242): n is a, c, g, or t
  misc_feature (266)..(266): n is a, c, g, or t
  misc_feature (284)..(284): n is a, c, g, or t
  misc_feature (288)..(288): n is a, c, g, or t
  misc_feature (321)..(321): n is a, c, g, or t
  misc_feature (335)..(335): n is a, c, g, or t
  misc_feature (350)..(350): n is a, c, g, or t
  misc_feature (354)..(354): n is a, c, g, or t
  misc_feature (363)..(363): n is a, c, g, or t
  misc_feature (433)..(433): n is a, c, g, or t
  misc_feature (452)..(452): n is a, c, g, or t
  misc_feature (459)..(459): n is a, c, g, or t
  misc_feature (482)..(482): n is a, c, g, or t
  misc_feature (489)..(489): n is a, c, g, or t
  misc_feature (491)..(491): n is a, c, g, or t
  misc_feature (501)..(501): n is a, c, g, or t
  misc_feature (532)..(532): n is a, c, g, or t
  misc_feature (649)..(649): n is a, c, g, or t
  misc_feature (656)..(656): n is a, c, g, or t
  misc_feature (723)..(723): n is a, c, g, or t
gggccttcctatacaaggngctgatcctgtgtttggcgctgagctcctcacagcagcttctttcagcnatcttatngggatagngttccgcggggcaaganatacattggttctaactgattttcaatcccctttcnccagtggaataaaccactttcacaaagagctgccctatgtataacccacagatttctagcttgcnacaaagtgacaagggacaaatngggggaaaaaaaaattangaaaactaacactgaagtaatccnccttctcatgtctccggncagnggggtccggggggcctttaaccaaagggaattnaaaatatgcaagtnatattacctagttcnttcnctgttagcnagatttgttcacttagggctttaacccctttccaaaccaacaactttgtcttaatccagctatgtttgcnaataaacgaaatgcatgcncttcccncatatatacttcactgggcctcngcattcngnaccgggcggnggaaaggtgggcgttcccgcccaagtcggtncgggagaataaaaatgagaactccaactataagaacaatgcctccttcaccccagtaatgttatccacattttccctaccctcacattagaataaagacatcctcccaacttttcanctcctanctccaatctgttcataggagatatatcttttgattcttttattataagggtagaatatagattaagn

SEQ ID NO: 724274 - DNA, 446 bp, Homo sapiens
tgaggcactctacaggacctacgtaatatgtaaccaatagcactgaaatgtttacgtttttggtgattatatcaacatcaaagaaatgcaaatcaaaaccacaataagatgccatctcacaccaatcagaatggctattattacaaagtcaaaaaataacagatgttggcaaggctgcagagaaaagggaatacttatatactgtttgtaggaatgtaaactggttcagccactgtggagagcaatttggagatttctcaaagaatttaaaatggaactaccatttgacccagcaatctcatgactgggtatatacccaaaggacaataaataattttacacaaaagagacatgcacttgtatgctaatcacagcactattcacggtagcaaaaacgtggaatcaacctgggtgtccatcaatggtggattggataaggaaaatgt

SEQ ID NO: 724275 - DNA, 422 bp, Homo sapiens
atctgcgtgtgctgtgcacttgtggtgcaggtggcttcgaggggacatggctgggcactgccccacagggggggccctgatgtcatgaggtgcgtgctgtggacgggcaccacagcccacgtgcttgtcaggccagtttctctcaggtgtcggtcaccctaccatgcggactttcttttgtctttatatctttagctaaggagtccatggccatagcaaaagctgaatgatgacagccagtgtccccatcctgtcctccccaaactttccacaggcagggacgctccccattcttgctgcatagtcttctgttgaccccatgtacctgagtgacccccacgtacctgagtgtgacaagcactatggtgcttgacctcagtccagctgcttagacctgtacctgccacagccccacgtgctga

SEQ ID NO: 724276 - DNA, 161 bp, Homo sapiens
taatgtgtggtcgtgcaggtagaggcttactagaagtgtgaaaagtaggcttggattaaggggacaggattccaaggatagtcggtaaaattaaattggggaaaatgaaaggtgtagaggaaagttaaggggtggatatggcaaggggggggctcccaata

SEQ ID NO: 724277 - DNA, 223 bp, Homo sapiens
gtctgcacagctgctggtgtagatcagaacttctttatagggaaactgccttctgcaaaacgacaagccagttcattccagtcagtgagttagtcttcttcattctccttcttggttatgctcctctcgcttctggggctgtgctgtcgcgggcatgtgagggaggggtctgtccctcctcttcttcctcctcatagtcactgtcccgaaagaagaaaatgat

SEQ ID NO: 724278 - DNA, 194 bp, Homo sapiens
actacatacttccgtgacagcccaggcttcactcactcagggttacctgccaccctcacaaccaaagacatgggtcaggaatcaacagccttccacagcagctcagacgcaactggaacaacacccttacctgcccgctccacagcctcagaccttgtgggagaacctgcaactttcctacaatcatttttctg

SEQ ID NO: 724279 - DNA, 1143 bp, Homo sapiens
gactgccgtgtgcatgctgtgtggtgtggccctgtgggtgccctgtgtgtgccctgtggatgtggtgaacctgtggtggcttcctgctggagtgtttctgtgcagttggcatcctggtggcctgtgggtctgctgtgcctgtgtgactgtgtggcctgtgggcctgagtgcctgcggagctctgctgtgagtgcaatggcctgagggataaatgtgatgttggattgccctgtcacccaagtttgtggcctgcttgtgtcaatggacatgaagatcaatgtccctgtgaggagatctatactcttctccctgcccattaaggaatcagagatcatttgatttcttccttgggtggcctctctcaaggatgcaggttttgaatgattatgccagtagcagaagcagaccctgtgcctggccagctgcaccaggttcaatggcatttgttgctatctggggactacaatgtgccacgtcggtctggtgtggtaagtgctccaagtgagtgttggccaccgacatccgtgtgggccatcatcctgtgccaagctctccatacgtccccgtgcgcagaggctactggagggaacaagatcggaagaccaccaaatgtcccttgcaaggtgacaggctgttgcggtcttgtgctggtacgcctcatccctgcacccagtggacactgggatcgtactccgcaacttgtgcctaagaagctgctcatgatggttggtatacgattgacctgtacaacatcagcccgtggctgcactgccacccttgggaaattcgccaagggcacctttgaatgcatatctaagacataagtacctgacccgacctctggatgacactgtatcaccagtttcctataaggagcactgacacctcgtaaaacaaacaagagaacccggaaagggaacagggccccacagtgccacaccacgggtacacacacgaaacgacagtgcgatagcgtgacaaaaacacgagggcgccaaacatccaggatgcaggaagagacagcagtgagagggacacagaacgaaaaaaaagcgcagcacagagagacgagcaggctggacaaccaggcgagaaaccaacagaacacatagcacagatccatcatcaaaccacagcgacaac

SEQ ID NO: 724280 - DNA, 237 bp, Homo sapiens
  misc_feature (50)..(50): n is a, c, g, or t
  misc_feature (62)..(62): n is a, c, g, or t
  misc_feature (76)..(76): n is a, c, g, or t
  misc_feature (234)..(234): n is a, c, g, or t
atcacgcctcggctagaagttttcttatactgttcatagttgttgactcnatcatatgatgnaaatctatgctacntaaatcattgacagatgatctcatcttttctgttagttacaattgtgaatcatatttccaagcacactttccaatattttcttgagcatttaattctgaaggtcactatgacaggttcattaaatgccgtacatcatctaatcttcagaatgactacntga

SEQ ID NO: 724281 - DNA, 831 bp, Homo sapiens
  misc_feature (77)..(78): n is a, c, g, or t
  misc_feature (152)..(152): n is a, c, g, or t
  misc_feature (176)..(176): n is a, c, g, or t
ggccgccggcgcttccgctcccggcgcaggcgcggagtttggcagagcggagggggctcgggagaggagtgacgccnntggcaggatggtgctggagagcgtggccgtatcgtgaaggtgcagctccctgcatatctgaagcggctcccagnccctgaaagcattaccgggttcgntaggctcacagtttcagaatggctcggttatggcctttcctgtggtgtactcgcaccttctgggctaccctgtgcagttcgtccattcctcccgaagaagaaaccaacagaagggatagctggattaatcttaacaatacacaaaggaaaatcggaaagtagtgaatgaaataaacttggaagatttgtgtcttactaaagcagcttatggtaggtgtgggcgttctaaaatgtttcactgcctgggagtggttcaacatattaaacacaatgaatgtgaccgggagataatgtgggtccactaatatgaagaagaaagaagtataatattaataacaatattttctcatctgggtgtctagaaaattttaaaaatggcggtcttaatttattactagtgtggaacaaattatttcttccaattaattttcttccggccctacggtggtatggatcatgtgtctaatcagtcactaagttagaataattgtcaagctcttatctgatcaagattatgtttctccacataaatccttcggtttaacaggaaaccaatgggtatgatcccaagcggggcttgcctcattttcacggcctgtaatccccccttggaagtatcaaccccgggagaaaggctcgggccaagaggcggaaa

SEQ ID NO: 724282 - DNA, 357 bp, Homo sapiens
aaggaaactaccaacacagtaaacagaccacctagagagtgggaaaatacacttgcagactatacatccaacagaaacctaatatccagcaatctataagatactttacaaaatcaagaaaaaaagaaagaaagaactcctctaaaggtgggcaaatgacatgaacagacacttctcggaagacaaacacgtggccagcaagcatatagaatagtgcaccatatcactaatcattagggaagcacaaattaaaaccacaatgcaatactatctcacaccagtcagaatggctattataaaaaagtcaaaaaataacagatgttggtgaggttgcaaagaaaggagaatgcttataca

SEQ ID NO: 724283 - DNA, 297 bp, Homo sapiens
tagtgtcatacctgaatgtaatagcttgctttctattatcaagaataaaagctgtctcttctcttattgggtgtcccacctaaaatatatatttttttctggccacatatgaaagttgtttttttctggcatatgaaagttccaaggccaggaatcaaatctgagctgcatctgcaaactatgccactgctgtggcaaaaccagatccttaacccactgcactaggctggggattgaacaggcaacatcacagagataagctggatctgacatctatctcggggccacaagcctgct

SEQ ID NO: 724284 - DNA, 290 bp, Homo sapiens
tgaagtactgctgaacacatagctctaagtgaagtgtgttcaaaaaaaaaaaaaaagcgcccaggcgcagttggttcacccttgttattctcagcatttggggaggcctttgggggccggaatcatttgaggtcagaggttcgaaacgaccttggccaacttggtaaaatctcgtccttgctgaaattacaaaatttgtcggaacagtggtgggtgtgctctgggggccccggctatttgggaacggtgagacggcaggaatattccctttgaacccggggaagggggaa

SEQ ID NO: 724285 - DNA, 802 bp, Homo sapiens
  misc_feature (83)..(83): n is a, c, g, or t
  misc_feature (400)..(400): n is a, c, g, or t
  misc_feature (435)..(435): n is a, c, g, or t
  misc_feature (439)..(440): n is a, c, g, or t
  misc_feature (447)..(447): n is a, c, g, or t
agggctgttcttatctgccccggttttcatgatcaagaagattgggggttgtgaggacgtcccaggcctccttggactcaggnccgcagtgtaaagagcccaaattgttatcaggcctcctgttcccaggccaggaggcccaggtgaaagtatagggtcaggcagattcttgcttttatggggggccatttatgggattgcttccccccggccatcattgcaatgctaattagggcatctcccctcccttttaggccagaacgaaggtcagtttcaatggtacccagaaccctgttactttggggtgtcctgttttaatggacccgcccttccagccccaaggggtgcctgtgggggtccatttgggtaagtttgggcccccactttcaccagttttttnggccttccaccgggccttaaccccaacggaggagntccnntaaaacnccccccccccccctgggggtggggggggggtgtccctccggaaaataaagaaaaaccccaggacccggctggggttttttttaacttttttgtgtgggtctggggagggaaagccccctaatattatttgggttggttggggtggggcaggatttcaaccataaaaggcccgtttggttagttttccctgtttcctggtttgggctgccccgctttggggaagcccggcggcagggggggggagggaggttcctcccaggtttcagcccggggcagggtttttcaaacaccctcctgggcagttgtaaggggttcggggggatgttttccataaaataaattttttttgggttta

SEQ ID NO: 724286 - DNA, 169 bp, Homo sapiens
  misc_feature (77)..(77): n is a, c, g, or t
ctccaagttggtggggtgattttagtatgcagccagggtttgagacccactactttaaggtgaaactatttttacanctctctaaagatttatgaaaaaaaatttactgattttggagataggaaacttgaaagtgttttaaattttatgtgtagcacttattaagcgt

SEQ ID NO: 724287 - DNA, 294 bp, Homo sapiens
gagtgtatagatcaccccctacccaatccagctaaaactcagcttcagttgtatagtactccagtgacaggaagtagactactacagtggctttaacatatctgtttacacactagctaagaaccaacctgggattagatagccccccaataatgttaactctaaatctatacaagttgaatctcaaaaaattggtcgcgcagaaaaattatgagccaccagcttaaaactcacagggagctgggggtgcttcctattccctctagaggagcctgttctgtaatcgataaagcc

SEQ ID NO: 724288 - DNA, 757 bp, Homo sapiens
agtgctctggagactctgcagggccagttagaggagaaggcccagtgagctagtggcacagtcagagtgccttagcctcggcccaacgggagttggctgccttccgcaccaatggtacaatgaccacatgcaacggctgaagatgagtggaatgtgcccagtgtgtgccctggggccggcaagcaggctgagaggacaagaatagcctcactcagcatgcttgtgaggacggaggtgtccatcctgaactcgccagtgtcctggagaacggagggggatgagcaatcggagttgaatgcggctggtgatggccgacgtcagagaagatgccagatatgctggactggagacggctgcgcctgcttgcagtgcatgagacatgccagcaatctgtgccatgagctgctgaacgcaggctctgctctgcgggacggaggtgcagagcctcctgggatcggacggctgataaaccgccgggtggcttcatgagaacctgcggcaggagctgacctcacaggcttgagcgtgcggtaggatcttgggccacgaatttgacgtgcgttggccgcgagaaagttcttccagaaacgagcatggcctctccaccctgcagctcgagcaacgccatgctctcaggccctggtgagttgagctgctggcagcgtaagcacctctgccagcagcttgcatgccgagcaggccgtgcgagaacgccacgtgaggcgctgagcgagcagctggccgtggggcctggggc

SEQ ID NO: 724289 - DNA, 356 bp, Homo sapiens
  misc_feature (297)..(297): n is a, c, g, or t
ggcttcaagattgttaaagttcctgacgcttacttgggcggtaagaagcaatctttgcacctgataatgttggtcgtgtgtttgttggtatctcaactatgcgtacaattgacgcagttgacttcgacggtgttgaattgcaaggtgctggtaaagacggtatctatatcccagatgataaccacaaggctatcttctttgttaacacacctgcaaaatgataaattattcataactcgccgtataaatacacaatacgcaatggcgggtattaaggagagtatatgagcgcttcancagattacctaacgttaatttcagccgatacttcgattgccgataaattggagattgtt

SEQ ID NO: 724290 - DNA, 387 bp, Homo sapiens
gagttactgtagagataatatagctgatgtcaaagcagattaagaaacctgaatgggggcgaggttcaaaaaactgaacacagttcttatatttcccatgttttttaacaaactaaccttaagcgtattggtaaaagcttcctttgtaatctggaaattcctgcttctgctaattcaggctcttttctataaaacaggtttatatatttaagtacataaaaatattactatagcctaacattcataggaagaatctcttggtcttatctgagaacctctcaagtgtttagtgacatattagaataatcatgaggatagataagtacgtgaatttcagtcttggtgtattctcctccaactcataggtttcatttagtaggaagagga

SEQ ID NO: 724291 - DNA, 270 bp, Homo sapiens
  misc_feature (26)..(26): n is a, c, g, or t
  misc_feature (29)..(29): n is a, c, g, or t
  misc_feature (50)..(50): n is a, c, g, or t
  misc_feature (73)..(73): n is a, c, g, or t
  misc_feature (88)..(88): n is a, c, g, or t
  misc_feature (92)..(92): n is a, c, g, or t
  misc_feature (128)..(128): n is a, c, g, or t
  misc_feature (136)..(136): n is a, c, g, or t
  misc_feature (163)..(163): n is a, c, g, or t
  misc_feature (194)..(194): n is a, c, g, or t
  misc_feature (221)..(221): n is a, c, g, or t
  misc_feature (259)..(259): n is a, c, g, or t
aacccaagtcatttttgatccccccnttntccccccccagatcccagggnctcatcctgtggctttggaaccnccctcattcctttcnaacncaaaggaggaattattgcttcatctgactttattcnaatctagntatggattggcctaaattatttgtgcnaaatttgaaatgttttttattttaatattanaaatagcccaaagtcatggagtttttnaaaattgttataattaagtaaaaataaagctgaattgngtcctttgaaa

SEQ ID NO: 724292 - DNA, 260 bp, Homo sapiens
  misc_feature (65)..(65): n is a, c, g, or t
aacttcccctcttgcagcggtgatccgtcccaagacagcaaaggttctggggttgggagaagctncctggagaaaaaggaacattaaaaaaaaaaaaaagattaaaattagccgggtatggtggtgcacgcctgtagtcccagctacccaggaggctgagacaggagatcacgtgagcccagaagcaggaagctgaagtgatgccatgatcacaccagtgcacttcagcctgggtgacagagcaagaccctgtctcaacc

SEQ ID NO: 724293 - DNA, 2451 bp, Homo sapiens
  misc_feature (1398)..(1398): n is a, c, g, or t
  misc_feature (1929)..(1929): n is a, c, g, or t
cggacgcgtgggctctcaagtctagccttgtcacggggcgggccagcaacacggaacgtatatactggaacggctggagcccagcaggcactgacaagacttatcaccagacctccggctacaccagacagccttcagggactggtattctccaatcaagcgaactgacccaggatgcgtgcgactcggaccatcacaagcactcagcagggccccagatgaaccgtcccagctcttgggcacgcgcttgacatggctgagcgctgcgctgacctccacggccttccttcaggccgtgacccttcaccgcgcgagactaacactgactggacacgattaccttgcacgagcagactctgtgttagcgacgcagcgacagaagcgcgaccacgacctctgcccaaagaacaaacattctctaagcactacgcccgaagccacaagcaccactgtcacgtgccgcgttagcgtatcaacaaattagcgacgaaaagacaacgcaaaaccttatataccatcattgtcggcgcatttcacactgcactaacagcccataatatctggacacgtcggccagtttttacgcccacggctggtcgttcatacacccgatatatcgacggcacagattcccgttattcagcgcattaccaacaaccagcgatataaccttagtcgcgaacccctattacgcccacccagcctcggccacacgttcaggcgcgcctactaccagttgggagacgacaacctttgcaaccaacattcttcacggcactacagtcggccccacacggcaactcttaaccccagcggcggacaccttacaaacacgagcattcccattaggcgacttacgcgcacacacagagcaggcaccctaattattgggccgacccaccagattatcgatcggacagaactcatgcggcacccacccactcatatgtgcgcgactattgtgccgccacaagcccaccactgttattaccccagatatcagtttctcctactattacacagcacacaacaaggcgcgagggcacacactagcgagcacacatacaaccgtgcggcgcgcatttacgttaaacggcgcacacaaccaatccgataaatcgctacgccacaacgagacgagtttacaaatccgacacacgatacagacgatgcacgcaatagtagttgggcagtgccagactttccgcacaatcgagcagcctaccagatcgcggcactttacgacagagaacggcagccacacgtgatcaaccgcccgaacaaggattactactggtccgcccagcttttatctcatcgcaacgccgcattctataatgcagaccctgtatataaaacgccgcaggtaagctatttaccacccgccaacagggacgncagcgtggagcactctattctaaactcaccggtcggcggcaacacacctttacagtctatcccaccacagtttaccaacccaacaacggggcagaccaaactgttgggccccaaactacacaaagaggaatcatggagagcaatatagggcacgcaccgcccacatcatctgacaaaacacacttgtaaggagagcacaagcgggaaacaaccccaaaagaagcacaccgcacaacgaacgcgaactcaggactcatcccacctcagcccatagtcggcggacaacaaccagcacgccccaccaaagcctgtccgccaaccagcgcaaaaccccacagtagagcacgcccaccacgcgcgcaaccacaacagccgggcatacggacaaccacaccatctcacgcagcacacgagctaggcttcaaccaaaaagaggagagccaaccacaatagggggagaagcggatcccaaaaccaccccgaaacgacgcgctaagtggaaaacaaccagaacagcacgcccaccaactngtgacgggaaagatacgaagctacagtatcaccacactttgctgcaggcgcacacaatctccgacccgcagacaacaaggccaaaaaaaggcatccaccactcccaacaatcaagttggggccagccaccaggagtggtaacacgacccagcataggggaggcaaagaaacagaggtgggctagacaccaaccactcacaagtgatatccccgatgatcttcacagctgatgcggcgtcacaacacaaacaaccccgcacgcggaggacggccttaatgatgtcgaaacatcatcatttccgccacaccacccaaaagacgatcaccaacagccccatttagcaacagcacagatatttgggaacgacacgccaacagcaacctattaccaactcgccttggtcgatcatggatgacccacctacatcattcattctgacagaactagaaccacacactcgactcggggcggcgagccagattgacccccacacgcaattcattcaccacatgattgtcgct

SEQ ID NO: 724294 - DNA, 234 bp, Homo sapiens
aaaattgtgaaattgttttgccctgcgcagcaccctctagaatgggctagctgcacatgaggccagggctggaggacatttttatagggtcttgtgtatgggagctctctgtcgaatgaggtcattgtgcccgcaggttgtttgtgattagctgtctctaccaattgttcatacaatcattgttcattattgttctcaacttggggctctccccaacctggggacccttcctta

SEQ ID NO: 724295 - DNA, 507 bp, Homo sapiens
ctggtagacttattcagtatttcattatgcctgttcgttgcaaaaggttctatggtgacacgtatttttctcaagtcattactagaatagcaatactatacagattttttatcctcttctcactgaaccgaggtgcatgattaattcatatctattccttatatttaaaccacaacatgccgatgaccctgtgttgattttcaacagtttgctcagcccagtcccatcttaatttattatttatttattttttaacttaaagttctggagtacatgtgcaaaatgtgcgggtttgttacataggtaaacgtgtgccatggtgatttgctgtacctgtcaacccctcacctaggtattaagcccagcatgcattagctatttttcctgatgctctcccttgcccacacatcctgcatcccacaagccccattgtgtgttgttcccttccctgtatttttgggacagggtctcactccagcctgggtgagagaggaagactctgtctca

SEQ ID NO: 724296 - DNA, 1470 bp, Homo sapiens
gtgtgagccgggctgcgtcgtgtgtggtgtcgcaggaccgggtgtttgtgttgtcgtgctcgttgttggtgtgttatgttatgcgcgtggcgcttcatgcctgttttgttcgccgggctggggggctctgcgtttgttagtcacagcctggtgttggttgtggtgcgcccgcaggggtttgttgtttttttgccagcgcgctgtgcgtggtgatgttcgctgcactgtgttgtgtttgtttcctgcgtgcctgggtaatcacccttctttgggtgaatatacaaggtggtgtgtgtgtgtcgcgatggtgtgatgatcgtcggcgtgggtcgtcgcacggggtgtttgtgggggggggaccccccgatatggttgtcaccctcgtgtggcttgtggtggtgtggatgtcctcgcgctacttttgttcatcctgcgtgcggtaggtacgattggttgtggcggtggtttggcccctccgcgggcggttgcacagagggtgtttgttggggggcttgcgcgccagagtacttgtctggggggggccagtttttgggaggtgattttgtgcccaccgtggctttgtggtggccccctgtgggggggtaactctttgcttgttttttacgccccacagatggggggccccatctattggggccctgttgtggttgacgcaatactgtgtttgctctctggaagagactctctgtgttttgtcgccggagacgcacgcttggtgatttctaccgttgggtttggccccccaccttgctctcgcttatgtgtgtggctcacgttcgcactaaatggagggcgcgtgttattttcgcccccccctctatatggggggggcgtgtctctgtatgttccccgagattttctcccccccgttttttccacagggggagcccaccccctttgggcccaatactcttagcggcccacaaaaacacacactttacccatatatataaaaatattatattgcggggcgaagaatattaaaactctttattctctccacacaacaacactcttttttggggcggcatattccggagaatattcccccgcacggtctatatttggggtataccccgcgaggtgaagaacacacccacacttgaaacacactcctctttatcattctttagagggccgcactattactcttttttataccacgcccgcagcgaaaaatatagaataaatattttatctaagagagttgaagaaaccctctttcgctcttggaagcggaaaattctttaatataatagtagagagagaacccccccataaacccggggggagcaaatatatgagagagagccccccccccctccccacacacactttgtagaggaaccccgagataacaagaaaatttatgacacacaaaaagagaagggattgaaacccccccaaatgggttttaacccaccccccgggcccccagagttttttcca

SEQ ID NO: 724297 - DNA, 450 bp, Homo sapiens
aggcagaagccccagggaacatattctagaaggtcgtatcgttgccaggtctatgtgcattaatgtgtgtcagtctggcatagattcagtcatgatgcaccgacacgtggttcatgcagtgctcaagacttagtcttacattcataatgccttatcatgggtttccagccagttgataagatgctctgagtaccgtaagtacatcatttatgactgtaaaacctacgtatgtatgtatgatatcgcagtagctgtcatcatataccagcgcttgaagcttgagcaggtagaagtgttcttctagaccagcatttgtcacaccagtagggcctcctgtcaaatctctttgtaggtgtccatgtgtcaaataagctccaataatgcgtacggttcgtattgtgccaatcatgttcttacacgccacaggtttgagcatgcgctcccctgtct

SEQ ID NO: 724298 - DNA, 679 bp, Homo sapiens
  misc_feature (134)..(134): n is a, c, g, or t
  misc_feature (143)..(143): n is a, c, g, or t
  misc_feature (159)..(159): n is a, c, g, or t
  misc_feature (178)..(179): n is a, c, g, or t
  misc_feature (199)..(199): n is a, c, g, or t
  misc_feature (215)..(215): n is a, c, g, or t
  misc_feature (284)..(284): n is a, c, g, or t
  misc_feature (327)..(328): n is a, c, g, or t
  misc_feature (392)..(392): n is a, c, g, or t
ccctatagtggagttgacaataacactgggccaggagggaatacccccttgggcagtcaggggtggggtcaactaagaagacattagaaaatagtaaagcatgtgggctaaccatttatgctagtgtccatttntggaatgtnagcatgtgaagtcttnatatcctgctcaggtcatnnccaaggtctgattttcacantcaacaaattgcaacntctggcataaatgggttaatacctaggtgatgagttgataggtgcaggaaaccaccatggcacatgttnatctatgtaagaaacctgcacatcgtacacatgtaccctggannttaaaaaatttaaaatatatatgtatatatatttaatatggaattttaaaaattactaatgagntcttttatctgagtaattttgcatcaacatgcttttattatggaagagaagattcagtgagtacaaaattgcagatacatgtgtcagaagatccctgaatataataaggcttagtattctgtgtcataattgcctgtttgtattcctctctggtctttaaacttcattagggcaaggatcaactccatcttactaaccatttgattccctatgtattacacgatatatgaccaataataagccttcaataaatacttgtaaaataaagaatgttatgtaatatgtca

SEQ ID NO: 724299 - DNA, 342 bp, Homo sapiens
  misc_feature (224)..(224): n is a, c, g, or t
  misc_feature (257)..(257): n is a, c, g, or t
  misc_feature (294)..(294): n is a, c, g, or t
catgtgatgatgagagaaagataaatttcttatttaagctactcttccttctgttactagctaactgaatatagtcactagagggaacagctcagcatggcgattaagaggatggactctggagtccagagtgctcaactctgaatcccgcttagctgcttactgggcttgcaagccttaaacacagctacttaagcctcttcatgtcattagtttcttcatcntgtgagtgtgtgggtgatagagagcctacctcnataaattagatgtaacagattaacattagttgaaacnatgtcacaatgttccagaagaagtccctgcacacaggctgaagccaga

SEQ ID NO: 724300 - DNA, 214 bp, Homo sapiens
cgctgtcggcgcttcttcggccagcgcggggcggggaaatgggtttcaccgtccagcacctgctcgatcgcctgcaacaactctgccaacgagctgcctttgttgacgaaaccgttggcgccggcggcatgcgccatgcgcgcatagacctcggcctcctgcgcggtatagatcaggatcggctgctgcgggtagcggcggcggattttttcca

SEQ ID NO: 724301 - DNA, 175 bp, Homo sapiens
acggagagtatacgctgcttatgtgtgtaataggagtggctatatttgagttgtgaggtaaaggggagatgggagtgaaagcgcattaatgggtaaaatgttgccatgagaggaccacagcaatcatctgtaaactccaggcaaccccatgtatggaggtaccgagccgtcgaat

SEQ ID NO: 724302 - DNA, 138 bp, Homo sapiens
gatgaaataaagggtccccctctcctcaggcccaaggaacagcttactttttgccagattttttaattccccctgtggccaagggccccttccccccggccttcgcttttagctcctcgagtttttttttccttaaac

SEQ ID NO: 724303 - DNA, 315 bp, Homo sapiens
ttcaacaaatgtttggccagacgaaaaacattgtgtcctaatggtaggcaggagaccaaggagcaaaaggcttgccttcctgggagcaggttgttttaactgttttaaaccagtaagccccaccattacatcctgaaatttggggcttttgaaggtttgtgctgggagtgaaaagtggcttagctatttacccgctttttggggacagggcaaactaaatgcatccctttttacctaactcccaacccctgccctggggtgaggcatatgaatgctaaagttgggcattaaaataaatgttttttatttcctgga

SEQ ID NO: 724304 - DNA, 775 bp, Homo sapiens
  misc_feature (102)..(102): n is a, c, g, or t
  misc_feature (149)..(149): n is a, c, g, or t
  misc_feature (327)..(327): n is a, c, g, or t
  misc_feature (364)..(365): n is a, c, g, or t
  misc_feature (383)..(383): n is a, c, g, or t
  misc_feature (413)..(413): n is a, c, g, or t
  misc_feature (415)..(415): n is a, c, g, or t
  misc_feature (423)..(423): n is a, c, g, or t
  misc_feature (425)..(425): n is a, c, g, or t
gagacgtgcggacgcagcgggtgggctttcagcttatgtggagaagtcgctgtgaagccacctataaatccatttactgaatttatggagaaggctgtaaangtgatggaagtcactccagaagaacctctttgtgccatcttaaaacntatatcagagaacagaagatttaccacggtgcaccagtgaaagtcatctcagctggcgaatctttctgcatggactttgacagatttctgaccagaacggacactattactaacaagatttagacacccttcaaaagtgtaaaacctagctttagaacatcttcttagaaagagagantacaaacaacaaggagacaatttatccagcatgtttnntagaaaatctaatgatantgaagtgaaaatactaatcttaagaagacngntatttgananggaggcccatatccaagaactttctgtgttggtttcagagtgaaaggcaaatacttgtgaaggcaaacgtttttcccaatcagtacaagtagtacatgaacgactacagatccaaattcataaagggaacgcgagaacgatagtggaccgactttgtaagagttagaaaccaagatagccatgtggacctgaatcaagagtgattagaatgaggtatagtgatgaagagcagtgggcaaaatggggttacaagggtctaagttacaacaggttgccatttacagggtatgaaagtatccaattgagtcggagcccgtgtgaaaattcgttcatgcgggagtctttgaatg

SEQ ID NO: 724305 - DNA, 113 bp, Homo sapiens
ccggaacagtagcatgtgatcacctcccggccgccacccctgaccaggaggacttctgttcagcccctcggtcaggacttcaagaaactccatgtagttctcgtctccctgcc

SEQ ID NO: 724306 - DNA, 138 bp, Homo sapiens
  misc_feature (61)..(61): n is a, c, g, or t
aggatatagaacggagctgactcatgaggcattgtcaagtctgtcacagtcctccatatgncaagatgaagaaaattggcatctttttaggggtacaagatctgagttgtacggtctttataaatgcagagcaagatg

SEQ ID NO: 724307 - DNA, 248 bp, Homo sapiens
gtacgggagcggatgatgcacgatagtgcggaggagtggagccaactactgacgtggagtgcgctggaagccgtgctggctacaaaaaatgttgagccgtagatgccgtcggaaatggtgaacgggacgactcgcaagctactctagaggctcgtagcgagggtaaacatagacgacccagatacaaattgtacataagcagctgcttgaacttatttggctttcggctcgttttctacttagtacta

SEQ ID NO: 724308 - DNA, 93 bp, Homo sapiens
gtaagagcggcgggggttattctatatataagtattagcttttctctgttcaacttatttcacttaacaccttcaagttcattccgctttgct

SEQ ID NO: 724309 - DNA, 177 bp, Homo sapiens
tagtatttctaaaactattttgttagatgacttgataatagtatatttagcagctcaccttagtaggtcaaattggtaaatctcttgtaatttagccttcatcgaataataggtaccagtgtattaaaaatgtgtattttttgcagccctttcaaccagagtaggttcagagaaact

SEQ ID NO: 724310 - DNA, 211 bp, Homo sapiens
gcaggcacaaagactctgagttataaaggaatcgactgacagtaaatggcgagattgcctttgcctgtggtccatcaaggcaacgagaaaaaagtcccagtgctccagacaattcaaccacacttggcatccagtgaagaggagagggagattcctttacccgagagccctgagaaagacgaagcagcagtcccccagataggctatttga

SEQ ID NO: 724311 - DNA, 430 bp, Homo sapiens
  misc_feature (145)..(145): n is a, c, g, or t
aaagtatcattagccatgtgtggtggcatgcacctgtagtcccagctactcgggaggatgaggcaggggaattgttgaatcccaggctggaagtgcaatgagccgagattgcaccctgtcgttccagcctgggtgataagagtgnacttccatctccaaaaaaaaaaaaaaaaatttttttttttttttttttggaaaaacatttagagttacatccttttcccccattcttcacacacagagccaaagagcagttatattcttgggataccatgatacctctgggaaaggaattatattcccaaggagaggtcccattggataagaacaataccatgggacttgagtctgaatgccaacttactattcacacatccttcttaaaacgaacacactgtttcttttcctgacctagagcattctaaagttc

SEQ ID NO: 724312 - DNA, 1001 bp, Homo sapiens
agcgggcttcgccgctctcctggccgctccgttccggtgtctcccgcggctcctctccccggtgtcggtgcgacgctgcgctgccccgcatcgccgccatcccagtagcctgggctcgtgccattggcagccgatgctgaatggtgctgggcactacctggcgtggagcatgctcactaggccgtcgtgcgtctctacgactgtgcactcatgggtgcagggcttgcaaggaagcgtgctgattcctcgtgaggtagaagcctgctgcgtccgagggcctaggacgccagctgaactggagatgactcacgaattgcgcttcctcttggcatgcatgagcagcagacatggaaggaatcagtgagcactcgatagcagctcctacgtgaccgtgcgtgccatgtagatgatccggggctcaccgcacaagggggaagacggccaagcgcattgctcagcgctacccatgatgctggcgcctcagacccacaaacgtatgcattccaactaccgttcttcaacatgtcgcaggcacggtgctacggaggatcgacacaagccactgttgctggtggtgtcaccgtggatgcctccttggcatcatcaagggttgggggccgctctgcagctttccttccatgggggtacgcaggttcctctcatcgcattggtatgcggtctggattgcctatgcctctcgcagtcgatggatgctagacgagtttcgcgggttcacagtatggtgcatttggcgtatcgcgagtgggccgcccggcacagcctattgttgcctgggcccaaggtttttggcgactccattcatttccccccgaaccatggagttgggagggggcctgggtgggttggcttgacaccactcggaccggcgacttgggtcaaaggggctgggcatagcacttggtgccttgcccaggcatatgctcttccggggacttatagctatgcaacttttagcccgacgccatgtggcctttgccaac

SEQ ID NO: 724313 - DNA, 1008 bp, Homo sapiens
acggcaagagagcagcctgggtggcattttggttttgtgtcatttaggttctttacaactatttcttacttcactttaatggaaatgttaaacaggaaataattagggtttatgtccagaacaaagtttggaagatcaccgttttaagcaacacattttcttttaaaaacaagagaacattgagcaacacaaaggagaaaaacattgttcattctagttctcaaccttccctagagatcgtatattagtgattttcgcaaggcaattgtggctcagttctgttgactcttatccatgaggacaaaaacagcatgacacgagtgtggaatacaagaacggaggaagaacatgctttggatggtttatacatacaaaaggaaagactgtaatgtgaggttcagttatacctctatttggcatctagtgatttctcatattatcttgtagacactagatttccgatgttgtcttgagaaattcttaaagtcatgacacagtggcataatgaactaacagctgagaaggggtacaagttcctaaaagcctgaagatcctaagatggaccaggttcacttactcccaggatcactttatatgcaagtagaagtcaggtcagggtcagaaacagaagagccatccttagtaaagcgcttcacccttcagcattgtttctcagtaaccttcataaattgcaggctactgagctggcctgatgatgatccttctgagatatggttatagcagatgattgtggatgataactacgccagcaagacactgtctccaagtaccccaggctcgtctgacttcctcggggattatactaaagaatcaccaaaaagaaccctatattggacaggctatgtctctggacattaaggcaacagcactaatccagaggctaagaaaggaggaaccacctttgtttcatgtctgcaacctgctccatatgaaggctttgtgacttgttgacccacaggcaaaagagagccgagtttacacacctac

SEQ ID NO: 724314 - DNA, 273 bp, Homo sapiens
agccttttaaaagtaagaatggcctaaagaataaaaaacttggatgcctttatcccgaaaaatatatttgctatcccccccacccttttctgaataatataaaaccgaagcccttccaaatgtagttagctcccctaaggcccctaagggtctaattaaaaaactaagtttcttggattttaggaattaaatggcccgtatttttcccccccccttcccccctactgaagaataatgctaagccccccccaaaaagggtttgtaataaatgtt

SEQ ID NO: 724315 - DNA, 112 bp, Homo sapiens
  misc_feature (80)..(80): n is a, c, g, or t
tagctcggtccaatctcaaaaccatgggcttataagtgctgagagtgagatgatattttcaggaatggaaagggggatcntggggatctcttctagaagtcgactctgtcag

SEQ ID NO: 724316 - DNA, 122 bp, Homo sapiens
gggtacgccaccctcaacggaactccacctgcacagcaacctgaaatatccttctaaactctatcctttccggttctatggaggcttcattgcacagatctgattaattaaaccattggcat

SEQ ID NO: 724317 - DNA, 321 bp, Homo sapiens
  misc_feature (56)..(56): n is a, c, g, or t
  misc_feature (181)..(181): n is a, c, g, or t
atgtacagacaatgtgggctccaagcagatgcagcagatccgcatgtccttcgcgngaaggctgtggtgctgatgggcagaacaccatgatgcgctagcatccgaggcactggaaacaaccagctctggaaactgtgcctcatatcgggggaatgtgggctttgtgttcaccaaggagganctcactgagatcaggggacatgttgcttggcaataaggtgccagctgctgcccgtgctgggtccattggcccattgttaagtcacttgtgccaggcccgaacactggtctcggggccgagagagacctcctttttccagg

SEQ ID NO: 724318 - DNA, 1478 bp, Homo sapiens
gatataatattggaacttcctagcgtgtggctcctgggttcagtgtctggcttaatctcacgggtatccgtgcctgtcagcgagggaccaacgctaaattgttcttgttgcattcttcggcagtcatataatccaatgcgataccttcgtttcctgatagaagaaacatagcatcgagccaccttcttcctcaaatgttcactacgaggtgggaagtgtaccgtatattatctacctgtgtacctatacaatttgctgtcgtcttcgctgtgccaaaagtacctgtttggcgatctactgcaatagatcgtagctcgcacgtacacgtaaaggtatgcgcgactacgcaaagcatacgctatatagctgtctgcaatgtagttgtgcgtaccctgtttcactttgtatggtatgggccccctattgcgtcccatcccttgtaaatgctctcagtggacaagacccatcatctcctcgtaagatcgtgatgtacgtgatatcaaaatcttaggtgggcgtgtcagaacacattgagcaatatcagggaaactatcaaagatcccaggaccatgaagtatatcattctctaatctattgacacatagcttcgctagggaaagccggggcccgctttcgagaatcctagctttccgctctctcatcatgtgtcccaggatcccagcgatagctctttacctcggcagtactacactcattgtttggcgtaacctctcctaccaattcctgtaatatggcaatcaaactaggggctaggtagcgattattagcggtctcctaattatacccctcgatttagttgtccaagctagattactttgtcatgccctatgcgatttgccaacttctagggtttggaaagtttaattccccaccgcgtaggacccaagttataaacctttgctaaattcaaaacttgtcggaagggtggtttagaaccagattttccaattcgtaagaccattggcttcaccaagaccttcttgtgtccccaaattgcgcttccaaggaagtttccaataccaaaagacttttaggtctttcagggaattctccccatggtggcttaacattaattactttcaattcttccgagagcccaacaacacgcttgcgattgacagcacacattggaagcgcacacatgatttccacggcaaggctgtcctttccctcgtttcgcacccattggcgttccttttttagggttccccaaacacggtttaccaattgcagagcgcacggcaagtgttcccccccgcttctcgtatgtttcctgtattggccctggttgctccctcatgtgggggcatcttcgggtcgcagggccgccctccggggccttggggcaaccccagttgtttggctgggtctctcaccccggcacaaatggggcacacccgcgccggggatttccctggcgcgctggcccggtgtggcacaccacttcccagataggg

SEQ ID NO: 724319 - DNA, 153 bp, Homo sapiens
ctgaggatccgatggcgagcactgtactatgattggactgactgaagtatgggcctgtgaatatgatgaaaaataaaaaagaaatgcaaaaaaaaaaacttagctacattatgtttaatatcaaaactcacctgaacaattccaattttcaaa

SEQ ID NO: 724320 - DNA, 206 bp, Homo sapiens
  misc_feature (72)..(72): n is a, c, g, or t
  misc_feature (119)..(119): n is a, c, g, or t
cccgctcgtaccaagttgcgctcttcctgttggttatgggaaaactgggtgtagatgaagacaagtaccttnatctcgttacggattatggaaatatggtttccgttgcggtacctttnggtttagcctatgcactcgatcatggctatgtaaaagaaggagataccatcttcttgatgggaaccgcaactggtacggcggatagc

SEQ ID NO: 724321 - DNA, 244 bp, Homo sapiens
gcacccaatgtatagatatgagctggggacatgaagaatcatggagctgaaaagcggtgcatcacccaatggctagcacacacaaggatcacactggggattctcttgtatgctggattgagcattttctcgcctcctttgcttcatcttttcacaacagctggatagagggagcagatatgactgtgtcatggtgctcattcactgcaaactcccagttgcaagctccttggctcccgcggag

SEQ ID NO: 724322 - DNA, 171 bp, Homo sapiens
cccctatgtgctgggtgtcgtccctgggcggtccgggtgtgctatccctaggtctcggggctgctgtgggctgctgttgcattctccatcacggcctgcggttgtggcagctctccaggcacacagtgtgttgtttgcacttgcagcccgtggcttgctgtcagtcagctg

SEQ ID NO: 724323 - DNA, 551 bp, Homo sapiens
gcgcactgcgatcggtatacagtagtatcttccctgtaaggcatcaattctggctgaaggtttttcttctgtatgcttcacgaagttctcatgctgtgttttcagctccatcaggtcatttatgttcttctctaaactggttatactagttagcaattcctctaacctttttttcaaggttcttagcttccttgcattgggttagaacatgctcctttagctcagaggagtttgttatttcccaccttctgaagcctacttctgtcaatttgtcaaactcattctctatccagttttgttcccttgccggcaaggagttgtgatcctttggaggagaagaggcattctggttttgggaattttcaggctttttgcactggtttctcctcatcttcgtgaatttatctacctttggtctttgatgctggtaaccttcagatggggtttctgtgtggatgtcctttgttgatgttgattatattcctgttagttttccttctaacagtgaggcccctcggctgcaggtctgctggagtttgctggaggtccac

SEQ ID NO: 724324 - DNA, 750 bp, Homo sapiens
  misc_feature (34)..(34): n is a, c, g, or t
  misc_feature (261)..(261): n is a, c, g, or t
  misc_feature (394)..(394): n is a, c, g, or t
  misc_feature (637)..(637): n is a, c, g, or t
gcacgagtaggttaggtacgaggctgggtggttncgttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcnggcgtgcggcggggtgaactggcgctggtgggcggcggcggaactagccaggcctctgccgtgggcagcgactggcgctactgtgggccagctggggtgctggtggccccattcaacccggcctcgctgcctnccctggcgaccctgcagctcatcgctctcatcgtggagcagctcaagagcctggggcctattttgacagcttccgccgggactgcctggccgacgtggacaccaagccagcttaccaaaacctgaggcagaaagtggataatttagtgtcaacacatctggacaagcaggaatggaatcctacgatgaacaaaaaccagttgcgaaatggtctgaggcagagtgtggttcagtcaggcatgtnggaagctggagtagacaggattatttctcagtgtggtggatccaaaacgttaagcacatcttcaggccacaaatagaacgagcaattcaagagtacctgcgcggcccagaaga

SEQ ID NO: 724325 - DNA, 833 bp, Homo sapiens
gacatctggtgggggctcagcggcggacaccctcttaacccacgtccggatggtgtgtgaggccgcagatgatgccccgagcagtgaagaggaggccatcgtggtgctctgcaaggacgccgcagcgcagcctcaagatgcttgatcctgcgggcacagacttgcaccctgatgaccagagcctcgagcacagaccagcttctagaagttgggtggagtcacgggtttccagagaaggatgggaaacaacaggttcagtacatgggctcagttcttgtgaccaagaaaagttgagaggactttatggaatgccagtaaaatgataaactcgggccttgtagggtgcccagcatcagagttgcaaggaatggtgggggacttctaggccatgaggcctatccagtgctccgtaggcgcccttctctctaggggtgtgggagtcatcagaggaaatagtcggagttgaggcagacttctgattgagaagagattcatctgtgttaaagtgaattgtccaaggtatcagatttttttatgaaagaagagagatgttaaggttaatttcaggaggtgaggtggtcaggctgttgttccagattttggaggcaagggggttgaatcactgaggcaggagttcgaaacagttccaaatgtgaaccattttataaatcaaaattagcaggtgtgcgcaacatgtaatcagtgtcggagtgagacggatcgtggctggggtgggaagggggatgcatgggcactgtggagagacctaaaaaaaaggtgttaagcacaatatatgagaacgggtttaaaggggctaatagtggaaaaagggg

SEQ ID NO: 724326 - DNA, 454 bp, Homo sapiens
cgcgtaacgggaagataccttgcgagttgttggaaaaaatcgccccttccgtcactagttatattgagtacatcgagcgcgatatgaggccctggatcaccaggtcagtcaagaggtctgaactaaagcgcagctaatgcgcgatttcgtcgccgatggcggctcgctgattgggctggtgaaaaagcatagtgagatctgggccaggtgactaagccgggaattgccttacacgacagaactatcgccttgacaatggtgtactgaagcttagcaattgtaagcaactgttaatgaacacagccatttagaaaccgtatgaccgaccggcgagacgaggcacatagcatgactagcatagttaccatctcgttgaccatgctgcctgacccggccccacagcacatggagacctggcaggcaggcaacaaacaacctggtgacccatgtccca

SEQ ID NO: 724327 - DNA, 1122 bp, Homo sapiens
  misc_feature (553)..(553): n is a, c, g, or t
caaaattgatgatccattaaagtaaacaataaaagtgtcattgaaaccgtgaaaaaaaaaaaaaaaaaaaaaaaaaaaaaaaaaaaaaaaaaaaaaaaaaaaaaaaaaaaaaaaaaaaaaggggggggcgttaaaattttctctggggggggcacattttacccccctttttttttaaaaaggggccaatagggggttttttttataaaagagggggcagcatgcttcacaaaacgtgtgtggtggagggacaaaacgtcgtcacagatggacctatttgttggaagaagccacctctcatcctggctggtggtcagaacatatcgaggggacacaatccacgagcgagagtgatgacaccgatccgagaaggataaatatacaacacttatgacgctgtgttctagtgtggttaccaacgcgcaggcgagattgtgagtcagcggagcaaagagatttggatcacacgcagtttcatctgcaggacaactattattatcacgacggggcgtctgtggtaatagaaagtgaagagaaagagaatgagagcagnaggacagtgaggagacagaaagcagagaagtacacagacgagaggatgagacagcgagagaagaacagaaggagtaacgaagatagaagaagacgaaagaacaagaagaaagaccgaaagcagaagaggaatagagaacgaacaagaagagagcgaagaggacagaaaagaaagaagaataccgaaagacagagaaaagagacaaatagaaaccggaagaaagaggagtagaagccgggagaggcgcaaagaggagaaagacgagcaagcacaagaagaaagagaggagaaaagcaaaaggagagagacgcagcagcaggggacacggacacagagacacgagaagggagacagagcgaagggagcaccgagagacagcagacaagaaggaggcagagagagcaacaccaagcaagagcgcaggcagccaagaggcgcgacgaaacacgaaacgaaagccaggacagaagacgctagaggaagaaagaagagcaggaagaagagcggcaccaggcagaccgagaggcagaagcagacgcagagaggcacgacggagagagggcgaggac

SEQ ID NO: 724328 - DNA, 128 bp, Homo sapiens
  misc_feature (20)..(20): n is a, c, g, or t
  misc_feature (48)..(48): n is a, c, g, or t
accaaatggcggactacacnggtgcagcgggggggcccggggcatggntggccatgggatggggaaccgcggtggcttccacagaggtttcggcagtggcatccggggccggggtcacggcagtggac

SEQ ID NO: 724329 - DNA, 161 bp, Homo sapiens
ggatccccgagctctctgagtttcggtggacggagcctctccgtgctgtcttcaagcactatcacttgcgaatccatgacatcccagaggcctataagcttcgtggatggtttgacgcagaaggacaagccttagatggtgttccatctctgatctaaaga

SEQ ID NO: 724330 - DNA, 219 bp, Homo sapiens
cccccccccccccgggggggttccggggggggggttcccccccttaggggggtttttaaaacctgttttgggccccgcccttcaaattccctggggggtttttaggggggaaaattttttttttggggggggttttggttttttttttttttttttttttgggggtttggggggttttctttttcttccccgaatttagggttttttggggccgggcca

SEQ ID NO: 724331 - DNA, 313 bp, Homo sapiens
ggctcattacagtactaataattgcacctgtagcaactgtggtggcaccatttatctagatcaaactcagacaggtacactatcctgaagaatattttggttgagtatgtggtgtcatagtctgggtataatcagagtcttctccagaaatattctcactacacagaagtccacacttttacaggattatggtaagttggtgtcaggtggagaacacaggatgcaccatgtaaaacacagggaataatgctgacataggcaggtgtgaacggaaaataaatctggggacccccaaatcacaaactgaaatgag

SEQ ID NO: 724332 - DNA, 191 bp, Homo sapiens
gagatcagcaatgctgtgagagagatggcctggggggtggagcaggcctgttggatcccagtcgagacaggtttcgccgtgttggccaggctggtctcgaactcctgacgtcgtgatctgcctgcctcggcctcccagagtgctgggattacaggcgtgagtaccatgcccagccgattcagggatttttc

SEQ ID NO: 724333 - DNA, 222 bp, Homo sapiens
  misc_feature (18)..(18): n is a, c, g, or t
  misc_feature (156)..(157): n is a, c, g, or t
ctcatggcagcatgtgtncttggaatctagatgtttctgtatcccaaggaacccaggctcaggctttaggctggaaaacaagacaattgcagatggtaattatccccaggatcacaagtcaaagcctgcttttggtcaagaatctcgaactcccgnnctcaggctatccgcccatcctagctaggaccaggtgctggtggggaaggggaggttcagggaagt

SEQ ID NO: 724334 - DNA, 86 bp, Homo sapiens
ggatttgctggtgcagtacaactaggcttaatagggacatggagaaaccccgtctctactaaaaaaaacgttagaagcttgaattc

SEQ ID NO: 724335 - DNA, 110 bp, Homo sapiens
agtcacaaggcatattataccacaggaagaaaaatgctgactctgatatgagaaccagactcaagagtcttcacacacgtggtaactgtaatagtgtataacataataga

SEQ ID NO: 724336 - DNA, 125 bp, Homo sapiens
gatcaggaactatcgctatacatcggcaccgatctatggtcaggaactacgcacggtatctagatcgtactatcgaacctaccgaactatacgtatctatgattaatagaaaacattactatgag

SEQ ID NO: 724337 - DNA, 1198 bp, Homo sapiens
  misc_feature (303)..(303): n is a, c, g, or t
  misc_feature (327)..(327): n is a, c, g, or t
  misc_feature (421)..(421): n is a, c, g, or t
  misc_feature (439)..(439): n is a, c, g, or t
  misc_feature (495)..(495): n is a, c, g, or t
  misc_feature (606)..(606): n is a, c, g, or t
  misc_feature (1047)..(1047): n is a, c, g, or t
  misc_feature (1049)..(1049): n is a, c, g, or t
  misc_feature (1056)..(1056): n is a, c, g, or t
  misc_feature (1075)..(1075): n is a, c, g, or t
  misc_feature (1129)..(1129): n is a, c, g, or t
  misc_feature (1136)..(1137): n is a, c, g, or t
  misc_feature (1140)..(1140): n is a, c, g, or t
  misc_feature (1146)..(1146): n is a, c, g, or t
  misc_feature (1157)..(1157): n is a, c, g, or t
  misc_feature (1161)..(1161): n is a, c, g, or t
  misc_feature (1165)..(1165): n is a, c, g, or t
cggggggaaaagggatgagagctccgcctgggatagttagaaaactaggctgctgcctggaaacccgcgcaatgcgcagtagacaggcctacttcccgggtacctggaccgggcctgggatccccgggatgctcaggaattctttcttgtcattcttgacagccctcctctgtgtggagtctctcgctggacctggaactcagggatcctaggcaggtcagctggaagggaagacacgcctctccataccaagcctgaggttcaccgcgaaagagaggccgccgctctgccccacctggcccnagccgcccaacctgctcctccagnagagccctgtgttcttcctggctgaggagtggttccagcaaagcgggctcttccacgtccttcagctcccccagtggcgccggatctaggaaangttgtgccttttgctganactctggggttgacaggagctcatctaacaggctggaggtgagtgcagacgagctncccggctcctggagcggttgggaggcgcctggatggctggcatctgtgcttgacgcggaggcctccggaggtggaggtgccccgtctttgggttcccacgccgccctggcnacctggggctccagcaccaccacggactccggtgggacgtgggtggcacaagcacaccttgcccctgtgactcagcttgagggggcccaaactgaacacgcgcccagcaggccgtcgcgcagcagtttctggtcttcctgtcatttgttggggtgcggaggccaccagggagtctgaggatgggagagccccagttctggaggagccagggcagggaacacaaagccccacatgtccaggcaggttgggagagtccttcttcctgcgcagcctggctgggctggagcaggggatggcccttgctgcctggctcacgaaagccccctgtgggagagccccaggggcgcagggcatgtggggtgtgggaagcgcaattccccatgcctgttgtgggtgaactggatagaggagggaggagggtgacaccaccagggttgccantnagtaccncagtgacctcaagaactcnaatgaaggaagaccttgcccgtctcttcaacttgaagtccagagctagaatgancagctannganagtganttcatagcgangaancccntggtcaactcaagatgcgcccctgggcccgctg

SEQ ID NO: 724338 - DNA, 380 bp, Homo sapiens
tatttgaaaattgcccaattgggtacaccactaaaaaaaacttgttttaattgtatttgccataaaccacctcaaattttttcatggaattttggggccaattcagattttttatttaaaattttaataaggaatacattttccaaatgccgtaatccaaatgtgatttagtgtaatgaaataaaatgtggtttagtgtaatggaagaccttttagaaaccgggggtattaactttgggtatatagggttaatatcccccctgtactgttagaggccccccattttagtatgggttgttggcaaagagtggtaccccgtttcaatgaaacaatgtatgtttgtttttactgaacttaaattaatacatggtttatcctta

SEQ ID NO: 724339 - DNA, 223 bp, Homo sapiens
ttgatgtggctctgcgctatgccaccccaggtgagcccgcttctccattctgcccgtgatggcgtatacagacagcaagcagctgaagcaagcagtaccgtacaggtacccactggctttagcccacttagtgggaagtctctgatgcctttgtgaccactggatgagtttaatcctcttgagttgatttcattgcccacctttgtgtgagtgtgtatcaaag

SEQ ID NO: 724340 - DNA, 146 bp, Homo sapiens
cccggagcagattaatctgataatggtcttagaaatgtagaaaatgataaaaaggtagacaggatgatctgtctagatcgtagcaaatgatggtacacattcacaacaaagtggtgccactacatataataaacagccacaaacaa

SEQ ID NO: 724341 - DNA, 128 bp, Homo sapiens
ttagtacccatgcatgcttggcttgacagtgagggtataatgacttgttggttgattgtagatattgggctgttaatttgtcagttcagtgtcttaatctgacgcaggcttatgcgccaatgcttgca

SEQ ID NO: 724342 - DNA, 470 bp, Homo sapiens
  misc_feature (353)..(353): n is a, c, g, or t
  misc_feature (382)..(382): n is a, c, g, or t
  misc_feature (432)..(432): n is a, c, g, or t
acagagtttcactctgcagcccaggctggagtgcagtggtgtgatcttggctcactgcagcctccacctcttgggttcaagtgattctcctgtcccagcctcccaagcagctgggattacacgcccgccaccatgcccagctgattttttgcatttttaatagagatggggtttcaccacgttgaccaggctggtctcgaactcctgacttcaggtaatccacctgcctcagcctcccaaagtgctgggattacagatgtgaggcaccgtatccagggctgtatgggagtctttctaatcagggacatagggcagacagtcctaggcccagctttatgcctttatgaggacgncaacaacgttggaacagttcattgttttnaggggacagtaggttttttacagatgggatggataaactaggcttttgtnggaacatttattttgtggaattttaggaattcaggaat

SEQ ID NO: 724343 - DNA, 202 bp, Homo sapiens
agatcgtatagagtatggataggagtctggatagagtataagtgggttatttgagaagtgtctcatctcctagagggctggatagaaccaaggcaagaatgtcaggtcagaaatacaagctggcagggtgcggtaatcacgcctgtaattccaacactttagaagggtgaagtgggcagcatcctgaggtcaggagttcgaa

SEQ ID NO: 724344 - DNA, 125 bp, Homo sapiens
ccacgcgtccgcttcgttagaaaagtaaaaatgctgaagaagcccaagtttgaattgggaaagctcatggagcttcatggtgaagtctgaactttaaatagtggcaaataaaaagtgctatttgt

SEQ ID NO: 724345 - DNA, 135 bp, Homo sapiens
ctataaattgctggcagatgctttacagtcaatagtgttgcttataaatagtgcccctcccaatatgctatgaatgttatggcctgatctccaggcaaaaggagtgagatgaatcaataaccagtgaactttttt

SEQ ID NO: 724346 - DNA, 219 bp, Homo sapiens
atctgtacgagcgaccaatcatggttttaaggatactggaaaaaaccgtggagcttgaggtggaattcacgaatcgaatcacctaacaagcgcacgtaaatcttggaaaaggtgtgtgctgacttgatacgaggcgcacaagaaacgatctcaaagtgacaaggaccagctcgaatgcctaccaagacctttgcgaatcactacaagaaaaactccttg

SEQ ID NO: 724347 - DNA, 961 bp, Homo sapiens
  misc_feature (272)..(272): n is a, c, g, or t
  misc_feature (308)..(308): n is a, c, g, or t
  misc_feature (426)..(426): n is a, c, g, or t
  misc_feature (748)..(748): n is a, c, g, or t
agcggagaatctccgtcagacgccgagatgcgggtcacggcgccccgaaccctcctccgtgctgtgtctggggggcagcggtgcctggatccgagagcgtgggtctggctccgctacgtcctagtgatggttattttggcgtacgctcgcgtgttccgctggcgtcccggccgccggggaagctcccggcttcatctcgacgtggggcttactgctggacgtgcgacccagattcgttggagcgttctgatcggtcgtagcgtccgtcgagntctcggagggacgggtaggcacccgatggcgcacgntggcaattacagcaaagaaggaggctcgcgagtgtattgggtgacgctgggaaatgacgagcgatgagtctgcgcatggagcgaagcatgatgagacttctacgcagaggacgacggncgtgctgcggaagcctatgtggtcgggtcgtatctatcagagccaagcaggccgataggacgcgtgcgctcgtcgagacacaacttccgcagtacgagatggtaacagggctcgcaggaccgattgagcgtggccgaggaacggtggacggctcctcgctcacgcgggcgcaattgagccactgtctcggtcgctaactgagtctgggagaccgggaattacacatgccgacccgtggagaccgaagaatgaaccctggaagtctctccgttggacgcttgcgggatgtgatcacctgccaggggtccacagaatctaagcnagatgcgaggcaatgctgcggaagtgcgagtcacggtgttggaggagagcacaatgcatgacaagtgcgctacacttaggaggggcaacgatgcgtgtgagctgtgcctccgacaacaagaggcgctggaaacgagacgcggaacaggaggaccgtcgtgtgaagagccgaccggaatcctgcgcaagatgaacaggctggtgaaccctaggc

SEQ ID NO: 724348 - DNA, 86 bp, Homo sapiens
tggacacccatcgagagcatttggggcattagggaatgcagcatgactctcctgaggctactgtgtggtttacacatttttccatt

SEQ ID NO: 724349 - DNA, 129 bp, Homo sapiens
agacgatccccaaccaactgaagcacgggccataagaaccatttccacagccatctatccttggaggaagggggagcttactctctctgaggtagtggagatctgagagaaggatgtctgcgttgtagc

SEQ ID NO: 724350 - DNA, 299 bp, Homo sapiens
gattcagggtccatttaaaaaggtaaataatcatatgagaactccttatttttctctataaccggattttatcttccgtgggtccttttacttcacaaaaatgagccccttattagttttatccctggtatgacaattagttacatggcccccccctgagtactaaaaacttaatataaaaccctggctatagttttttatacatatgagaaaaaaaaaagtaaaagcccagtttaaaaaagacagattcaaagcttaaaggagaaaaaaaggtttaaatgcccgtttagtaactagga

SEQ ID NO: 724351 - DNA, 309 bp, Homo sapiens
atcatatataggtaaagctctaagactcctgcagcaacttatatgtaactggcttacctaggctggggcttgaactaagtaaagaagccaaggagtacagatctagatagcagagaagtcagtctcatactaaaacattgcaactactgttagagtccaccccatgaagctgtaacagatagtgtatctttgactgaattctataagtatatatggtacagactaaaacaatatgtggctagctaggtaggctagcctgtctcagtaggacattgacagactccagctatcaccctctgaagaccttgg

SEQ ID NO: 724352 - DNA, 1070 bp, Homo sapiens
gacttatataatttatttctatttgtgtgtactatagtcttgttgcatatgtagttgaacacacagtgaaagtatatgctgctctctttgtggatggtgacggacataaaaatatttgaatgtctggtgagaagagagccagtgtgtataggtcagagaaaagaacagttcccgactccctattagcgcctgtgattagtttcctttctgtgtttatctgggcctagctgtgctgttatctttaaagccaggaagaagttccgtcttttggaggctcttctcacctgtccagccgtgggcatgtcagagaacacatagcctgtgacgaatgccgtgtgttgcaaaggtttacttcaatttgctagtaaatcctagctgcctcaagaactcctacacctaagatggacattccctttccagaacatgggatcaagtatctgctcacttcggtattggatggactaataatgtagctccaaatatgcaagggatggaagaatatgtgtaatccaaaaccaaggcaaggaaatgaacaagtgaacgtacctgtctgttaccacccctttctgtgtgcgttatagtctggttgcttcactgtgcataaagtggtttgcacttgcgagcgcttgttaccataaatatcgtgaactatgttgtacagtgacatgtctttcgtgaacagccgagtccagttcaacgactaaccccttctgggtggctgctgacagatgaactggtttaggttgaaacccgaacaggcccctagagggtacttgcatatcctggcatttgattggatataagtctttcgtgtacacttcctgtaccattacaatttgccgggcaaagaagaaatcctgtatattttggtcaactagggcttctaccagacagcgcaaatcacaggtgcaaagtagtcacgaggtcggacctgaagggagccccgatggggtctccccacctaacaacgcgtgggttgtgccaccgctgggcacgatatcatagcgctcgagagagagtctacgtcttcatcaagatgcgactatatatctacacaagaaagtcagtat

SEQ ID NO: 724353 - DNA, 116 bp, Homo sapiens
cagttagtgtctctgatttcttgttagttcttgatgcaacatctcaatgagagtatcttcatcagttccaaggcccttcatggcagcacgaagttcatcagcatcaaagttgcgct

SEQ ID NO: 724354 - DNA, 141 bp, Homo sapiens
ggatcccttgcttgatagctgatgtcctcaatctttcagttttaaattcatcagaagaaaatctgcacaggaatagaaacacaaaaggcattttcccaaaataagtggtagcttaacaatttccccatattccacattctc

SEQ ID NO: 724355 - DNA, 236 bp, Homo sapiens
aagtacttatgctggctacagtatgccagatcacatgaagagaacactcgatgggaaagatgccttaatatccagctgacacaaagtacgaactaatctgcatgtataacagagagcagactgacgtagggtggaaagcaggacagagaggggcgccgaatgctgaacggaggtgcttcaaggagatgggaaaaccagagctagtgatgtttctaccagcgatacgccgaccgagc

SEQ ID NO: 724356 - DNA, 829 bp, Homo sapiens
gtggagaggaatagatttgtgttgttctcccgccccccttttttgtgtgggaagaagcggtcgggggaggttggcgcgcccctccgattttttcttgctgagagctgtggtgtggtggagtggtcctccccccccctgtctgtgtggtatgtaaatggggttctgcctcgttcgcgcgcgccccaccacggcgtgggtgttgtgggagagagcttgttctctctcacgggtggtccgccccccctgtcgggggctgccttgtttgcttctgtctggtagatatgttaggcgcacgaccaacacaatctgctggggtgggtggcgcaccaccaaacagcacgaggtgcaccagagaagagacgtcgctgtggggaagctgcgcaagggtgtctcaccacagatgttgtctgctccccgattgactctctgagaaggaagcgcgaatggaaaaattattctctccctctcatgactcttcccccccccccccctcctttattaccatacgtgtggtgggtggagaaagacacgtctctcacgaagactgtttgtttgttgtatatctgccgcctctgtgataatttgtgatgtatagtacggtggttgtcgaatgacgacaccatgcctgtgtgttgactcctccctcgcgaggagaaacagaggagtaatatttttttttgggaaccacaccttgtgttttctttttttgtggtgctgggcggacgcttttgtggatgatgtggtttgttggaatcatccccttttttttgggcccccccccccccattttccccacttttgtgggccccccataaaaaattaataaaga

SEQ ID NO: 724357 - DNA, 129 bp, Homo sapiens
gagctcgtaccgttaattttgagcgctacagcgccgacttcgatgggtaaaggcacgggctccgtggaaatctggatccgatcaacaccgacatcgcctgaccgcaccattggcaggagcgagcatgtt

SEQ ID NO: 724358 - DNA, 877 bp, Homo sapiens
cctgtggctggtgcctggccttcgcccgttgcttgggggagtcgtggtgcagctgcccctctggctggtccttgtttttgttgtcctgcgatcttcctgtgtgtgagcgtcgggtgtgttgatccgttgcccccttagtggtgcaattggcccgggttcgtcttatccccttgggtggcacattgtctctcatgtagtgaattgtttgtggtgaggccccacgtgtgtgtggggtgtagccacgggagtcggttgtcggctgggtgctggtggtgagcgcacaggttcgccccgcgggggcccgctctcctacttcgtggtgcttctgttgttgctccaccggtggtggccgtgcgtttggttcctccaaggtgccgtgtcatttctcctataagggctttacgaagtatccgcacgcttgttgtttgggccccacccgctggggtaatactcccctcgttgtgtatattccgcccctggatgtttaatcccctctcatcggtagattgtagattcccacctttgttaccacgagcttcccccacgtggcggatacggctccctggcccttgctccccaccctcgtggtgggagccctctaccgcgctggaggagcgcgttgtaaaggagcccgtgtcgcataagagagacttagcttgctgtgttaagagagccttccattctttagcacgagaggagtctataatgatgtttccatccattgtggcccaataggacctgccaaaggctgcagcttgcacttttgatggatcgccacaagagccccctggcgtgaaactccactcacccacgtttagtgctcgaagcagccaatttatttccaagcatttccataaaccttttttttcctcaggtc

SEQ ID NO: 724359 - DNA, 256 bp, Homo sapiens
catggtgccggctatctttaggacctcaagcggcagtgcctggaggcgggagtacactagcagacgcaggagacataccagcagctcagcagaaacctgtgcggatcccactgagagcacgccgcacgcgaagagccttgaccgtgtcagaatactgccgcgacacgatgacacgatcgacgcgcattagaaacggctctatgacgagacgcgcggcatggatctacacctatactgcagacacacactgtaagga

SEQ ID NO: 724360 - DNA, 1256 bp, Homo sapiens
  misc_feature (313)..(313): n is a, c, g, or t
  misc_feature (1117)..(1117): n is a, c, g, or t
cgagcaacatgcttgcggacctcgagtttagtcgagaaccataggcgaggatagagcgaggtgccggtgtgagccgcgatgtctgtactccgtgggtacagaggaaggacggatgtgggcccgattgtgctcgggcaagacgatcaaagaagcttctggcggaaagaaccggccaagtgctggatttcaactcctgactttcgtgtctcgagcatgagcaaggaggggacgtacggatggcagcttgggccctgggctgaatgtcaatgagaccaagcgtacaagtaagtaagcagggcatgccagcatacgntgtagaacgtgcagtaagtagttgaccgaatacggttcggaccaggagaatggagcacaacatgcagaggcactaccacgcagacgcgcataggatcatggggaacacaattggcggaggtcgccggcaagacggacgataggccaacaccgggatagtgggcgatccattgaatagctcgagaatctgtagggcaacggggaccagggcaaaccctttacagagcggaagggaaactggactttgcacggggcacaccggtggcataccaaggaacacggcacttggacatgggcctatcacgagaggacattctggagagtcgtgaagcttgtccagtacaaaagggttctcggacatttgtggaagtgggaaaacaatttcggcattccgatgggataggaaggctctggtgcgaattcaacgaggcgttaccggaaaataatggcttcacacccaggggggattgcgaggggaagacgttaaagggaaacatggaaaaggaagcaggcaagagatgtgggaaccctatgggggaacaaaggcccagaggcgggcaagggcggaacacttcgtctcttcccactctggcagcgcgcacaactggtagtcgcaactccctcttggcatagacattgggcgggaaaagttagggaaaaaaacccaacaccgcggtcgcgcaacccgaagtttgccaccaagaggggggcaaaccgcgggtgggggaacaacagccggataattctcggcggcgggacaccacccgcgtcacagtagctccagcagtggaacacaagagggcanccccaaagtgcaaaacgaacacggacgcggccaacccgtggggagggtgctgcttgagcaaccacagactgcgaccagcaatgagagcgcccaccgaaaccaccgccccgccgggcgaagttccgagccaaagcggcaa

SEQ ID NO: 724361 - DNA, 348 bp, Homo sapiens
cgtcgaccaataccgtgattcgctgagtgctcacttattcacctcattggctgcttcagtaaagtatttaacagcgtcctcggcggttatgcggatcatcccgtttggggcttgtgatgaatgaccaaattcaagccggtaagcataaggaacgttgttggcgaaatagatcgccttagtgccgactttgaactgttcaagcatgtaattgcccgcagctattgtcatgttgccacttttatctatgcgccctgtttcgccgtccggctgagcatctaagccaacctgccagttacctctaaagcgtccaccggtatagccagcaggtgctttgacatccgtcgacgc

SEQ ID NO: 724362 - DNA, 308 bp, Homo sapiens
tggtcacacaacctctcactcaggacaacaccataaccagtgctgacagcaggcacaaccgagcacagtcaaagcattcctcctccagtcaaggactgaaccacccttcagtgctgacaagcacagcaaaaatccacagctaccagctttacagccatcccctcctacaccctgtggaccacgtggaccgtcccagcacagaccaccacacccatgtacaccatgtccacaatccacaccttctctaactccagacgacacccaaaactacacagtgctgaccatcacagccacaatggcacgtggat

SEQ ID NO: 724363 - DNA, 230 bp, Homo sapiens
caaattgcactcttctatatctaccttgcttgaatttgcactcctcttctccatgctggcacttgaactcccacctgcacacatgacattttgttcctcgtgcgtttccgctagggcaccagacgtgacatatgaggatctccatgcaccaaccagccatgattggtgaagacgctcccggaatcagtgaaggctcgagcagcacaccgcgacagctgcttctatagata

SEQ ID NO: 724364 - DNA, 421 bp, Homo sapiens
caaataatacaaaatatgccccagattttaaactttttttacaacatgtacatgcattggatgcaggctaggcatcattatcatcagactttattacaactaccacctgctatgggagaagagggtgaggaagatcacattcaggtagcagaatcggaaacagaagaagaggtcatgactgttcaagctgccataatagctaggccaacagacaccagctgccgtcatgaaattccagccttgcaacctgaacccagcctcagtgggacagtgcccatttccattcaagagccatccctgcattatctgggacaatcacttaattgggggggggtttctacaagacagggcggtcgcccaaaacgccgcccccccctcctttttttctgctcccaaaaaacaccgtggacaggttgaagtt

SEQ ID NO: 724365 - DNA, 474 bp, Homo sapiens
tggtggtggaaggcagaccatactcctacatccagcattccctgttagtcagctcagtgtacagcaccacagaagatacgcagcccctccatggcaccacagccaccacagggctccgaccagtaaccgtggatcccacagacacaacagacaccagagaacaccctgacattccgcctggcatccaaacagcagcgggcaccctgaacaggtcaacagaatgatcagatagagggagacatctgtaaataaagtctacatttctctattatggtataacagtaatccttgtctgtttgcttatacttatatataagcaaaaacttcaaatatagagccgtgtgcagatgttaactgcatgattacagaaattctaaaattttatattacttaccgtagccagcacccctctcaatgtgtggctcatgtccattaacacagaaaatctgtcctcactacatgccatggggatcc

SEQ ID NO: 724366 - DNA, 694 bp, Homo sapiens
cggcgccctttttttatgtttttcggattaaattcttcagactaaaacaggggaagagggtgatttatatactatggtttgtaaccatcggccacaaattaaaccaaaaaaaatagctccacaagtgtcacaggtccagggacagaggaccaacagtgggcatactgagttctaatgacacaaggtgctactacacctagcccatggaccaatccctcttagtgacgcgcgcggcgacaggagatttataggtctgttgcgacttctaagaattaaaaagtgcccatagccccaattattctatacacaaagaggaccaacaagcatacaccacctctattaatccaccattcacgtacgttaactgagagagtcagaaaccacagctcgagcctatactgcaagtacaaccacaatatagcgccagtggcccagatacagctgtacaccgcgctataacagataacacagtgaaaagagcccaacataacatcagtggcacaacatactctgcgggcaaagaggacacacacctatcagcagcatgataacacacgaattaaaacccattgcgacctcaataacacctataactcaatttgtgtccaccaacgtacataaatgacatcacgtgacagtaatccattagaaaaatcgattgataagcacttaaatacacaaagcgctacacgga

SEQ ID NO: 724367 - DNA, 389 bp, Homo sapiens
  misc_feature (321)..(321): n is a, c, g, or t
ctgaccttttttcatcaccagcgcatgaccgtggagaaaactgtgtggcaaacgcgctgcataagcgtattcaccggaacaatcagtacgccacgctgcatcgtcggtagctggtaaagggtggaaaggcgcgaggagataatgtcctgatgaggcgaaaaactgtcgtagggaagagtttcccagtccgccagattcatcaccatttgatcggtaaactggctgatttcatcatgcaaacgcagagcattttgcatatctggtgcaatgagtaccaccggaccggcgtgacgttcggcaatttccctaccagcgttgcancagtgcgccggttaactcgcccagcagacgctgctcacccgctttgacgggcagcgtataacgatatt

SEQ ID NO: 724368 - DNA, 480 bp, Homo sapiens
ctcaatcacgatacataatatttacatctcatgatattattataaataatagctatcagggacgggagaagtaactcatatgtccatcaacagattaatggatcaactgtgtaacagccataccatggaaagttactcagccataaaaaggactgaaattctgatacatgccacaacacgtatgaaccttgaaaacattatactaaatgaaataaaccaatcccaaaagtacaaatattatctaagtccacttatgtgaaatatctagaacaggcaactttatcgagcacagaaaatacattagaagttaccaggggcaaacagagattactgcttaatgggtcagcgtgtttggagtaataaaaaagtttcagaaatagataacagtgatggctgcacaacattgtcagatgtacttactgccactgaattgtgccctttaaaacagggcaagttggtaaattttatgttgtttatttt

SEQ ID NO: 724369 - DNA, 594 bp, Homo sapiens
acggaagaagagcctgcagcccatgaggcaaacagcactgtgcccttgactcagtcgtgctgtcccctcccatctccctcagactcctctccatgaccaagtcagttaccagccgctgatacttcatggcatacccagcacagccgggcaccaagaggcacaacccaaggcctggctaggccgtgttaacgatagtacagacattaattcaaataactttgtgtaatactttactggaatagtaagttcttgttgaactgtcacaggtgagcttctaggaacacaccaggtgtggatacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttcaaaccgaccatccgagagtcccaattccctgtataacagcattaaaataatctgcctgactggaaagatgagaacactgttgcacaacccaaaatgtgtctttcatccgtgacccattaccatggtgagtcag

SEQ ID NO: 724370 - DNA, 1083 bp, Homo sapiens
  misc_feature (811)..(811): n is a, c, g, or t
ggagagaactagtctcgaggttttcttggtttatttttagtggcttccggccgtctcccaattcgaaaccgtctcccgcggcggccgaggcgggctgcgactccagtggctggctttcactttgtcgctgtagtcctctctcatcgttcggtgatgtgcagacactttcccgtgggggccctcccgcctctttgcgcacgtcctcgtgcccgccgatcgagctcctttcttgctcccgctgcctccttctgctgctcccgcatcttgcgctcccgctcccgcttccttttctaacgtgcctccaaggcggtcccttttcgtctccgtggaagtgcctccctttgccaatcttccccttctctctcgtggtcttttcccatttccgcggcgagctttatccgtggttcttctcgagtgccgtttccgacgtttcggtgcctcctctttctcttttttctttctcacttcatagcatgtgctttccccccctttcgtgcgtgaatgtggcctacgagtggcctacggttccctctttgtcccctcttttctcacctcttttcgtggtgagtgagcctttatcctttctcccgagcacatttgtgcttggggagtggtttagagtggccaagagaaatcatctttcttctcctcgtgatcttccatagagtctctctcttctatacggggaagtcccttatgggtgaatctccatgcggggatctctccatctccccctcctcaggggaatcccgcgttggaatcccggctcaatcagacggcgaccattttgcgacgctccaacgagaacttntccgcgaagaaacgcgttgttccatactggcaaaacacttgagcggcaccagaaacctatcaaactcctccctttcaggaaacaacccctcttttcactataacacaaaataatggcgctctaacatttctcataaacacgcggttaaatcacccaggctatacttccctacttgttccctatcctatcggatacctttcctgaaaaaattatccctcaaagcttcacatttcccaaaatcccttttattaacccatttcagtttaaaacac

SEQ ID NO: 724371 - DNA, 161 bp, Homo sapiens
  misc_feature (10)..(10): n is a, c, g, or t
  misc_feature (38)..(38): n is a, c, g, or t
  misc_feature (120)..(120): n is a, c, g, or t
  misc_feature (131)..(131): n is a, c, g, or t
  misc_feature (153)..(153): n is a, c, g, or t
ggctcacctnaactgaatgcaggaggggcagtgctttncaccagaaagagcccatgtgtccttctcaccatcccctgtgcttacacccccagtcagcatgctccgggggtccctgagccnggccgccccanacggcctccttccctcccaccnaccacccc

SEQ ID NO: 724372 - DNA, 1655 bp, Homo sapiens
atcggctttcgtgccatagctttcctccagcagcccaggagtttgacttacaaggaatctggagtagatatcgcagctggaacatcatgctggtcgacagcaaaattccagcctttcagccaaaagccgacttccagatcaggcatgtcaaagttgatcttgcgaggttcttgctggtcttctctctgatcttaaacagcagcatgcgtttcaaagcatcccctctctgggcctcatgcgcaacagcatggccgcttggcaactcaacactcacacacgcattgcaccaagcctcatgcacaatccaacacatgcatcaccacattggctcaacgcatccaggctcaagccacatgctgtgttacaatcgcatcattcctcggcccaccacaggcagccagcagccccacatcgtctcattacactctcgcaattcactatctgaccatagtcgcgccacaacacttgagcaccctcgagctgtcacactcgcaagcctcgcccgttcgcctaggaacatcgcatcaaaagcccttcgctgcgcaccacacaccatcgcgcatcgtcgcctcctcccattgcgcaatgtcgcacacaaccaggccaagcacaccatcgcgcctcgcacccatcggttcatcacacgaccctcgggccacgcaagctcgatcgcacccctcagccactgggggatacccgcccggctctggtggtggccccaattgggctatcgaccggaccgatactccacgacacaatcctctccacccgtccacgcccttgtcggcaaacacggacaactcccacccatcgcaagctgaggctcgcaacctggctatggatcacgagtaaggagaccactacgcacttactcattcactcgggctcattactaccagctaggcacaccactcggcgcgacactttatacggaacaccttcgggtttgggaactcggcaccacaacacacctcgccgcccggcgccacaaccacagtagtcccctcctcgccagcgatcaccaagtggatcgaagactcatcccctttccctttgccaccatgcccgacaccgcttgagcaagctgcggcacacgctagcagctgcgaacccaccacgaacacgtctcaaccggcctggcacaacatactcacacttcgctcactcacacgcgcgcccgctactcacgacaacactcacctcactacaagccccattgcctgaccttggtcccagacacctgtgtcgaccacacgacctcacatcagggagccaactggttctctacacagtctccgtctggtctgcaacttcatttatagtggctcacgaccagacacatctaccatcagccagcaaccatctcctctgcacacaagagctaccactcgccttcgagctaaccacctgcaggcagataaaccattagacagtcccacacacaacatatcactcacaccctcacacgcatggacaatctcttaactgcatgtcacatccacacaagacgacactcactcaccactgcgaacagtgacgccaaactaaatacataacttgcatatcccactaccacatttgtgtccacaactggcacaacaaaccaaatgtgaatagatcacagacgagcaacacccaacgaagacagcaacaac

SEQ ID NO: 724373 - DNA, 156 bp, Homo sapiens
ggaagggggggggggttataaaattgtaaatgtttttaaaaaaacttgggaatgaaaatgaatcccagggtttcatgggaagaggttgggcccttggtttcaggccttcctgtttcagggcagaaaattttgaagattaaaaaataaaataatcca

SEQ ID NO: 724374 - DNA, 986 bp, Homo sapiens
tacggggacgccatctgaggactgtatcgcaggtccgacggtgtctgctgcgccaggtgtgttggccccccggggggacacgctagtgttgggggcgcgcgtgtggggcccgcctgggtgcggtagtgcgcctgtatgcggctgcgcaggtcccttgggtgagtgtccgtggtgaaaccgacctgggccctgcggaaatgttttcgtagcgggccccccttatggtttcccggtaacggggggtaaacggccggcccacctgtgttttttgccttgcgagggccgcctgccagttaggatcgacgtaccctgggtgatctgtcttaagagacagtcacggggttaccaaagtggaagcccgtggtgggggagaatgttgcccatgccgaccgggaaaaccaagcgtgattcttaacaggtggacattctgccagccgtccccagattggcgccggtgtccaatccccgtgtgttacacgattttgggtaaaagtagacgccccccgctgacaattggggtttagacaacacagaggcacggcaccactcgaaatcttgttagcccaacagcatgaggtgccaaatcagttgtgaaacacacagttggggcgcacgacgaagcctagagtcggaggtacgccacaaatagtgtatcacaaggagtcgcgatcttgagggaagccggcaagtggaataataatactcaaaaatttttgcgggggagatgtgcgtgaggtttgcccgcttataaaacacggtgttgtgtctcgttaaccacagtgcgcaccatcctgcggtacatactttcgtggtccaccatgttttgctggaaccccacccccaagcagtcttaattgttcaagtgctaagcaccacccacaacgggcaattcaggggaatttggcgaaagataggagatgttgtcaggacaagtagggagtatcttgcatttcgaaacaaaaaaaaagggaaccgggccccacgca

SEQ ID NO: 724375 - DNA, 346 bp, Homo sapiens
acttagaggatccctcctacaaggtacgctgagctggtgcccatgggctgagtggactggcgcgtgtggtacacctgctcaatggccagcagatgggtgtggtcacaggcgccgtcagacctcatcacctgtctctgcaagaagcccccagtctcgtacaaggccccgcccttttctttctttggccgcacccaaggcatataggagtccctggccagggattgaatctgagcctcaggtgatacctcgccacaagttgcagcaattgccaggtcctataatccacttgcaccacaagcagcaacctccaactcttgcttcaattaaacggctgcgtctagctgaa

SEQ ID NO: 724376 - DNA, 396 bp, Homo sapiens
ctttcattattgaaattcaaaacggagaacatataattattcaaaagataaaaagtaaaacacataccttggttttatagtataactaactaagataaaaaagaaggtggactggctgggcgtggtggctgacacctgtaatcccagcactttgggaggccaaggtgggtggattacttgaggtcaggagtccgagacgagcctagccaacatggtgaaaccctctctactaaaaatagaaaaaaattagctgggcgtggtggctcgcggcctgtaatcccagctactaaggaggccaaggctggagaatcgcttgaacctgggaggtggaggttgcagtgagccgagattgcactactgcactccagcttgggctacagagcaagactctgtctc

SEQ ID NO: 724377 - DNA, 168 bp, Homo sapiens
gcgcagtgtcgtgatcatgggaagctgcaaggggtgccgtttgacatccactctgacagatgagactgcccagaggctgcaaaagactggctcctgttgagactgaccccagctggcgacatgaggcacagtagggcagtccggtgtatggccaggaacgaaggctct

SEQ ID NO: 724378 - DNA, 134 bp, Homo sapiens
agacgtcattcttgcatccggcactgtgctcttgatagggaatgagtctcacgagatctgatggttagaaaaagtggaagttgccctgaacaagctctcttggccggctacgcgagttcatgcaagaagggacg

SEQ ID NO: 724379 - DNA, 156 bp, Homo sapiens
ggcgaatcctccatcctcctctactcctgccatcagctccacacgcccttagccaacaacagctgaatcactcatcaaaccatcatgtgtcttcactcggcagaaaccaagggctatggacagaacgagtaaatattctgcacctcacacaaaata

SEQ ID NO: 724380 - DNA, 219 bp, Homo sapiens
cgaggatccatgacgaacaatgtgaggtctgtggagtcataatactgtgatctagtatggtcttagtcagctcagagacacaaagcttctaggtcattaggcaatgggtgggggttttcctaagcacccatagacctggtttctttactgagctcgtttttcttttggaatggagtaacctgggggggttcaaaagaaaacgaggtcgtagacagtctg

SEQ ID NO: 724381 - DNA, 120 bp, Homo sapiens
tagtattgaatctcgctcaccaccggcatcgtattggcgtaagtgaatctgacgggcagaggacagaggaagcttgcagatgtttcattatcagacgaagtcgggtcgagacgatcagat

SEQ ID NO: 724382 - DNA, 144 bp, Homo sapiens
gtggccggtggggggggactgcaaaccggaataatgaaccaggaagaatccctgatattcctgtatttcttccacaaagagccactcaaagggccccactaatggccccaccacgatgacacgaagtagccacaccacgagcct

SEQ ID NO: 724383 - DNA, 173 bp, Homo sapiens
ccttctacgtctcatcactgcttgttcggtgcggggaggggacttgggccgaagccgccccgaaccaggtgcttatgtgcctccaatatctgcaggtccggtagtaacatctgcatgacgttttagtggacgtcactcactgccaccctgtcccagtgatgagacgtagaagg

SEQ ID NO: 724384 - DNA, 822 bp, Homo sapiens
aattccctttagctatttatcgtgtatgcacatctgctggcagcaaattttctcaggtttgtttgtgtatttagtgttatgcttggttttggaggctgggttgacatgagacaaaagctctcgatcgtcaagaaaataataataagtaaagaagtatagtgtgcgctggatgcagttgttgttatttatttatcctgcttggggatcataaagcttgtatcagtggtaggaaagttctcagcctagtatttagtttaacgtagttccttctgccccatcttcctcccttcttctaagactccagtgacgtatgtattaggcctgttgcaccacttcccacaagtatctgaatgtacttagcatggtattgttccatactctttgtctctgtaagttcagcttagagtgaatattactgtcctgtattacagttcaacagaatgttccttctgctaaatctaattgtagttaacccatatgctaagtacttaatttgcacgtgactgtgatacagagttgttaaagtttccatttcattctttcttatagattccagttctttgatgaaagtctctattccacccatcaaagtctgtgtctgataacacaatatctgggtcataagtggctccgtgctgtagagtctgttttcccctccattcctgtttaagtgcaggggtcagatcacttaattgttgacatgctaaccattctcacttaaatttccaagtggctccaggcaaaaaatagcatactcaaggtgtaaaacaccaaaatgggtggaacggcccctggcccctcagtaaaagactttttcacact

SEQ ID NO: 724385 - DNA, 213 bp, Homo sapiens
taaattccaaagaccctatcacttgggccaaggtcctccactcaaaggggatccagtaaatagtggtggaagtaaggtacttacgacaattattaagatcaggaggaatagtggtttatcatccaggggttaatagtcaaatattggactttgggttacccatttaggggaataattcacctaaacacgccataaatctatttaacaagagga

SEQ ID NO: 724386 - DNA, 424 bp, Homo sapiens
atactgtagaagacatgataggtagctgtgccataataatcccagttatctacgaggaggctgaggcaggagaatcactatgagccctgggacatggagcgctgcagatgagccgaggtcatgccatagcactaccagcctgggcaacagagtgagaatccatctcaaaaaaaatcaacgaaggcatccaaggaaggcattggagaggtatcaagacaagtcagagtagagggacaaagatcccaggaagaagagcagttcagagcaggtgaagcctggattctggggcagaagccttcctacttatggcccctatccactaacaacaaatcgctaagttgagcagccagttaatatcttcaagaaattacacgacaatgagaactagagcttcccgctaaaaactgaagtttaggatgaggag

SEQ ID NO: 724387 - DNA, 911 bp, Homo sapiens
ggtggggcagctcggcagcatggcgtccgtgacgctgagcgaggcggaaaggtgtacatcgtgcatgggtccaggaagacctccgtgtggatggccgtgctgtgagggactacccgatgtgtcgaacgtgaaagactgatgtgggtgtcccaacacctagtgggtccgccagggtcaagcctgcgtcacacagacaatcttggtgggagtggaacagcagaaagttgcgggcacgccgaaagctgggaagaaaccaaatgaagggctacttggagttctttggggtgaactgttcacgccagttgctaccccctggaaattgaagggtacaaggacggtgattgacccttgggccacccgagatccggctaaagacctctcatatcgggatattttaaaaccaaatgaaacaggcagtgtttcggactttaaaagggacccttcttgatttagtcccttcggggcagcccacgtggcttggggctccacttaattgtgggacatggttgcgtggctatcgtgggcaagtgtgggtgggcacaaaatttggtttgcgactgcccatttacccaattggccttggtacacagggcctggccttcttctttcaaagtaacaaggggattaccccaacgggggtccgaaggtctcgcagcagcgctgaccacgcacgggggggccccgcacagggcaccttctggacctgtgttgcacgatttgaccccttttatggactggtgttccgaactacaggtgttgggcgacaattgtcccccgtgctttgggtccctccttgtgccacgactgggggttatccggcatggtgggcggatgctactccttccaggagggaggccttgtcggtgggccgttgggggggtcggtgaccccaaggggttgtgccgtgctta

SEQ ID NO: 724388 - DNA, 749 bp, Homo sapiens
agcggctgtgattgcaggcgcgcgctgccacgccggactagttttcgtatttttttggtggagacagggtttcgctgtgttggccgggctggtctccagctcctaaccgtgagtgatctaccagcctcggtgccgggattgcagacggagtctcgttcactcagtcctcaatgttacccaggctggagtgcagtggcgtgatctcggctagctacaacatccacctcccagcagcctgccttggcctcccaaagtgccgagattgcagcctctgcccggccgccaccccgtctgggaagtgaggagcgtctctgcctggccgccaatcgtctgagatgtgaggagcccctctgcccggccgcccatcgtctgagatgtggggagcgcctctgccccggcgccccgtctgggatgtgaggagcgcctctgcccagccgcgaccccgtctgggaggtgaggagcgtctctgcccgggcgccccgtcggcagaagtgaggagcccctctgcccggcagacgccccgtcggcaaagtgaggagcgtctccgaccggcagaccgcccgtccgggaggtggggggtcagcccccgaccagtcagcctcacctccggggacaggagatgggggacagtcccgacgcggacaagccaaacgctccgagacggcaaagtgcagcgccagcccgcgaacccggacaaccgcgccgactgggaggagaggtgggggcagccccgccagagccagcagacg

SEQ ID NO: 724389 - DNA, 997 bp, Homo sapiens
cgcggtggctcacgcctgtaatcccagcactttgggaggccgaggcgggcggatcacgaggtcaggagatcgagaccatcctggctaacatggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagaacgagactccgtctcaaaaaaaaaaaaaaacaaaaaagaatttttttttccgggttgatcccttttgaggcatattccacttcgtggttacagacagcgaatgtagctctgggctattagggaacaattcacctcgggggacattttccagggcataattaacccttgtgctctaaatagagtcacgtgcgtcaggttacctctccacaaaaacacttctttgttggggaatctgcgctttttttccgccccacgccgcaaaacaggggattccttggaagatcctgaggatgaggaactcctgtgcaccgctttacccgagaaagccattcgctggccacgggatatggaggcgctcccccggcgtggtgtgaactctcacagccttaagggcaagcgctgttgaaaggccagaagaggacaccgtctggaaaccatctggcgggggttccaccccttggcggccaagcagcgagagagagcacagcgctggtccttctttaacgacgaacaacctgggttttgcacattgacccgcggtgtttgggtggcacaaaacccctggtatgtcccccaggaataaccacgagagagcttaaggcacacacgaggacccactttggtgaaccccaaaagttgggacgagttcgatgtgaacctggtgagtggccccagtgtattccacgtcggggacaacaaggtggaaacccttcttccaaataaaacaaggacagatgc

SEQ ID NO: 724390 - DNA, 587 bp, Homo sapiens
  misc_feature (54)..(54): n is a, c, g, or t
  misc_feature (178)..(178): n is a, c, g, or t
  misc_feature (456)..(456): n is a, c, g, or t
  misc_feature (572)..(573): n is a, c, g, or t
gggggtcatttaaattaaccctctgaataggtggccccatgtaaacaatatttncactgtaaattgtgaataatcatatatatatttataccccatggctaactttacactgaaaatttgcggcgtttttccacataggatgccttttatcagcagataattatccgctttttaatgngggggggggggaattactacacttgccgtaacaaaaaagaatggcacgtgactaaatgtgcattacctttcggatatacgtgctctcacatgaactgtgcttcctaaacattgagagttgagttgtggccttagtcattgactgaatgtttaactttctttcttgaatcaccgttaaagggaaatggggctttactgttaatgcctaaacaatatgctccatcctttcaaagggaacataaaaaattcgcttttgaaattaataacccccaacctaanataaaaaaatggaaggaaataccaagcctttattttgcacaagaaatctttctcatcccgaaccttggatacctagggcctttctccctatatcttttttaaataaatccttttgnngcctcttgaaactt

SEQ ID NO: 724391 - DNA, 1158 bp, Homo sapiens
  misc_feature (314)..(314): n is a, c, g, or t
  misc_feature (343)..(345): n is a, c, g, or t
  misc_feature (351)..(351): n is a, c, g, or t
cagcctctcacactctcctcactctctctcatctcctgtgaaccatgtgccagtacatccaccaccatcaggagccacagcagcagccgccggggtttcacgtgccaactcagccaggctccctggggtcagccgctctggcttcagcagcgtctcctgtgtcccgctccagggtgcagtggtggcctgggtggtgcatgtggaggagctggctttggcagccgcagtctgtatggcctggggggctccaagaggatctccattggagggggcagctgtgccatcagtggcggctatggcagcagagccggagncagctatggctttggtgcgccgggagtgnnnttggtntcggtggtggagccggcattggctttggtctgggtggtggagccggccttgctggtggcttttgggggcccctggcttccctgtgttgcccccccttggaggcatccaaaggaggtcaaccgtcaaccagagtctccttgattcccctcaaaccttgcaatttcggatccccaccattccagcggtgttgcggggcttgaggagccgtgaaccagattcaggacccttcaacaacaagttttgcctccttcatcgacaaggtgcggttcctgggagcagcacgaccaacggttctgggacaacacaacgttggaccctttgcttgcagggacgcaggggccaccaaagactgttgagggcatgcaccttgaagccgttgtttccggaggcagtacattcagcaaccttcaggcagccagcttggaccagccatttgtcggtcggaaaccggcggcccgccgtgggactcagaagctccaggaggccattgcagggacctggtggacaggacttcacagacaccaacttatgcggcattgacattcagcaagcggcccagaaggccgacagaactggaacttttgctgaccttcttgcaacgacgggccttgtgcattgcctggcccatcctttgaagcccggggttgaactgcgccagcccgaagcacgaccactcatcaccggcacggagaccacctttatgtagaaccccttgtgatagatgccaagacgagtccacaaagatgccaaccaccatttccaacccatctgtgttgggctgcccctgaaccaaaagcggaccgtgcc

SEQ ID NO: 724392 - DNA, 236 bp, Homo sapiens
cgtctggatagacgtccttgatagacgtcctggatagacgtcctggatagacgtcctcgtggagggacggtgctgtgtatcatcctatgtggtatactgttgtcattacttcacttaatacattgtgcttaaggaattgtgcttattgcgtagttcctttcgtaggacccttcttagagcagctcgtactgacgaagtgtgcatgctgctgaatgatgtcacggcagtcgttgaac

SEQ ID NO: 724393 - DNA, 325 bp, Homo sapiens
acggcttgaatgttgccatgagctctccagtccgtgctcgccagaaactcgagtctatacacacgccttgagttctttcaacctccgtagccatcttgcacccgctcttctggttctattgcatgcgcttctggcgcacgtccccgctcggccctgtctgcgcgcttaggcgcccctcaagacttcacgttacgaaaaaggacatacaagaatttggtgacccaaactgacagcgcacaggactgccgccttgacctaccattacctttccaaacatgaccgactgacaaagacactaaacgcagtatactatgacctccacctc

SEQ ID NO: 724394 - DNA, 112 bp, Homo sapiens
tggcttggagtagttccaggaccagaggttgtgctggttgtagaagcagaagttgtgctggtggtagtgaacagagattgtgctggtggtagtgaacagtggctgggagtag

SEQ ID NO: 724395 - DNA, 451 bp, Homo sapiens
ctaacaggctttgagcttggtgtgtataatctgctgaacaggttgtcgagcttggcttgttgggtccacatctgaggcagatctggtgcgtgatcagtctgccgcttaggcagatgttgggactgtagaggcctgagggaggcagaggctgggcctggaggggccaccaagatgcaggagctgggcctggagaggctgcaaagaagcatgagctgggcctggtgaggtcgacttgagaaagttcagggcctggagagaaggctgtgaggcaggagctgggtctaaagaggccattgtaacgatggagctgtgcctgtggaggctgttgtggggcagtaggctcatctgcggagactgccgtgacgtagggtatgggcctaaataggccattgtgagtcatgggcttggtctgtagaggctgattggagaaagttctgggcctggagaggct

SEQ ID NO: 724396 - DNA, 196 bp, Homo sapiens
  misc_feature (130)..(130): n is a, c, g, or t
tgctggtctctatcaggctacagagaccctgatgctggaatagatgaagctcaagttgaacaagatgctcaggctttatttcaggccggagaacttaaatgggggacagatgaagaaaagtttatcaccnatctttggaacacgaatgggggtctcatttggagacagggtgttggacaaggtacatgacttatat

SEQ ID NO: 724397 - DNA, 633 bp, Homo sapiens
atctgaggatcccctctctccacactggtacaaatcatggcatacagacagaagtctaaaaatggtaccacgagaatatttttttaaaaaactaaatgtgtgatacaaatatccagacgaattaaagagtcacgagagaaacagagatagcatataagatgtgacagtgtaaaatgggtagcgaatcaaagtgagacttaaatagaaaatatatataatcacctcatttctaccacataatttcagagtgtgtaatggggagcatttgagaagagtaggagaaaatagagatgagaatttatctcacctttaatactgtgaatactatatgggggggtccccgggtcagagcatataaatatcacacttaagaactgagcatggggcctttgagtaagtgtatatacaggatctgagtatttacacacatatcacactatagcaacctctcgtgaaaaatcatgaggatagaatgcgccagtgtgtatactatataaaaagtgaatagggggggtgtggggggtcatgcgtgtgatcccagcactttgggaggccgaggcaggaggatcgcttgagcccaagagtgtgagaccagcctaggtgacacagtgtgaccccatctctacacaaaaa

SEQ ID NO: 724398 - DNA, 581 bp, Homo sapiens
  misc_feature (515)..(515): n is a, c, g, or t
  misc_feature (518)..(518): n is a, c, g, or t
ggacccgaaggccggggcgtctgtgacccccaactgggaggaggggaggaacgcaatgggggctcccatcccagagcggggacaaaaaccccgggagaaactcaaatacaggggcattggaaccaattctccgcccccctcccccagggaatctctcctgtcagccagcactgggcaacctgggccctgtataacctcgtgtctgtctacccggacaagaactcccccctcctgatcaaagaagggggatcccccttctgagggacataattaagatggcgaccgcacggcaggagaccaaggaaatggcccgcaaggtgattgagcactgcagtaactttaaagaggagaacatggacacgtctagatagaggcccccgtccccatggccgccaccgctctggaccacaggcggggattattctattatattgcacccagcgggcgggctccttccgagggagcctcccacggagtgaagagacatgggggatttttgtacaactgacgctccnccnaaattttttttttttatattttttttatatatatatattttttttttggttaggaagtgtgaa

SEQ ID NO: 724399 - DNA, 837 bp, Homo sapiens
  misc_feature (24)..(24): n is a, c, g, or t
  misc_feature (66)..(66): n is a, c, g, or t
  misc_feature (77)..(77): n is a, c, g, or t
  misc_feature (83)..(83): n is a, c, g, or t
  misc_feature (85)..(85): n is a, c, g, or t
  misc_feature (92)..(92): n is a, c, g, or t
  misc_feature (94)..(94): n is a, c, g, or t
  misc_feature (96)..(98): n is a, c, g, or t
  misc_feature (104)..(104): n is a, c, g, or t
  misc_feature (181)..(186): n is a, c, g, or t
  misc_feature (240)..(240): n is a, c, g, or t
  misc_feature (294)..(294): n is a, c, g, or t
  misc_feature (336)..(336): n is a, c, g, or t
  misc_feature (349)..(349): n is a, c, g, or t
  misc_feature (361)..(361): n is a, c, g, or t
  misc_feature (364)..(364): n is a, c, g, or t
  misc_feature (366)..(366): n is a, c, g, or t
  misc_feature (379)..(379): n is a, c, g, or t
  misc_feature (381)..(381): n is a, c, g, or t
  misc_feature (389)..(389): n is a, c, g, or t
  misc_feature (399)..(399): n is a, c, g, or t
  misc_feature (404)..(404): n is a, c, g, or t
  misc_feature (410)..(410): n is a, c, g, or t
  misc_feature (426)..(426): n is a, c, g, or t
  misc_feature (428)..(428): n is a, c, g, or t
  misc_feature (432)..(432): n is a, c, g, or t
  misc_feature (450)..(450): n is a, c, g, or t
  misc_feature (462)..(462): n is a, c, g, or t
  misc_feature (483)..(483): n is a, c, g, or t
  misc_feature (500)..(500): n is a, c, g, or t
  misc_feature (507)..(507): n is a, c, g, or t
  misc_feature (524)..(524): n is a, c, g, or t
  misc_feature (538)..(538): n is a, c, g, or t
  misc_feature (573)..(573): n is a, c, g, or t
  misc_feature (601)..(601): n is a, c, g, or t
  misc_feature (660)..(660): n is a, c, g, or t
  misc_feature (827)..(827): n is a, c, g, or t
ggaaaacatcctcctcgccaaacncggcttcctcctcctcttcctccccattctcattctcacgcntctccgagganttcttnanagtcctnanannnacttcntcgccatccgcgttaaccaggacggtgcggaaatctcgcccgtgccccagctgctctggcccttccaaaccaacttnnnnnnggggctgtgggccacccccgcaccagctgcccacaccgtgaccatctggccggngcgcaggatgtacttgggcgtgaacttgtaggcgatctcctccccctccaaganctgcctcttgattctccagttccccagagactgatccttgtncgattttttcttnatctgcacaaanttncnctctaggtcgatntnctcgatgntgatgctacncgagnacgagnactgctgggccagttntnattnaccgctgccacccgtgcncgttcccaggantcttgttccgctgcccaaggnctcctccacctccagcngcttccncttactgcggcccaggngcccggtggcgganaagctgccgctgctgctcgaggtggctcgtgaganggtgacgcgcgaggatgggctggggganagcttcagcctctcctcctcgccctccaggagcttccggtaggcgttgatctccatgtncagggccagcttcacgtccagcagctcctggtactcggccagctgctgctgcatcacgtcccgcatctccgtcatctcctgctccttggcgtccagcatcttccggaacttgtcccgctccccggccatggcctcctccagctcccgaatgcgatcttcagcggcantggcctgctt

SEQ ID NO: 724400 - DNA, 242 bp, Homo sapiens
ccaaaatttttgggtttttttttaatttgggggaattatggaaaggggttccccgaaaaaaggttgccccccccggggttaaaaaagggtttttttgggggggttggggggcctatcccaaaaaggggggaaaatttttttttaccccccccttgcccaatttttggatggaagggaattttaaaggtgctttttttgggcctttaaaccccggccgggtttttccccaattttccccccca

SEQ ID NO: 724401 - DNA, 243 bp, Homo sapiens
ctcatcagactgcgcccgtgtggatgaggcgggggtaatccgtgtgcaatggtgacagcgtgggatacatgctctcgtcactggctagccgtggaaggtgcagccgtcagaccaagttggaaaagtcatctttgagcagatcctacagatccgcctcacggacacgctgggcaggctctcgcacatcctggagatggaccacttcgccctggtggtgcacgagcagatccagtaccacagcac

SEQ ID NO: 724402 - DNA, 514 bp, Homo sapiens
ttagtgcactaataaaatactgctcagcaataaaaggagctaactactagatacttgcacaagcaatgttcagagcagtatcatttcatagtagccaaagggcagaagcaacccaagggtcaccaagcagataactggataaacaaaatgtggtatatacatacaatgtaacattattcagccttgaaacggaaggaaattctgacatatgctacatgcatggatgagccctgaggatattatgctatgcaaaataagccagtcacaaaaagataagtacactatgattccactataaggtatctaaaatagttaatttaatagataaatcatcgtagaatgatggtggtcaggagcggctgaagaaggaagatggtggagtagtgtaatcagtacaatatcagtgttgcgcgatgagaaagtgctatagatctgcggtgacaaattggccaaaatcggggaacccctaaaatcgaactggcgggcttcaagcttgggcaactggcccgtcgta

SEQ ID NO: 724403 - DNA, 1590 bp, Homo sapiens
tatcttgtttcagtgttaatcacagtgaaatatacttttcaggataacattttcaaatggagcaaatatcgttacagattgatggcatagcctttatttgccttgtcaacattaaggtaggaagacttctgagatacaaatgtcagactgacagtagtgactcagaagcagaaattcaaaaaatgcacttgctgtaaattctgctacactgcccagggcacttcttggtctgtatgtgtaacatgtattcagctattgtaaagtttctttaacagtcctggaagtactatgacagtaacaaggaagattgatagcagattccatgcctctttgttaatcacattaagaactctgcttggtactctttgatgttgtgtctggaaacatacatccccaccacaccatattgaaaactttcatcctattacccatctgctgccagcaaatgatcagtttaaaggcaaaaaatgggtgatgggggtgtgaaagtcaaagatttgccaagcataccgtttttctactactcattcttctaattaccttttgggaaatgagagaacctaaccatataacattttgaaatgtttccttagggaatctgaataatattttatgtagcttgagttacatgataatgacaagcatgtcttcaaacattagaattaaacccatggatgtggcatagtgcctgttgtttttcatcataagagtttatgataaaactgagtactggagtctgcagtttataaaaagatgtttccttctatttagctggaggagtttcttatactggtggattggttcccagcgcctacagtcagataaataaaaagttgcagcagggggaccaactagtagggagtacagtcagataaataaaaagttgcagcagggggaccaactagtagggagtacatttcatcggttggagagaggaaatttatttcttcaattactttagaacatctgcatgttacaaagaggaatgtgcattaacacaattaaccatttcttttttttaattgaattcatggattcattcctaagttttctaatcagttttgctctggtgtcataagttaagggagaatccataccaaactaattttcctgcataaagagattacttggataatagattttttccagtgcttttggaaatattgagtctaataaaataactctaacagagatacaattattcatatcagtaagttgttcatcagaaatatttcacaaagactagacctgaatctaaattggaggcaaaatcattcaattcaatagagcagttgcacttttctcatatagtaaaatgaccagttgcacctagtaaacagtacagcacaacccctaagtgcaggggatctggaggcaaaacatgagggtcaaagcctcactgtaccactttccagctgtgtaatcttgggaaagattcttcatctgtaaaatgatgcttaaaagctatacctgacttttaggattgttgtaaacattaaatttgtaaatgagaatgatcttataactgtacatgttaaccattgtttaaacctatatgaataaaattctagatgagtcaaaaaaaaaaaa

SEQ ID NO: 724404 - DNA, 1103 bp, Homo sapiens
acgagctgcaattgtcagtggcatcatttatcgggggccccacaggcagtgcgtcttcatgggtcctcctgtgctcattcacattcgctgagatgcctctcaaacacagctgttctccacgggcccactcagtggatttcactgggtctcatctgtcccagtttgcgttttccaaaagcgttattccctttggcccaaaaacaaaacacacaaacaacaaaaacaacaaacacaaacaaaaacaaaccacacaaaccaacaacaaaacaaacacacacaccacaaaacaaacaacaaacaaacacaacacaaacaaaaaaacctcgagcgggggggggccccggatacccaacattcggccctacatacgtgaagtcgcactcaacaacttcacctgggcgcgtccgttataacaactcgtcgcatgacctggggaacaacccccttgggcgtataatcccacctcattaaatacggcctttgacaggcaacaatcccccgctatttcggacaggcgtgggccgattagcggaagaaaggacccgtaccccgaattctgccgctttccaccaacatgtggtgcgcgagccctgtacttggagaacagtggcgacactatgataagccggtccaataatatcgggtcgaacacatacagcgtttagaaattattggtgttaaactcaagcgtacatactgtttcaccccactttgggggcggaacactcggccataacattcccttttataagaatcacgcaggcgcttcgaacccgcggcacagggagtgtgccgattgtgttacccccctgtgggaatcacccgagggccccgctatcttacgcaacacggtggagcccccccacggtcacagccggcgggcaaagagccgtgctcatccgcggagcgggtcgccccatacggggaggccacacacgccgcatacaccggcatctcgcggtgtccgaggtggcggtacaggcctaattccggacccctaagggaagccccggatttatagctgtacgtgccaactccgcaccgtgtgtacagcgcagggaacacaactaacccgatgcgggcagcagctgcggctatcaggc

SEQ ID NO: 724405 - DNA, 264 bp, Homo sapiens
cccctacccccgccgtcgctaggagacgccggaagtgggggaggggccggcggcgcgggcgagggtgggaatctttttcgggctcccgggcgcggagaggaagggacggtgcgcgcgcccggccggccgtcgccgcggtgaccgtcctcggagtccgtgcgtcgcgccccgcccccgtcgccccctcccctctcgcgcgctggggctgtttctcgctccttccgagttaccgccgccgtcccgccgctcctcctctcccggtcc

SEQ ID NO: 724406 - DNA, 180 bp, Homo sapiens
atgggcagcggcagggttgggggcatgtcttgcaggctcatctagtgtccgcctttcactccactaatgctgtctcagtgttttctctactctctactattcgagcttgcactcctggtaccctgaccctggtgcccctggccacatcccgatgcctggggggccaagtggaaacgaaga

SEQ ID NO: 724407 - DNA, 114 bp, Homo sapiens
tgatggcgtgtggcagtttaaagttattagttttaaaaatcagtactttttaagggaaacaatctggaccaaaaattggtcacagaatttggagaccctttaaaaaagttaatt

SEQ ID NO: 724408 - DNA, 396 bp, Homo sapiens
cgtcgacagactgtgaatcaggccttcatggtcaaattgctgcaaagaaaacactactaaaggacaccaataagaagcagagacttacttgggccaagtacacaagcaaaggacattcgaccgatgggaatctgccctttggtctgatgagtccagatttgaggtttttggttccaactgcctgtctctttgtgagacgcagagtaggtgaatggattatctctgcatgtgtggttcccaccatggaggaagaggcatgattgtatgggggtgctttgctggtgacactgtctgtgacttatttagaattcaaggcacattttaaccagcatggatacctttcacgtttattccctctccggcgctcgacgttgccagtttactcatcgtcgacgc

SEQ ID NO: 724409 - DNA, 139 bp, Homo sapiens
tcgataaggccaactaggggtgatcttccagttgctggagagaaatgtggtaactggagtgagagagtaggaacaggtcatgttcaggttatcagggccaagggtcctaaaggacttagcttgtgttggccttatcgag

SEQ ID NO: 724410 - DNA, 779 bp, Homo sapiens
  misc_feature (172)..(172): n is a, c, g, or t
  misc_feature (570)..(570): n is a, c, g, or t
  misc_feature (580)..(580): n is a, c, g, or t
ttaagggattgaattaaagtgataataattcgccatcagtcatgttggccagaaatgtgtaagttgtgatttctatgaaagagtaaaggaattaggtatatgtgaaataaaagttaaatttctgtggtaaggcaagtgagtttcatttaaagtaactcatttttacgggatntgagatttaaaagtgaaattaattcattttgcacagtgtagtcatggttgggctctgagaaaatgttgtaaagctgaaattatttatcttgtgggaagaagtgagaagaaactacaatgtgtggtattatcaagagtttacatttccggggtaaatataaatgagtttcctttaaactcatttttgtggaatttgaggtttaaaagtgaaattaattttgtagaatctagtcatggttgggctctgagaaaatgttgtaaagctgtaatttatcttgtgggaaaaagtgaaaaggaacttaaatttatggtgttatcaacaattggccaggcgcggtggctcacacctgtaatcccagcactttggtaggaccaggtgggcaaatcacttgaggtcanaagttcgggnacagactggccaacatggttaaacccagtctttactaaaagtacaaaaattaactgggcatggtggtgcaagcctgttacgctaacaactcgggaggttgagggagaaaaatttctttaacccggaaggcaaaggttgcagtaacccgagatcatgccactgcactccagcctgggtgacaaagtaagactttgtctca

SEQ ID NO: 724411 - DNA, 360 bp, Homo sapiens
  misc_feature (169)..(169): n is a, c, g, or t
  misc_feature (173)..(173): n is a, c, g, or t
  misc_feature (250)..(250): n is a, c, g, or t
  misc_feature (291)..(291): n is a, c, g, or t
  misc_feature (293)..(293): n is a, c, g, or t
acatttcacaccagtgactagttgaatcccttgtaacgtagtagttgtctgctctttgtccatgtgttaatgaggactgcagagtcccttctgttgtgattcctaggtcttttcctcaaaggaaatctggttttctcactaccggttgactggaaagcagggtacactnactnacgttttatgacttattgtcgggctagatctattaggatcatataacaagtaaaactgtcgtaccacaaaacagtcnaacttctgttggtgaggttgagacaattgtagtctcatttntnacattctgtcattagctattatcatctaacgtttcagtgtatcctttcagcaataaagcagcatatg

SEQ ID NO: 724412 - DNA, 239 bp, Homo sapiens
ctcacatattgtggctggctactcgtgctctacgtggcacaatgctatatattaaaaagaggtggctgggcacagtgactcacagctgtaatcccagcaccttgtgaaggctgagatgggcaggagatcgagactatcctggccaacatggtgaaaccctgtttctactatggtgaaaccctgtctctactaaagatttaaagatttactctagctaaatctaaaaactggttgggcgt

SEQ ID NO: 724413 - DNA, 1049 bp, Homo sapiens
cccatgaaggcccttctcacgacggtggaacaaaatgagcatcagccccgatcgtcgcttctgcagagatatagcaccctcacactcgagccgtgccctcgacagccttaccagcagacacacaccaacacagcgtaggaccgcccacatcggagcggcctctatgcaccgcactcgcaccgatccaccggaagacaccacagcacagagcgggcaagcgccaacgcaagtgccgacatgacccagtgccaactgcccaacgccgggcgtggcaactaaagtgcaaaacacacacaccccacagtgcggccaaccttggcggcgcgctcaccacccacgcaccaccgggcccaccaccaccctacgaacgacggcagcgcatccagcgcacgaccactacgtggacgagcatccaaccgcacagcgagatcgcaacccgcaagacgaccacccccactgaagagacagacacagaagaccagcatgccctcaagacgaaggcacgtcgccgccaccacacgaaaggcgaggaggtgcaacccaaagaacaacgagccgccctcaaacgactgtaaggtccccagcccgacccccccatccacaaccaacgcgcacctgtcacacagctgcgtacgtgaaacgccacacagcacatcaccgcccgatcctagcgacccgataccacgcaacccacacacccattgcgtcgtgacgtggaccacgaacatgcaacggaccggccgcccacaacccccgcgacctccactcgccgccagcaccaattcacccaactcaccacagagcacgacagaggtcccacacgtcaacgctgctacatcacaaccagtccaaagccacaccaagccaaggcaccagacccaagagcatctgcatcgcgacgcccaaccgcctcacaagcgcacctcccgcaacacacgagcgtcacacgaccacgaccgactacacagcacaacatcgcgaccaccatcgctccacgtcaccgtgacccccctcagaccgcgcacgccacggctggaccgacacaaacc

SEQ ID NO: 724414 - DNA, 368 bp, Homo sapiens
tcggccctcttaatgtgtgccatttgaaaaataaattaccctttaaaattttctttttctttttttaaccaactgggtctgtgcaagaattatcctgactgtaagtgtggattaaaatagctgttaaaaattgtcatcatggctgggcacagtggctcacctgaggtcaggagttcgagaccagcctgaccaacatagtgaaactccatctctgctaaaaatagaaaaattggccggggatggtggcaggtgcctgtaatcccaactacttgggaacttgggaggctgaggcaggagaatcccttgaacctggaaggtggaggttgcagtgagctgattgtactccgtcctgggcacacattatggag

SEQ ID NO: 724415 - DNA, 749 bp, Homo sapiens
gaccttgtttcacaaccttgtaaggctgctttgtacagcctggaaggaccgcttcccagagtcgagtcttggcttaatgagagggggaggctcagagactcaagaagcctttggagtttgagtgcaaatgaggtcagtggccttctctctcctccacgtgcaggaggccatcatgaagcctcttgatcacaagaacctggacctggatgtgccgtactttgcggatgctgtgaggtgggtgtcactgtctggcctcgggccgcagaaatgaagcacattagcattgtgattgtcatgtgattgtaatttctaaaatattgctgtcgtggtagattttgttactggaattcatgttttatctatgtattaaacctgaaattgtgttcattatttgtattttgagcttctttcattctttttcttcagcacgacagaaaatgtagctgtctacatctgggaaagcctccagaaacttcttccagtgggagctctttataaagtaaaagtgtttgaaaccgacaacaacatcgtagtctataaggagaaataggtcttagggttgctattgtagacaggcacatttcttttcacacttgaaaaaggctttgtccttccagagttcgcagcagtcaccacatgcttgtgtctcccctgttctgtgctagagtatccgagcattaagtaatgtaagggccgtatttgatgttttcgaatccaactttcaggggttctggcagtgggtggcgcgc

SEQ ID NO: 724416 - DNA, 270 bp, Homo sapiens
ccccagggtttcccccccttaaaaaaggggggcccgggggtttttcccaaacccgggggaaggttttttgggttaacccaaaaaaaaaatccggcctgtgggaaaaaaagcccccccgttcccccggccgggccgtccggggtttttagttttttccccccggttttggaaattttggggaaaaatgtcccccgggggttaaatttccccccgaggggggggggggtttcccgcttccccccccttaggggcggtttttttttttcccca

SEQ ID NO: 724417 - DNA, 749 bp, Homo sapiens
  misc_feature (497)..(497): n is a, c, g, or t
tctaccatgtatctcgatcatgtgctgactctatattattcatggtgatatgtagtccctggtaagctggtatttatataggtctagtgtagtgtctgtacagggcatatcggtgctaggatacatgtgtatctggtcttggtctagtgtaattattagtctgtccttgctgcgtctggtcatggcgttcatgctctttacattgtcctcacggtttgagtgtcctactaatcctaggcacctagcttgtcagctgctcctaccgtcctagcctggtctagtatgccatgctgtgtactataacgttctctgtggttacctgtactcatgctaggactatccagtatgtggcacaagtcatgtccactgtgttcctatataaatgtggataaatgtacctagatttgtaaatgtgtttaaggctagcagctttggtagtgggtgccatggcattaatactgtccctcgtatagccagtctagttgttagagtactgnttactactatgcgcatagctcactagcagatacatagcgctgtatggatgatagtgacttatatcataggaatactattgtccgtagatactgaaagcactaataggcagacaagtacgaggttgctgcggaggtggcgataactcttggatcctatagtacagttggctgtagctgaggggtacccctgtagcccctaaggcaagtacgagtaagacctggtatagagtcacttataagcggtattacttt

SEQ ID NO: 724418 - DNA, 208 bp, Homo sapiens
tgtccaaagcgagtacccaaatgctgaaatactagtgaggggtcgggtgtggtgacgcttgcctgaaatcccagcactttggaggccaaggcggacggatcacttaaggccagcatggtgaaagccatccctactaaaaatataaaaattagcagggcgtggaggtgcatgcctgtagtcccagttacttgggtactacgctttggca

SEQ ID NO: 724419 - DNA, 1059 bp, Homo sapiens
tttgtcgtggggttctgggtttgcctgttgtcgcgctttgtttgttgacgtgtgcccctggtcagttcacttttcggtgtattcccccttagtccctgtgtgagtttgtattctggtggggccaagaagggcgtttgtggaaggtatttcttcgctgggtgaagccggactgtgatgttgtaatgggacgatgctacttggttgtggcttggtaccgatcgttataatgtcgatttggatctgtgtcactacctattttatctcgccatgccatttgaagctggtagaagtatttacctggagttattatgttaaggctcagcttctgggattttcacatcttgcaactgtgtgatatacttcttctcgcagggcataaaggatcccgatttgcatatggagatggctccaattcgcagtggtcagccatttagaatgttagcagcacagaagcagtgaagttaaatacttatatatatgttaaatagatgtatatcgcatagcagggtttgatagcacctttaactagttcatgttccaatattacagctttagagataatgcgcaattttatgtgtatgccttaagtcccaaaaggtgaaacttttgaagattggtttgtgatcttttgtgttaaaatagactcgatacacctataacctaaatgcccccttatatatatgagaaatgatggagaaggaaataagtgatggttttttttgtcttgcaaatgttctatgttttgaaatgtggacactgacaaaggctgttattgcattaggtgtagtaaactggagtttatgttaaattacattgattggaaaagaatgaaaatttcttatttttccattgctgtgtcaatttatagtttgaagtgggtttttgactgcttgtttaatgaagaaaaatgcttggggtggaagggactcttgagatttcaccagagactttttctttttaataaatccaaccttttcgatgatttgaggttttatctgcagttttggaagcagtcaccaatgagacctgttataaggtggtataaccttcttggcgttc

SEQ ID NO: 724420 - DNA, 968 bp, Homo sapiens
  misc_feature (439)..(439): n is a, c, g, or t
tgccgtgtattcctttttgcttctttctgtcttttgtgcctgtgccccaccgtgccgggtgagccttcagggtgtgccctctgttctgcgccggttccgcgtgcctgtgcctgccttggacattttgcgtctgtcggtgtgggtcctggtctcttcccccggtcgtttgctgccctttcccttgctctcccctgtgtacgttgtgtatggtttttcttgggctggagtgctttcgtctatacttctgtgtgcctactgtcctttccttttacgacggcatatttctttctcatcattctaccttcgcctctgcgcttgacgtgtgcttactcggaatgtcaatctccacttaggttggtgtaaaattgagtgtggagtgaactggagtttcttttctgtggcctcgaaagcatgtcttgcacctgttaatggttacacnccaagtggccctgatacatcatctgtatggtgaatagaccgtgggggacacacgtggaccaacataatggccttgatctcatgagagaccgtgcatggtcctctgttagagatgcgcgttatgaagtgaatagtccttcataagggatgcattatgagatcctttttcaatacagcgactgagtgccagcttagtattgtgatgccccttcccagagccaggttatggattccagggaaggccgcggattccggtccttggaagaggcaggatcctggagcagttttgtgaggcccctttgtgtctcccacacgacctccctgggtggtgagtgtacatagaagactttgcctctcacgaacgacatgtatgtgcggtcatttttgttagagatgagaataaggattgagaaggataaactggaatcctggtaagatgcctatatgccagcccgacacctgctgtaattggggtgcatgagctatggagtcagattagttgttgggagggggaatccaagagtctatgt

SEQ ID NO: 724421 - DNA, 271 bp, Homo sapiens
atttcccacttttggataccaatgaccccattcataagttcgccttcaatactttgtccctggatgaaaagcactcatctcctggtctgacatccaaagagtcactcatcgttcaaataaatactgctcatggattcatccttattcacgtggacaacacaaaggttaccatgaaggaaatcatattgaaggcagtgacgcgaaaaaaaggatcctagaaagtttcacgccataagtaccgcctgtagaagcagagcgagcccaatgtcgc

SEQ ID NO: 724422 - DNA, 936 bp, Homo sapiens
ggcgttgttggtggggttacacgcgggttcaacatgcgtatcgaaataggtgtaatttgtgttcggggccatctatcctgtgacacggcatgatgttcgtccgagatgatgcgaggtgtccatgatttgcaaatctacttgtcttaaacattttacaaagagagcgcaatcctcgcgaaagttaggtggaccatgagcattccggaaagcagctgggtaaagagctgtacgagtggataattcacttggacatttgccaaaaggtagaaatgaacctatcaaataccagcgagagctatggcaataaaactatggatgcgatgaagagcagttgaagatgtcaatcagaggcgccaaagctaaaattgagtaatgaaacagactcgtactgacacaacatacaggagctacagaaagtgcaggatgtcaatgaagtcatgcaaaaatccatcttatgcgagcccctcttgcaggtcgacgggacacagtttggaagagaaaatggtccagcagtttacacagaggatgtggcccatggaagatgcgccttagagatctctgtaaccatttcttttgatgtccatttttgagagtggccttggggtactggaacgctaccttatctgatgtcttacataggtcacttaaatgcaagggggattgcacgaaatctttcctgattggcatctacatattattccgatattacggggtagagtgctctcaggttacatcttgctggtgggggacctagggagaccggacatctcatggactttgaaggatgggcgcaacggcggggttgggaatggccgcggctggtgtgacaatggccattgggcggggtacaacatctgcgggaaacctgtgatgagggacaagacaaggggggcgcaaaaattcggggcgtaacaacagaagaggggctacaagaaa

SEQ ID NO: 724423 - DNA, 447 bp, Homo sapiens
aaggcaggcagggtaggtcaatgtctggaggctcacggttttatagactaggggtccccaacccctgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgtgcgctccttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaa

SEQ ID NO: 724424 - DNA, 109 bp, Homo sapiens
ccttgatcccctcctgcacagccgaagtctgtgatcttaatgtgcccgtcttgtacagcatgaggttctccagcttgaggtcccggtgcaccacgttttactacgtggt

SEQ ID NO: 724425 - DNA, 382 bp, Homo sapiens
ggaattctacacatagttaatagatgtgtcaagctacctcatcagtcatggtttgcattgtccatttcccgtaatgacgttcagcagtcttttggtgtgctcatttgctatcagcttaccttctttattgaagtacctatacaaatcttctatttttgtttatttgcattttattgattggaggacatcgagtctcattcgtgtagcccaggctggacgtgcagtggcacgattctcagctcacgtgcaaactcgtgcgctcccaggtccaagcagtgtctcctgcctcagcctcccgagtatctgggactacagacccgtccccgcggggcatcctcctacagctgccctggccggcttgctcgctttgccactggccgtc

SEQ ID NO: 724426 - DNA, 425 bp, Homo sapiens
catgtccgcaggacctggagtgttggaatctcagctgtgcctgttccaacagctccgctcttcgcccagagccaccagtgtgtccactgcagagagaagccccacaccccttcctggctgcccatcccacctcacgcagctctgtggaccccgagtgtccgctgtgcaccagctctgggacactggaggccggcgatgcgctcccagatgggcttggccacaggactgtctctgcagcgggtgcccttacaatcaccaggaatggcctgcctgccgccctgcccagtggatcctccacacgccgaatgctctcccaccttcccaccgcttcagcacccaaagctgagatgaagcagggacccctcttaggagtcttatcccccacccccaagcatgaaaataaaggaaaatcttgagttatttca

SEQ ID NO: 724427 - DNA, 393 bp, Homo sapiens
tctcatcgatgtatggtcatctctgtgtcagctctcaggacatagagcagacgcatactgagccatgtcagtctacatcggcttgggctactgccatgatattcatcttgactgcaatcacactttgactgcttcactgggaaatttggtgacataaccctaattgtgcccgacttgtcttacccgacgtatccggccatactctagtatgtgtccaatgtcagacgacaatggttaggcttcgttagccattccagagatctaggtcgggcttgtcccgcgtccttatacggagttgcaccgctcgaaggccgatccaatagcagtcgtcgtgccgtcggccgggcactcgatacggctgtggtcgtgtcgtccgagaacccagcaatactg

SEQ ID NO: 724428 - DNA, 210 bp, Homo sapiens
taggcgtaccgcggagagatatgatcatactatgtgcccgctctattgctccccacctccaaatatctcatcaacaaccgactaatcaccacccaacaacgactaatcaacgtaacctcaaagcacatgctaaccatacacaacactgaaaggaagactccagatctctcatacaagatatgcttaatcacttattataagccacaatga

SEQ ID NO: 724429 - DNA, 609 bp, Homo sapiens
  misc_feature (21)..(21): n is a, c, g, or t
  misc_feature (225)..(225): n is a, c, g, or t
gtcttattttccaaggcaccncaagtgtttcatgtagcacggtcgatagggaaacggttttcttagtaccggatgtctatggctcggcatgtgagccgggcaatctcagacttggtggaactgtttgaaaaaaggggcttataggctgttcacagcccaaacccctatgggggcgtttcggtaggtcccagccctgagtttggggccaagtacaggaaaattacngaagatattgttttaatgatcagcaggcaaagattgtgggttgttccccctcccaatttggagaggccagtttccatcccagtgtccagccacaacagtttggtgtacagcaaccctgtcagttcattgggaaaccccaaccttttgccctgggttcccctttttttgaaaaggaatagtatgttttttggtgtaaaaaatcgccctccaagggcaggtaacacagggggtttaatggggggagccctcagttttggggcaggccccagtgcagggaaggggtatggcaatccccgaaactccccaggtttgggggtttccccgggtaatttgaacaagaaaaggcaagcaaattttcctccccctttcccccctttagagcca

SEQ ID NO: 724430 - DNA, 929 bp, Homo sapiens
gggatgactgcagaaaggggacagcgtcaagttccaatagtgtgtcctgggacaaaatgcacaaattatggattacaaaatcagatccctgcgcagggccgcagtggaatgtgtgatagatcagattgggtgtctgtcattaatctatgaaagtaggtagatagaatgatagctctttttccatgtgaaagaaagttcaggatggtgttgagctataggcaaggagatgaggtggagttcgtgctagtgattcgttgaatcagcgcatatggcaagtgagcgcctgtaagggttagggagtctgtgtaagggccctccagggttgtatgaagctctcgaactgatcggtgtgtcaagtcgtcttgaatgaatactcacctctgtgcatgatgccgacgtgtcatcgctcgtcggcctaatggtgtcttccgtcagcacaaggtggaagcctagatcactcaatggggttgtggtgccaggaaggaaggatctcgtcatagcttggtgtccaattgactagaccatcatccatcaaagcacaccatctaatccagtatgatcaagtcggtggaggaactcttggtgaagggtcggaatatctccctcttgatgcctccccgaaatgtggtaatacttatttctaggtgtagctatttaagacagtttaaaccttctggtcatgtttcatatctagttgttttgaaatcatttcaatatgtcgtgggctgggaaagtcaggtgctatagtataaatgtaggagctattggggattaagcgagggaagtgaacactgggggttggaaaatgagggagagggggcaaaaagagtataaatataccacatgagtgtggaggggcggcaaagagtactttgttaagagtgggcagagaaatttatataaaaaggtagttttttagtggtgtgggg

SEQ ID NO: 724431 - DNA, 132 bp, Homo sapiens
gcccgagccaaaaaggttgaaactatgtaaagggtttttatggaaattaccagttccaatattttaaaggggtaaaagggcttttttgtttaaaggaaaccctttgtaaaaaaagttaaatttttaagtcca

SEQ ID NO: 724432 - DNA, 167 bp, Homo sapiens
tgtcgttgtccagtgttcccaattccgagttcgatatgtctcgatgaagctgacacaatcatcgtatcattcatgaagttgatctcagtcatgagtacattctcagagctctgatagtcattaaaaatagcccccactcatcccggagacagctatcagtacgagct

SEQ ID NO: 724433 - DNA, 139 bp, Homo sapiens
cagagacgggacagagttacataaccctaggtgatctgtgcagagtctatgtcacaacgccccagtaggcagagcttagataaatgttacatcacctggtgaccagtgcagagatacgtcacaataccgtctgtaggcg

SEQ ID NO: 724434 - DNA, 362 bp, Homo sapiens
aaaagttttttggtagtcctcccataaacccacaatggtttgtaagatttacctcccaaccaagcacagctacaaattcttcatatgcttgacttcctccgtgtattgtgtaagaatgaagtgtttgtcttcttgtccttcagcaccataaaatactgcattcttgtgtgtctctgggcattgccttgaatccaagttcttaagttctctaagtacgcttttcatttttctctcagagagatgaaagctcctccgttgtgtcccaggaatctcattccatatattctaagaagctatctgcatataataaaatgctgtctgaggtttttgaggtagtggctcctcgtgttccacagctctca

SEQ ID NO: 724435 - DNA, 320 bp, Homo sapiens
attgttagtatgacggatgaggggtgggaggccccggttgtgtcacacagtggatgctaccatctacggcctctgtatgtggagctctgtgtgcgagatcaacaaggttcaggctgggctggaagttgttgtaggcgttctcaaggacggaatctgctctccctcagatactgggctttccagatgtgcgtcctctggaagatgccaggggtgccttcctttcgacactcttgaggcacatcatattgttccctgtgccgttttctctgggataggctgaataagatgattaggatgatcaaatgcgagcagaaggaccg

SEQ ID NO: 724436 - DNA, 328 bp, Homo sapiens
  misc_feature (2)..(2): n is a, c, g, or t
  misc_feature (40)..(40): n is a, c, g, or t
  misc_feature (109)..(109): n is a, c, g, or t
  misc_feature (120)..(120): n is a, c, g, or t
  misc_feature (155)..(155): n is a, c, g, or t
  misc_feature (186)..(186): n is a, c, g, or t
  misc_feature (266)..(266): n is a, c, g, or t
gnggaatcaactcctaatattccccattatcctagacccngcggcctgcgactcttgacgttgacatcgagtagtactccggatgagcccccattggtataatattacntcacagacgtntgcatctgagctgtccccacattaggcttaaaacngtgcattccggacgtctaaaccaaccacacnttacagaccgggggtatactacggtcaatgctctgaaatctgtggagcaaccacagtttctgcccatcgtcctagattantccctaaaatctttgaaatagggccgtatttaccctatagcacccctttacccctctagagc

SEQ ID NO: 724437 - DNA, 274 bp, Homo sapiens
gtatggtatcaaatagtttaggacaatgagagtagaacaataggatgctgtggcctagacttctgagtattaataaagaaaaagaagtacccttcggcctacagatcagagttttacttattttttattttttactttttattatagtttaagttctggggtgcatgtgcagaatgtgcagttttgttacataggtgtacaagtgccatggtggtttgctgcacccatcaacccgtcgtctacattaggcatttctcctagtgcaattcctcat

SEQ ID NO: 724438 - DNA, 554 bp, Homo sapiens
atttatgttttaatgttgctcttaattcctgtctgatgttgcccttataaacatctcttattctttcttcatactacccccaaaaatttctgctgcctcaagacttcaacactattttgttttatttttcttattaatataataattcagtaatgtcatgcctctgagcccaagccaagccatctgcatcccctgtgacttgcatgtatacatccatgatggcctgaatgtaactgaagatccacaaaagaagtgaaaaagccctgccccgccttaactgatgacattgcaccattgtgatttgttcctgccccaccttaactgagggattaaccctgtgaatttccttctcctggctcagaagctcccccactgagcacctttgtgtcccccacccctgcccaccagagaacaaccccctttgactgtaattttccattaccttcccaaatcctataaaatggccccacccctatctcccttcgctgactctctttttgcactcagcctgcctgcatccaggtgaaataaacagccatgttgctcacacaaag

SEQ ID NO: 724439 - DNA, 98 bp, Homo sapiens
  misc_feature (5)..(5): n is a, c, g, or t
ggccnaccgtggggggctggtagttaatcccacctgtcagagatgggcagcatagaatgaagtttatattgcctcagaaatgggagctcattaaaaat

SEQ ID NO: 724440 - DNA, 413 bp, Homo sapiens
cgcgcccggtcggcattgttttctgagtgcattcacggtatcatttcctcactgtggctgcttttgatgttgaagaggagccggtgtctgtccagcgtttctctcttccagggtcacctgtctcttccccaccgactgcctgttattgagacgttgtctttgtctttgttgttttgggtcacctctctcccccaccgtctgcctgttactgagacgttgtctttgtctttgttgttctgggtcacctctctcccccactgtctgcctgttatcgagacgttgtctttgtctttgttgttttgcagtttcattccaatgctccagcttcttgaatctcgggcagtctctctcatgtctttaggaaataagcagccactgtttgtttacgtgttgcccctgtcctgcttcctctg

SEQ ID NO: 724441 - DNA, 354 bp, Homo sapiens
aagttacgctcccaagatgtgacgtttattgcaactgaacagagacaggctgtgcggaccttactcaatcccgtccaacccccagcccctccccaagcccccgctgcaactacgccggcaggtccgcagagtgttgcttgacatcgcatggcggtgcccggagtcttaaaacaccggcagtctatggcgccttcagtcatggtaggggactccatagggcacgcccgccttttgaagccctaaatacagcttggaggcagcggaaccttcatagaggtcaaaagtagagcgaggacactgtcagaggcagaggctctggtctggacggtaccacatatgggcgggatttcatcc

SEQ ID NO: 724442 - DNA, 334 bp, Homo sapiens
  misc_feature (89)..(89): n is a, c, g, or t
  misc_feature (293)..(293): n is a, c, g, or t
ttgagtgaggacagaagaacatcatcctggagtagggcaaggagatcctggtgtgcgatgtgggcagactgtcgacgacccctacgccnactttgtcaagatgctgccagataaggactgctgtatgccctcttatgatgcaaccttatgagaccaaggcagagcaaagaaggaggatcctggtgtttattcttcttgggccccccgagttcttgcgccccttaaggagcaaaactgatttattgccatgctccaagtgacgccatcaatgaagaagcttgacaggggatcanagcgatgaattgccaagcaaacttgctacgaaggaggtcaa

SEQ ID NO: 724443 - DNA, 248 bp, Homo sapiens
tgcaggttgtctgcgaaacctgtttttgaccatatttattgattacatgttccattacacgtccacggcctcgtcatcgaagagtcgatatcaatatcgggcatcgatacacggtccaggatttatggaaacgctccaaaaagcaagtcgtatttaatatgggtcaactattcgtaattcctcagacaattatgcaacggcagaaaccctggtggctgatccactgaactgggcccaaccagatacgt

SEQ ID NO: 724444 - DNA, 509 bp, Homo sapiens
ccaatttcgtcatgtgtttttccctctccaccatttagatgagctgggctgaacctcaggtatggtgtggatgaagggggctggtctcttggtacgggaagattagattagcattttcatgcataccaaaaatggcggggtcatcgatcaaaggcagatttgcaaggtagtccttaaactctggtaggcggtcagccaggggtgcaaaatagatgcctgatacagagtatatataatcttcttctaaggtgccaggagaaaaattctttccaagatagtaggaaggcttcttgggtcccagtggtcggtgactctaccaccataagtaattccaccagtaatgtaaattagtgcatcccagggaatctttccttctttacaatagagtcggagattcagtaaagcacattcccggtcacggtcattcactccatagcagatatccaaccaggggggccaaacggggcggcagggaggtaaggccattgcctgtgaggagcaggacccgg

SEQ ID NO: 724445 - DNA, 1270 bp, Homo sapiens
aagtatactccaacccttgtattgttgtaacgagtgttgctgtgtttccgagatggagcgtgcccgtgtgtcagcccccctgttgctgcgatacagctgccaccgtgggaatattggggctctgttcttttcacccattggggctcacgagattttttctcggggggagcccccccttgttagggccctaccccgcgctgtgttgttgtaatctagctctcacatcccctatacactttgttcctggaggggaagattatccgctggtcctgtgccccaacttcggtggttcccacacccgggctgtctgttctcactcggaggggaggttccccctgttaatctccctcgcacgatgtgtgtgcccgcggttttctttttgggggcaccctttttagggggagccttctcacccttcgccccccccggagtagccgtcgggatataggctctcttcgttgagaggaggtctttcccagtggcatatttccccactgcggtgagaaaacaccacgtgtggacaatggttaatgaaccctacatacggagtgttaaagtgttgccttttggcggcacacataaggcccccccagctttctggcgagacctttatacgtacatgtgacccatcttctctgagagaaaattatagatagcctgggcgtctaatatgtgtggttatagaaactctcgtgggataaatatatgggagaccccttctgtgcccatatttggaggttaataactctccctctgtctttaagacttcagcaaaacgcgttccgacactcttcaagtgcgacattatagatagagcccacttctttttagatggcacccacgcacatgagaggtggagatctctcacacccacacttctttttccgcccagaagagtggttccatatattctgggagggagaggttaattacccataaataaaatatgtggaatataatggtgtagattttccccacaaccgcacccaaaacgcccgacgtaagagtggatattgtgccaatatttgggaggttaaaatgtctttgactcgcttaatcacgccacaataacatcacacagagaatatgcactacctaaatattaaatggaaatgcacgagtataatcttaacttggcactgagttttttcacgggagaggtgtgcttcacatttgagatttacttgtatgtagctcgggatcacattttctgttggttcaacctggttcctcagcttatatgatgggattataatatattttcgtgtta

SEQ ID NO: 724446 - DNA, 1072 bp, Homo sapiens
ggtaatggagacttagaagtcatgtagatgctcaataaacagaggggacgtgatggccattgatgggtacatgataaccgaagtgtacatcatacaaaaaagtgctttattttagagtagaacagcatgatatcccatgtggttagtccagaatagattatccagaagtgcaagcgcagtcgagccggctatgtctaatatctgcattgctccaatcgtgatctgtagactagaaagcgctcaaagaagccctcgaatcagagaagtggagttcatacccactgtaaaccattgccgcgtggccgtggatcagatgtccggccccactgaagacgtcactcccactccctatcgacgattggtttggctgtgctgctggggtgctactgtatcactcgtccgatggcttggttacttcaattttagccaaggaaggggtcgtaattggtccactctcgttcttactggaggctattcaagataaacctgtagagacttcatgaacaactggtaaggtaactaactaaaacctaagttaatcatggtcagtatccgtatttttcccttgtgttcaccagaacgctcaagggtgctttgggtgagaaagaacggactcatatagaagggggggaaagttagcgtgccccagtagaaccaggttggcggcaccttgtttccaggcaccagtggctctatggctagaacccccggattttgggcatgcgacagcggggggaacacccgacgtcccgagggcccgagacagacatggccggtcataagggataccccggtgttaggtttgacatagcgaaaattaggtcgagggtcgagattaataatgctgtattgaccagcatatgggcggctgaggcaagagtagacgcgtgaccacgggaggaccgtggcgcggcgactcccgcggacataggtctggggcaaggatgcactggctcgacccgagataacacgaaagatctgcgcttgtatgtgccacacacacatgacagaccctttctcactcgtcccatcaaaaattcccgggcaataaagctatcatcaaagacatctg

SEQ ID NO: 724447 - DNA, 781 bp, Homo sapiens
  misc_feature (472)..(472): n is a, c, g, or t
ggggatggcgcggcggattagggactgcggtcagctgcgtcacttggcggctgtgcggcggtccctgcgccctggtcgatgttcccgggcactccctgagtagctggcatgcttattccccgccctgctatgccctgccctgtgtccccgtgctcgctcgcatgtgctggcgctgtgcccggtgccccagctctgacgtcgtgcccgaccgctgtgtggatgtgcgcgctgcagggggcacgctggcccgggtgatgatgctgtgatttgcgtgggtgcaactcgcctgccctggggggccccctgcggaaggccggtgatgccggctgcgttttcgtcctgatgtcgctctgcccgtgcgcgcttgggattttgcagatcgagtgtcgcatcgcacaatcagtgggctggcttgggcgaaccgacgtggtggacaccaattccaaccaagtgaacaaacctgtggcctgtnctgagtgtgccattatcgctgccagcttacccttggtgtgaagcaaagccactcttgggtctccagtgggaacgaagacagcacgcttggtttgcttgaagctccgggccagccactagagtccggcggctgtttccccggggttcggttcccagccccggcacgcgtacttttctatcggtgccacaattggttgccggtttattcgcggggaacttttgttcacaaccgccttcgggcttcggggtcccaacatgcacctttgttcccctcggtctttggggacccatagttttgacagcgttgatc

SEQ ID NO: 724448 - DNA, 110 bp, Homo sapiens
tttacggctacgttgttctgaaatcaggctctgagttggtgggtttgcttgtagcttctagtgacaaggcgcagccagatggaagggagagggtccagggcttcctaaat

SEQ ID NO: 724449 - DNA, 327 bp, Homo sapiens
tggaattctcctcccagtcgtgagcagtggcttgtgatgctgctaatagcttcagaacagccttcactctgctaggagtaccagagtgcccacaggactcagggacctatttgcttgtttactccatctcgatccaggcactccaagtacatagcttcaggagtaaaaatggctactgacaatgagattaaaaaacacctctcaccctgtaaggatctcatatccacatgagactgttataacccttacagaagagaggacaccagttgggttatcagatagtcgctgttcacattgcaggctatcccatgacagggcacattatca

SEQ ID NO: 724450 - DNA, 131 bp, Homo sapiens
gactctagcggatccttaggtcagggaaggtgaagcaggaccatgtctgttggaccaatgtgcctgaaccccgggagagcggcggaaagccgggcgacggtcgcggggcgcgcggttgcgacgctgaggat

SEQ ID NO: 724451 - DNA, 225 bp, Homo sapiens
  misc_feature (166)..(166): n is a, c, g, or t
  misc_feature (214)..(214): n is a, c, g, or t
accttcagagagaaactgttagcagagaggagctgccgtctgctgagagcttcagagacctgcagacatctgaatgacttgcctgcagagaggagccactcttttcagggccttctctcagctgagagctgaacacccaatgggataattgcctacagagaggagnccacccactcctcttgagctggttccaacaccaatataaacttctttnttcacccttca

SEQ ID NO: 724452 - DNA, 180 bp, Homo sapiens
  misc_feature (63)..(63): n is a, c, g, or t
cagctctgaggtcaatggtagtcctgggttgtagtagaagtcttggagacaccccaaacttangggatcttttccaggatctcccaaaacattcgtgagaattttcaggtctcagtagataacaggttaacaggccttatcttgggactggttgcttctcaagaccctcaatttcttcag

SEQ ID NO: 724453 - DNA, 1118 bp, Homo sapiens
cgctgagaaccagagagaagccgggaatggaaactccaaacaccacagaggacgtatgacaggagcacagagtgcgactagtggggatgcaaactccgtgccacaaggtgaacgagagggcctttggggcccaagcgctggccccctctgtactccgtggtatgtgtcacttgagccgtggttggaaacatcctggctggctcctgggtccgttgctgcaatacaacgaggctactcataaagcatgaccagctatctactctcctgaacctggccactttctgacctgcttcttcctgtttcacgcttcccttctggatcgactacaagttgctaggactgacttggcgctctcttgggctgactgccagtgctgtaatgcactccttcttcctgcgggcttctctacttacgacacgcgcgttgtccacgctgagcactcatctcttctcactcactctctgcctgaccgactctgacacggtaccttggccgatcgatccacgcgcgtgctttgcccttgcgggccacgtgaccgtcactttcgcgtgtcatcactcagcatcatcatatttgggccctggccatctgtggccttccatgccaggcttatagcttttccaagatccaatgccaacttcactcacccacacctgccagccttcaccttccgtcactgaaagcctaccgaccagttgcacacgctgtcccacggcctctgaaaaccgcaccccctctctggcgcctgcctactcgcccttgccggcccctgactcactctgcctacccagccggcctcctcccaggcattcctgcctaacgaacgaccacacatggacaccgcacactccacgagcctgtcccgcacgacttcccgctccactcatgactcactcctccacccctcctcctcgagcaaccccaccttacaaacctggaccttacaatccctcttattctccgggtttactcgcacggacctcccgtgtgtcacacccccattcacctggtgcaacgccgcagccacgacactcttggacccctcggcctgtgtgccacctgcgacgagacgcggactcccccctacccgcgaccggccgcgctcaacccccgcgcct

SEQ ID NO: 724454 - DNA, 363 bp, Homo sapiens
ggtgctgagttcttcacctccttttagactgagatctgacaagttttgcggcattgctcttgaggatctcagaagggctcttaagacaagactgcaaatggtgtgtgtatttgtcatgaaccgaatgaattcccaaaacagtggttttactcagcgcaggcgaatggctcttgggattgaattcttctggttggtgatgtgaaattggtgcattctctgaacttagttcgtatgttttacgccatacaatcaacccttctttaacgcctttgaaaaaacatccaggatgggatggcccttttgggctttatttttggagcccttgcgaccccttggtccaataggactttccggaaacttccc

SEQ ID NO: 724455 - DNA, 966 bp, Homo sapiens
  misc_feature (850)..(850): n is a, c, g, or t
  misc_feature (879)..(879): n is a, c, g, or t
  misc_feature (934)..(934): n is a, c, g, or t
gagtcttgccgatgcccccagccaaataaaccccttccttctttaactgggtgtctgaggagttttgtctgtggctcgtcctgctacatttcttggttccctgactgggaagtgaggtgattggtggatggttgaggcagctccttaggcggcttaatcctgccctgtggaacatgcctgctggggactctgaccagcctgagagacgcagatcctgagagcgctcccgggtacgcatttgccccggttggacgcttcgccagagcagtgtgtggcaggctaccgtggaggatcaacacagtggctgaacaccatgaaggagcaggcacttggagtctggacatctaaaacttgactgtggaaatgatgttagacaaaaagcaaacttgagagattttcttatttgagttcaaaatgggtcataaagcagcggagacaactggcaacatcaacaacgcatttggcccaggaagtgctagcgaatgcacagtgtggtgatgtttcaagttttgcaaaggagatgagagccttgaaggtgaggagtgtagtagctggccatcggaagttgacaatgaccaactgagaccagttgagagcaatcatcgaagctgatcctcttacaactagatgagaacttgctgaagaactcgacatcaaacattctatggtcctttggcatttgaagcaaattggaaaggcaaaaagcctgataagtgggtgcctcatgagttgagtgaaaataaaaaaagttgttttgaagtgttgtcttctcttattctatgcaacaacaatgaaccgtttctcaactggattgtgacatgtgacaaaagtggatttatatgacaatcancagctcagtggttggactgagagaagctncaagcacttccaaggccaacttgcacagaaaggtcatggccacatttggtgtctntgcagctgatcactaagcttctgatccaaaaa

SEQ ID NO: 724456 - DNA, 707 bp, Homo sapiens
agcctaaaccaaggtgttggcagggccgaggtctgtgctttaggaggctgtaggagagagccacattgctagtggctgccagtacttcttgacttgtggatgccagcattacttgacttgtggtcacattacctcaatctctcctgcgatggttgtgtggtcttctttttgtgtcagattgccccctccctctctcaacattcgtgatggcactttagggcccagccgttgatgatgaaggataatcccctcatctcaagattctcaacttaatcacacctgcaaagacctgtgtttcccccaagtcataagaacatttataggtatgtcacagtgtaggatgtagatgtcttgggtggaccattttcacagctgatcacagtcctataaattatttggaaaagtaggaaggttgcttttgaagtagcaactgtgtagatgtatcataagtatacttccagctatacatacgaattagtcgtagtttgataacttggtaggtgttaccttgatgatccacatttgagatccaactgggagacgaggtccaaaatttgtaccacctaatctgtttgtataacaatggtattgagcgacttttctctaataatggaagtgatgtgctttgagggtcagtgatagctgacagtggttaattattatcaaggtattaagatgagtctgaggttagggaaatgatatgatga

SEQ ID NO: 724457 - DNA, 203 bp, Homo sapiens
cacataggatcttatggactaccgtgcaggttgattcaagtcccactctcaattttggctgggttgaagtaccagccacagagtttcactacactccccacatatacaacataaatggattgtacacccaagtgaacagacccccgtaatgaccaaacatggcccttatgcataggcagataatccaagtccaccattagaca

SEQ ID NO: 724458 - DNA, 357 bp, Homo sapiens
tgctgtactccatactactgctctattgacgagacactggccccaccgctggtcattgacagaaccatggtccctgctcccctcactgacagacactggccccgactctgttcattgacactgtccctgcctctgctcgttgacagacactaaccctgcctctgctcattgacagacactggccccacctccgctcattgacagccactggccccgcctctgttcattgacgctgtccctgcctctgctcgttgacagaaactaaccccgactcatgctcattgacagacactggccccgactctgatcattgacagacactggtcccaactccgctcattgacagaaactggctct

SEQ ID NO: 724459 - DNA, 152 bp, Homo sapiens
aaaaaaaaggggggggggggggggggggttttttccccccaaaattttttccccccccttttttttttggggcccttttttttggggggggggggggggggggggggttcccccttgtttttttcccttttccccccctttcccccctttta

SEQ ID NO: 724460 - DNA, 141 bp, Homo sapiens
taacagcagcatcctccttcattctacccgcgaagatccgagtcgtccggaagtagagcgcccgtgctctcaccgttctaccgcagactcagaaagaccccctccggcacttctaccaggggcaagaagtacaagcccctg

SEQ ID NO: 724461 - DNA, 169 bp, Homo sapiens
tcctcctgggcggcccagtcctggacaataagcaacagatgatattgagtgtcgggtgggaaggaggccagactctgcttcggccatgatttgtgactgcccaggactcttcaggttgggctggcctactcaggattacactgagagtgatggcctcgtaagtacaggt

SEQ ID NO: 724462 - DNA, 922 bp, Homo sapiens
cggacgctgccgaagccgccaccgccttcggggccagcggcgggggccgcccgctcccccgggcgctggctgccgaggagatccgacagatgctacagggtcaacgccgctggccgacagcgatgcgtcctgacagcgctgcaggattacttcgcggcacgatgcaacggctcgtggcgaccgaggcatacccgtgcgtgcggctcgcgtccgtggcagaccgaacggaagagtccccgtcggcgttatccgtgtttgcgggcctgccgaggctgcggtcaagaaccgactctggctcactatcatagtcgcagcgaacatgcgaagaaagcatagcataaggtttgtgacgagttagtctgcagaacgaagatgcctaagtacacagatgaatgatgcgcacgtagtggtcgattacataccaccagaagactctaaacatagtgcaaagaaacgaagccgtctcttgtcgaacacatgggaacaaccaatccgtttgtttctcaattcgagtgaagattcagttcggattcccagtaaaaatctcagcaggacacttaccttcctcacgtggaatgtgggacgatcacttctgattggcggacaaccactggaaaaccctttccttccaggtcaacgctagctcttcttgagccgcctggtcgagatgacttgttcttgacgaacgcttccagtaggaggcgaatggtgatcgtattttcaattcgcgagtcgagtcaacttccgctggtgatatgcactgtcactaaaactactaggccagtccccactgacaccttctgaggccacaaggagaaagcagcatgcgtcaatagcccggccatgttccattagagggataaacgtgagaagaacaccatggctaagcatcagtgaaaagtacgcccgagctgggtagaac

SEQ ID NO: 724463 - DNA, 346 bp, Homo sapiens
  misc_feature (3)..(3): n is a, c, g, or t
  misc_feature (18)..(18): n is a, c, g, or t
  misc_feature (60)..(60): n is a, c, g, or t
tgnaaggggcactccccnacatcctgaaatggccagcgctgaatgaagaccccattaccnaaaactattgcagcactcatcattctttgggcgctggcattaacgcagtttggtggcacgaaatacacggcgcgaattgctaaagttggcttcttcgccggtatcctgttacctgcatttattttgatcgcattagcggctatttatctgactccggtgcccccgttgctatcgaaatggattcgaagaccttcttccctgacttctctaaagtgggcaccctggtagtatttgttgccttcattttgagttatatgggcgtagaagatccgcaacccacgtcaat

SEQ ID NO: 724464 - DNA, 216 bp, Homo sapiens
atgttagtgaaaatccgtattcacaacaggcgaacaatacgatgaattctccgtttctggtgacccctcaatggcttgcgcaacatatcaacgatgaaaatctggtggtgatcgacgtccggatgtcgccggtggggctgacgccgaagaaagatatgcttgccgagttcgaacgcggccatatccccggcgcggtctatttcgatatcgacgagg

SEQ ID NO: 724465 - DNA, 151 bp, Homo sapiens
caactactggcagcggaacaacgaacggcgatgatggactccaatccgcagggactctggctggaatgtttatcctagctcgcgaacacagcaacaacaccaaacaagcaagcaatccaggcacgacctgcaaactggcatgacacgctag

SEQ ID NO: 724466 - DNA, 1226 bp, Homo sapiens
gtgaacaccgggctgagggagtctgcaggtcggctccgggaagccgcgcggccgacgtgggtgagtgacttcactaaatggggaaaaggaagagggggtcggcagtatccccgaaagagggctagcggctgcatgaagaccagcagcagagctccacgagcaggaaaagcccccgaagcagccccagtggcgacatggacctgggccgcttaggccacgcccggggaagagggcctgactgacgctgcaggggctggggccgctggggccgggtcgcagctgatgcatgagagatgcaaccaaaggtgaaacgtggaaagaatggcagccaatcaacgggacccggtggtaagactcttaacagaagcacatgtattgccacttgtgtgcttgacttgacacatgcatcccatcggcatcattggtgcagttgggagaaaggggctcattgagcgagctaaccccaggatgcagttatttgtcgacacacaaaaattgttcgccaaggagggaaagagacggttgcaaacagcaacatgtagggtaccaaaacacaggattgtgacaccattaaagtagttagggtgagaaaagagggaaactcagcggcggaaaggcgtacagtggacttggccagttggagaccggtatatggactagacgcgtggaacataccggaaaaaggggtgcacaacccaaataactttgtggggacgacagtgtagaatccattagcgaagaaaaagattgagttacgttcattggggaaaggggaaccccgatgtagaatagccaagaaacattaaagacgaatcaaaaggggcgaagagaagtaacgcaaacgttgataacaaatccagataggaaagacttggggaaaggacaaagagacgccacaattcaaaatgaggattggacattaagggaacacaagcagacacgttagcccggatgtagctttagcacatgcaagagatacccagagaacatcagtgaattacgtttggcacagcggaacagatgtgtcaaacagtgggtcctagggagcggggacaatacacaaatggctcattggaaaaataccgttagtcacgcagtcgtataagtactaagaacacaaaccaaaggatcgtggataaacgggagcgaaaacaagacacgctttatggcaaagtacacacactgtagggaaccacagaaaaatatgtaggtaccctgacgaattg

SEQ ID NO: 724467 - DNA, 312 bp, Homo sapiens
ggtagacaactagggtagttttgcaggtggtaagccatttaccaagatagttgtaggtaaagaagggcagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 724468 - DNA, 347 bp, Homo sapiens
ccggttgttaatctggtcctcctaaattggtcaaattgtgggtctggtccaattcttcaaggtcttcctggcctttttcccggcaatcctggtcccgtaactttagattcagcattcaaggttttgcaaccggttccttggtccttttcggcaattgccgatggtttcaggcttctgggtcaaccttgtccacctgggcaatggcgccttaccattaagcaggaccgttggcctcctgaaacacatctccattgactgtggtccccatgtcctcagaacacacgcactcgtggggccgctgccgggggccatggctgccggcaggtgccccgaagccctcgtcgttc

SEQ ID NO: 724469 - DNA, 122 bp, Homo sapiens
gtcgacagccagtaaaaaaattgttagaaagcgagactaccatcaaattggttctgggaagtgtgaaatcaaagttgcacaacccaaagaggtatataggcagcaacagcaacaacaaaaag

SEQ ID NO: 724470 - DNA, 211 bp, Homo sapiens
ttagttcttaccacaggcatgtaactttagagctatagaataaaataacagattgcacctttgcatatcctcaaaaggattttctgtctctatttcagaatgatttttctaccacatacttgattttttgattatacacactgctgtaaacctatgttacatttcttatattccattccaaaaactctgcttcaaattttaaatgcccttt

SEQ ID NO: 724471 - DNA, 895 bp, Homo sapiens
ggatctctatggctgtcagaggtgggcggctttgaccagagcagcgcttgctggagctcgtcggttggcacgcgatgtttcgtctgaactcacttctctgctttggacagaactgggctgtgggttcatcagagtggtaccatggaggatcacagcccatccatgatccggcgaagactaatgatggtggctttcctgggagcatctgcaggtaactgcaagtactgctcttttgtgcgaagaggtgatgattgttatccagccactcttgttcgttgcgtatagcttttatgcttccagtcatctctgttgtcagaacggagttgatttctggcttaacctctgtatcagaattgtcttgctcggatcatttggtattgttaatattcgtctatgaaataagatgtttcacaacgaattcaacatgctaatggcgatacttaggaaacactgtgcttcaaggtctgcctgtctcctctgctgaacattttacataactgggatagggatacgcaatagcagctttagagaatgaaggctttctggccaggcgcggtgggttacacctgtgatgcccagcactttgggagcccgggatgggttggatcgcttgaggtcagggagttgagaacaggttggcaagatggcagagaccattctctacaaagatagaaaaataggcagaaacaggcgtgagccgtggccctggtgcgggaggcgaggggagaatgttgacctggagcggggcgtgagtggcgcaatggcctggccaccgggtgcagaacggtcccaaaaaaaaaaagaaatggggccgcccgagataaactgggcgcaagagaagaaccacacacaagaagggcaacgcggggcgaacaggtgtcgcaacgccgaaggg

SEQ ID NO: 724472 - DNA, 418 bp, Homo sapiens
  misc_feature (350)..(350): n is a, c, g, or t
cgactgcgtataggctgtcacatagattccatatgactatgtactttgaggttccattgaaatgtaagtgtactgcgcatgatacattaccgtcatggattacattggctacaagaaccatgaggacattgtgatagtgcctgacgatggaactaaactgacatggtagactgcatttttgtgccaagctctacagaagtgtcactaattgcctagattcaaatcatgttttaatgctagagtcgaacttacaactagagaactgtgcactaaagattacttgtatcatatctaatgcatcatacgtgctcgcagaaggagttagaatgacatgacaaatatagacattnagtcgggtgctgtatgaacatgtatgagcatcattctatgtgtagtgtacacgcactgttcggcgctt

SEQ ID NO: 724473 - DNA, 199 bp, Homo sapiens
gttttccctctcagataatgaaaagcatgaaattctgaagataagtgatgattcaacaagtgatagcagttacatgaatcagtgactttactgacaactatcttagaatgagcctcccaaagtgccaggattataggcctgagccaccttgcctggccaggggcatggatttgatcaacagttaggtttgctgtctgcc

SEQ ID NO: 724474 - DNA, 476 bp, Homo sapiens
  misc_feature (340)..(340): n is a, c, g, or t
  misc_feature (376)..(376): n is a, c, g, or t
gtcacctgaggcctttccctcacttttcagggcctgccatgcgatcagggacacccgagaccacttccagccccaacctcccatgcacgtgggagtcccacccgggaggccttccacacatgcccacatcagtcacagcgagtgctcctgggactgtgatggtgcctgtcactctgcctgggggctggggagggtcacagaagatggtccttacctatcttacaaagaattcaaaatagagcccaggccctgagagcatgatttgaaggtgccgctgtggtgtcagacccaccattccagtgccagctgtgccacctgtgtgggcatcagtgtccatcgntgtgaaataggacattacagggtgaagttgggagtnccggcggggggcacatgctcagggtctggcgtgtatagacacccctaatacatgattgtgatcatgatcacagaatcttctggaaactctgcctccctgg

SEQ ID NO: 724475 - DNA, 673 bp, Homo sapiens
agctttggtacagttattcaggaagtgaaaacaagcaatgtggctagagaggctgccctgggagctggcttctctgataagactccagctcacactgtcaccatggcttgtatctcttcaaaccaagccatgaccacagctgttggtctgatagcttctggccagtgtgatgtcgtcgtggctggtggtgttgagttaatgtctgatgtccctattcgtcattcaagaaatatgaggaaaatgatgcttgatctcaataaagccaagactctgggccagcgcctgtccttactcagtaaattcagattgaattttctgtcccctgagctccctgcagtggctgagttctccactaatgagaccatgggccactctgcagaccgactggctgctgcctttgctgtttctcgaatggaacaggatgaatatgcactgcgttctcatagtctggccaagaaggcacaggatgaaggacacctttctgatattgtacccttcaaagtaccaggaaaggacacagttaccaaagataatgggatccgtccttcctcactggagcaaatggccaaactaaaacctgcgttcatcagaccctatggcacagtgacagctgcaaattcttctttcctgactgatggcgcttctgcgatgctaatcatgtcagaggacagag

SEQ ID NO: 724476 - DNA, 102 bp, Homo sapiens
gactcttaaggatccccggttcaaggcgcggaattttccgtatcagaccgatttaagtgctgcaatgaaggagtcctgggagcatggactttcccctgccct

SEQ ID NO: 724477 - DNA, 162 bp, Homo sapiens
cacgaggaagacagccgcttacaatctcaactcaagtctcagttaacaagcgtgtgtgtcaccaacctgacagtgtcatccaggaacaaccgcgggtctctatgctccatacgagggtcactgtgctctacccagtgctctctgagctcggtcagcttcagt

SEQ ID NO: 724478 - DNA, 319 bp, Homo sapiens
  misc_feature (1)..(1): n is a, c, g, or t
ntccaaccgtaacagaaccagtctgacctgtgctgtgtaccatatggagcctgatcatccagcagcagggctgagctcctcggagcccgtgcgcctggtttacttgccgggggaactgtggggacagctcttccatgtactcgctcgagggcaacatggtggagcacagtgtgccagttgtgccaggagctgcggacctcgttgaggaatgtgaccctgcactgaaccctgactggctccagcggggccttacagatacaccgaggttgaaaagatgtgcggctgattggggcccggcgcctgccccttgcgccggggg

SEQ ID NO: 724479 - DNA, 296 bp, Homo sapiens
gtaaagcctgaaaaattttccctttttgcccttaaatcttggtgttgttttaggagacgggggcccagggagtaaaggaaggcccgttgagcaaaccgaaggggtcctttgcatttcaaaacctttttcccttttatagccctgggggggaagattttattaaaatcccacgggaagttgataaggggcttgctgatgacttggaaaaaaacttccccaggttgaagggtcaggcttaaaacctgaattgggattacttctggcccagaaataaactttttttttttccctgccca

SEQ ID NO: 724480 - DNA, 712 bp, Homo sapiens
tgtaccatgtgcgctggcctgcggcaaggccttcggctggctgctccacgctgctgaaacatctgcagcagccacagctggggagaagccgcaccactgccctggtgtgtggcaaggccttcgggcacggctcgctcctgtgcacatgcacctgcgcactgcactgtgctgtgccctgctggccccacaatgtgccctgtgtgtgctgccaatggtgcttctgtgccatgtgagctctgctgcttgctcaagacacccttgcgcactgcacactgtgtgctgagctgtgccctaccctgtgtcctgcatgttgctgtgcaatgtgccttctgtggcatgatgctctggctgcttgcttgcatgcaccatgctgcacacacactgtgcctgagctgcccctacctgctgcccccacttgcggcaaagccttcggtgcagatgctccaacttgcaacaccacctgctgcatccacactggtgcgagctggccctactgcctgcccgcactgctccaatggccttcggccagatgctcagctgctgctccatgcacctgcacgtgcattcgggcgagcgtccctatctgctgtcagctctgcgggaagtgccttcggccaggcctccagcctcaccaagcacaaacgggtcatgagggttcagcctgtgcttgagctgccgggggcgtgcagctgagcagcggctgcggctgggc

SEQ ID NO: 724481 - DNA, 184 bp, Homo sapiens
cacactcggttatggaactctctgcatctggaggcctgtctaggcaagtcttccctacccctccacacaatctacccttctcctgcttcctgtggcaccttgcacaaagctctaataagatatgcaccacactcccatttggttggtttccatgtcaggctccccacaggaagatttccccaga

SEQ ID NO: 724482 - DNA, 114 bp, Homo sapiens
ctgaagatcagggggaagatcttagaccagggggaggactccccagcatcagagatgacacggatcgccaggctgatggcgaagaacaagatgagtgacgggaagaaggaggag

SEQ ID NO: 724483 - DNA, 702 bp, Homo sapiens
  misc_feature (169)..(169): n is a, c, g, or t
ttctctctcacaaaagaagaaaaaaatatgtatctatgatgtatatttttatattaatatatgtagaagcagtgagtacgatatggtgtgtctaccagaggactccggtggagtgaggcacatgggtgagaatgcatgggtcatcagctgtgtcaacacaaccaacagngaaggaatgattattgctgtgtgagaatcctattgcatagcatggtagatgctaagtatttcaaatagacaacccaaaaaatgttatgcatttgaggtgatggatatgttaactggcttcatttaattattccatattgtatttataggtcacaataggactttgtggcccataattataaacaagtataaattgtccatttacaattaaaaatcaattaaaagaaaaaaaaaaaaaaaaaaaaaaaaaaaaaaaaaaaaaaaaaaaaggggggggggcgacaaaaatcccccccgggggggccccaaggtcaaacgcgggacaccccgtctctgcctcgcacaaaaggggcccccttaagaggagcgccgataaaaacgcacgaggccacggcgcgcgttaaacaaagcgggcgcgccgcgaaacggtcgtacgcgggaacctgggggaagagccccacttcgtggggtgggccattactgggacacctccgccagagcttaacgccgaggacaacaacactagcgataacg

SEQ ID NO: 724484 - DNA, 118 bp, Homo sapiens
  misc_feature (24)..(24): n is a, c, g, or t
  misc_feature (45)..(45): n is a, c, g, or t
  misc_feature (85)..(85): n is a, c, g, or t
  misc_feature (95)..(95): n is a, c, g, or t
tggtagatgcatgacttgtgtgtnatgagagaatggagacagagncccggctcctctactgtttaacaacatgctttcttatttngttgaatgtnattcacagatagcacaaactaca

SEQ ID NO: 724485 - DNA, 1262 bp, Homo sapiens
agctatcccaagcaagacagaagtagtgatataccatggcatgtcagcattgccgaagacatactacaaggcgcctttctgaatgacaacgacctagactgcatttgaaaagtgagacgggaatcgaaagttaaacttacagaacatttagtcccagacttcgacacgatgtagtggactcacgccagtacttgcgtttgactggtgtggacgccggacaccttttgaagttggagaccacctgactgagagctagtgggaagcttcacctgctggataagctactagtcattcctgtattctagggggccatcgggttcaacttatgctcccaaactgaccccagactgtgggactacttctccgaagactactatggattacaagaggctacaggctatgactcgtgtggactggttctcgtgacgacggccgacaggacgagacaactaggaccaatataaacacactaaaggacaagacagccacatgccacagaacacaccatcccaagcagtacaccacagggacacggatgacgcagtaagacacatgacactcaacaccagcagccagaacaaccagtgactacaaggcaagacaaagcagaaccaatcaaaacaacacctaccaggacatcgaaccataagacacaccgcaacgcagcgccaccaacgggcaccacactacgcccactaggaccaaccaaaccaccacacacatcggaacaaacacgatacctaccgagcacccggacacagcgaggaccccacgcaccaccagacgagccacaacaacacgaccgcaacaacggaaacaaacgacagcccaacaccaaccacctgcacacaccccaaccaaaacacgaacacaataagcaaaggaagggcccatcgacaaccaccgagagaaacacacaacacaaacacccaagaccggaaccgcactacccccaacacacagaagcaaaaaacaacaaaacacaactgcgactggcgcaccaaaccagcccaccacaaaaaggcaaaaaaccacggcatgaaacacacacggagcaactacagaacaaaaacacacgcaggacacgggacacagagacacagccgacaccaacgaggaacaacaacaccaggggcaaccaaaaaagaaaaagagaaaaaatacacgcaccgcgacacacaaaataaacacaaaacaaacaacaccaaaaggacaaacaaaaccaacccacgcaccaacaggaaacacacgccgacgacaca

SEQ ID NO: 724486 - DNA, 468 bp, Homo sapiens
acaacttcaaaaggatttcaggctgagtgtggtggctcacgcctatacacccagcacttgggaaggctgaggaaggaggatcgcttgaggccaggagtttgagactagcctaggcaacacagtgaggccttatctcaacaacaaccacaaaatctaaaaattagctgggtgtggtggtgcatgcctgtgatcctggctacttcagaggctgaggtggaaggatcacttgaggccaggagtttgaggctgcagtgagttatgatggcactgctgcactccagcctgcgggacagagtgagaccctgtctgaaagaaagagagaaagaaagaaagaaagagagagaaagaaagaaagaaagaaagggaaagatggaaggaaggaaggaaaaagaaagagaaagagagagagagagaaagaaaaagaaagaaaagtaagaaagaaaaaagaaaaagaaagaaaagtaagaa

SEQ ID NO: 724487 - DNA, 447 bp, Homo sapiens
gctgaggcgacacacacctcaggctccacagtagccagaactacaggtgtgtgccacacagccaaatacatttgtgtttctttttaatgagatggagtctccctccgtcacccaggctggagtacagtggtgtgatctcagctcactgcaacctctgcctcctgggttcaagtgattatcctgcctcagcctcccaagtaactaggactataggtgcacaccaccaagcttggctaatttttgtatttttagtggagatggggtttcaccatgttggccaggctgcttttgcactcctgacctcaagtgatctgcccaccttggcctcccaaagtgtcattaggtgctgggattacaggacagctaccgtgcccactctaatttttaaattttttgtagatatggggtcttgctatgttgcccaggctggtctcaaactcctagcct

SEQ ID NO: 724488 - DNA, 1047 bp, Homo sapiens
gtcccctgctgtctgtgggtcccgcggatgctcctcgggccccgggtctcctggcgtttcgggggtgcgcgaggtgcggcgaggcgctcggttgtccctgccggtccgctgggtcgtccggtgtttcgctgtggctcctgtggcccctgttgccggcgcgggagacgcccagggttgtcctggcagcctctcgtcgtgcggactcgctgctgtcgcaagctgcttggggctcccggttagtgctctagggtcccgtacagtcctgcgcgccaggcgcctgggtgatacctggtgtctgcaggggcccagacttttggcgctcccgggtgctggaatggcccctgtgttctccggctccgccggcagactctggctcctccgacctacacctcgggggtacctagtccgcctggggtctggccggggctgggtcctcagtcctccctgggcgcgctgggtccacctgtgttggacctggcgccagtcagagagccgcgcttcgttgctggctatccgcccctgagtccccaggagcagctgcagtcccgagaccttccaaccctgatgctgcgcgtgacgaacgcctgggatccctggtgctggatctgatcttttccttgctgcccgcactgtcctgtctggtctgaagctctcgcggctaccggtccgtagagcccacgctgtgaccctgtgctgtagcttctttccaggcctttgcccaaggagtagctggaaaggaagacgcgattagtggcttaagacttccaagccagaagacagagggttcgaatcccacgcactgccggtctactcagctgtagttagtagcaggctacagcaatatggtagtacgtagagtacgtgcaagccagctggacttcctgggattgaatggggacctggagaacttttctgtcttacaagaggattgtataatggaccaatctagcactcatgtaactatggaccaatctagcgctctctaaatatggacctaatcacgcagacagtgggccggggacaataagggaatataaagctggcgag

SEQ ID NO: 724489 - DNA, 292 bp, Homo sapiens
agcacaagtctgacatgctggagaacactcagacaaaatccttaacatacataaatatcacccggattccctccacaacatgaaatctaaccccatgaaacccatgatagtccacaaaaccagacacgccttatatcacccagtctagcttcacaacagccaagcataatgcaaactcgcccccgcaactcatgaaaatactccacacccaacaaaccttcccccaacacagaaacttgccgggcaaaacaaatgcaatggctcatgcctgtaatcccatcactttgggagc

SEQ ID NO: 724490 - DNA, 111 bp, Homo sapiens
attatagctggacgtaatgacatctgcagaacatcagtcggatccatcgttggtttagcttgctgcacgggtgtaggaaagtctaattgtaaatgttaatagataccttgg

SEQ ID NO: 724491 - DNA, 345 bp, Homo sapiens
agagatgagcaaggagagctagcggaggatggggagcatgaaacaggacacgcctgcaaaaaactcccaatgtggagaagaacgtggaagaacagcagagctgggcagatgtgagtgggcggcgtggggctgggagagccaataccaaatagcctggatttacaggaatccagggctgcctgcaagctcgcgggagctctgtgcttgggcggaaagctattattttgaggtgggaatgcaagcatgctcttacctgaggaaaagcacttcatatgtcgtgagttttacgtaaaggaatttggcgtcatgggttgaactacttaactgaccatctgctttttttgg

SEQ ID NO: 724492 - DNA, 912 bp, Homo sapiens
gggtgtttctccttccataaggccctccttattagggcgtttgtttacatactccacttatcagcttgaattcctacgcttggggcggcggttttttattcaccctgaggtctctttctctcctgggcgcccccctcaccccacccccctgttctcctaatagggccttctttcattcagcgcggggagaaattctcttcgttgtttgtagtcccccccgcacaaggattttgtttttttctcccagcgcaggttttttgtggataccgctttctccgcccacccccgccctctgtgttctcttctccccccaccctttttgggggcgcgcgcttcgcgctcctcctctccacggtggtttctcctccccgttttattgcctcctatgagtagtcgctcgccctcccttgtaacacacacaccccggtgtattgtcttcgctcgtccaggggagtgtgttctctcatctccctctggccgtctccgccacttagtgttttatatatgaggaccccctccccgtcctcccccattttttcttatagccccccgtggtgtgtacaccacttgtgcggggtgttttttttttccccctcctcacactgcctgcctgcggggatttgtggtggttcctctttccccaacttttgctgcggcgctgttgttgctgcgctgctacccaactttgtgttgagccacacgggagtttctccccggcatttcatccttcttatattggtgttgccacgcacctttctcctcctcactagtgggtttatccgccccccccccagttttttctccttccacacccccccaaccaccctgtgggtttaaaccccccccccatggccctttttaaaagaggggttttaatttttttttttttccccttttttgtgggggggttta

SEQ ID NO: 724493 - DNA, 875 bp, Homo sapiens
tgccacttagtgaataacgtgtgtgtgaggacttcagaagggcctaccatggctgtgtggtatcgttcaaacaatcatgggtttcgcccctcctccaggtgagtaatgacagacttagagagatttgtcagtataaaatcagtgctcgaggaagtaaggaggtcgcttagtattaggggagggctgttttccatgatgactgtagtatggtctcaagtcacgaggaaaggaatgatccctggaaactccatcacacagtggtgccttaactgggagccatactggcagcaagaaatggacccaagtggccatggttgggtcagccgcaatggtgtggcattctcctagctttactgtgagaggagctggtatctgtgtgacaagattttgcctctgcacaagtgttccacaatgggtcctcagtcgcaggaagacccctcccagtgtgccttcaatcagttaccctttgcttcaccttttggagacttatcgacaatatcatgtagggacttctttcctaggatttctttaacagaacgagtgtggttcgagaaggatttcagaagatcaaagttacagtctgtttttaaaaccataaggtggggacagctatggcaataggtataaagagacctttagcacttttttctattaaaggaacagcgggaaggtggtaaagataatacgttattattcaccctttgaatgcttgtgaccagatcacgttaatgttaggaatcagcagtgtgaagatgggccagggtaaaaggagatgtacattcctgggtcttgcggtgggtggtgtccaccaaaggggggactctttaaagggaggggaggcgttcaaaagtgtgtgccccggaggaatgggggac

SEQ ID NO: 724494 - DNA, 218 bp, Homo sapiens
  misc_feature (8)..(9): n is a, c, g, or t
  misc_feature (29)..(29): n is a, c, g, or t
  misc_feature (118)..(118): n is a, c, g, or t
cacgcgtnncgttgatgttgtgcatttangtcatatgtttgttggccatttgtatatcttcttttgagaactgtctattcatatcctttgcccactttttgatggttttgtttttttnttgctgacttgtttgagttctttgtagattcttgatattagccctttgtcagatgtagagattgtgaatatttggtctccattctgtgggttgttctgtt

SEQ ID NO: 724495 - DNA, 121 bp, Homo sapiens
acgcattatcaggaaatagcaaacgcacttgaatccaggattgatgacttcaaaatccatatctttggtctggtgcagtgaataaagattatgtctggcgttcaggtccctgaagatgtgg

SEQ ID NO: 724496 - DNA, 675 bp, Homo sapiens
tccactggcccggcacattctcctcagagatccctgagccccgcggataggtcaaaagctggtacccgactggggccttcagtgctgtcttctgctggctcatcctgcagcagggacactggagagcaatggtccctgccacacacatctgcggggaccagggagtgctccttcacctccctccctaacaccttaacacccggggagcctccggagggtggcaggaagtccccagacacccaatgcacaatctgccctcaaattctctatgtacatagcccatgattgcgggggctggccactccccccaatcgttaaagggctacacgcaccgactccacgaagacccatagggacgaggatagaaagagagagacaaacaaacataaataagcaccaagagaaaccgggagacaccccaaacaccgacatataaaaggaaagaacagcaaaacaaatggcaaccgcacaacccaacatcacggacaacggacgcagcaggagaagaacacaaagaggcaacaagagaacgagacacacgaaagaagggaaatagcggcaaaaagaaaacaacgaaaaatgaaagacaggaagcaccagaaaaaacaacccacaaagggaaccgacacagcacaggaagagaaccaggcgaatacaaaaaagagacaacacaag

SEQ ID NO: 724497 - DNA, 827 bp, Homo sapiens
  misc_feature (140)..(140): n is a, c, g, or t
  misc_feature (261)..(261): n is a, c, g, or t
  misc_feature (289)..(290): n is a, c, g, or t
  misc_feature (308)..(308): n is a, c, g, or t
gaacctgaacctgaaaaggttatgagaagccaaaactcaaaccaagacccccacctcctccacctgctccacctaaggaagatgtgaaggagaaaatattccaacttaaagctattccaaagaagaaagtcctgaaaaanctcaggtccagaaaaagtgagcttacacctctgaaagtgcctggaggtgaaaagaaagttcgcaaattacttccggacgtaaacctgaaccaaaggaagaagttgtctgaaaagcgtctangaaaaagacctgaagaagaagaacctanngtagacctaaaaaactanaaaaagttaaaaaagcctgcaggaccagaaccagcaggctccaaaacctgtggaagaggtggaagtacctactgttacacccacgggcacgtggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgcccagtaacagtgccagtggttggaaagaagcagaagccaaaggcacctaaggaagagggctgcaagccaaaggtcctatcaaggtgtacccaaaaagccagaagctccacctcctaaagtaccagaggtcccaagagggtgtgcccgaaaagaaggggccccgggtcctcctaaaggctgagtccccggtaagggcgaggtccaaagaaatggcggaagaagggcgcggccccaaaggcggagtccccgggaggccggcgccaaaggcccaaagggcggccccaa

SEQ ID NO: 724498 - DNA, 345 bp, Homo sapiens
aatttacccccctttgatgaaaggattactttattccttatcggatattttaacaatgtttattattcctttatccctctatagaacccccccccccccccaggagattattttgagttgggtcccaccctagggcctggacttttaaatttaactccccccttcccccctttttttacttaggtgggggcatggttcagtcaaaactggtgtttcctattgggttgtgccaaaggagggcctaggcccccccatatggtggcccccccccggagggtttattggcaggctggaaaacaaaagtttccccataaaggccctttttcccccaaaagggggtgggga

SEQ ID NO: 724499 - DNA, 1273 bp, Homo sapiens
ctcgcgtgcatttgggcagctcccataccgtctccaagacccaatcctcaaccattgtatgccccctggatcaggccattggtctcctcgctgtccatcttccacgaagtactccggcatggacgtgagtgactagacataccctgaccaagaaggagctgaaggagctgatccaagcaaggacgactcagccaattagggctcggaagcctgcagagcatgactgcacatatttgcaacgggctgagtgtgaaggacgttgcgaatccagaatcataggagccgagagagcgttgagactgtccaaggaggtactgctcagcactgtcctgggcggccgttgagccttctgcactctacgaatgcaatgccccatctacatggggcgtgaagagagtacatagtatgggcaacgaatgcgcaggacagcccctcgtgggggcgtcctactcgtgcatggtcagaattccacgtgggtgggcttaattcgtaacaaataaaattctctattttaggggatcaagacttgttaaaaaaaaaaaacaacaacacacaacacacaaccaaaacaagagggggcgcgcgcccgcgcccctctataagagtttatctcccacctcgagagggggggccccaagagcctatttcacgcgcgtttcacccccgagttatctcgcgtgtgttcacccaagagtgtggggcccccccctaaatgagggagagctgcccaatattttatatagaagcgctctgagggccccatgtgtggccgcgaagcctgtattaacaccaacaaggtctacgcgcgcacttctgggcgacacacacatcgtgggtttaagcccccttgcgggggacaatatcttcagggggtggaccaaaggggaaacccccttaaacactcatcgagtgcgcgcagtgtcttgccccatcataatatttgggggcaacaacaccttaaacaacttaaccgcagtacgaatattttcaaacaggggcccctccaccagcgggggggtcatcaaattcattcaaaaaaacgtctcgttccacacgaggtcgtctcatcaaacgaccaggggcgcttataaacaaccatacagccgtgtgcaccaatacgtagcaccatgtacccgcaggcccttttagaacacacagtcttacgggggccactaaacactggcgagaccaattcgcgccctctctacacacgcagaacccctatagtgatatctacacccaccaggtaatcattaaacgtgagataggaaca

SEQ ID NO: 724500 - DNA, 103 bp, Homo sapiens
tagcgggagtcaggggaagttaggccggctcctgggcgtcttcgaacagaaccaggatcgcaagcacagaacatgagtagctgatgatgttcagtatcggtag

SEQ ID NO: 724501 - DNA, 132 bp, Homo sapiens
aatttcaaataaaaataggtaaaaataacaaacttagcagtaacagagtctctaaacggcagccatgaaagaactgtactcaagtcgcccttataggagcccttgattcaggcttcaataagtagtaggaca

SEQ ID NO: 724502 - DNA, 704 bp, Homo sapiens
gggacccaaataaagtataggcaatgtgtcaaaatttaatgtttcataataaaaatagatacgttgacttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaactgaaacaggcataaaacaacgtaaaaaattaaaaaaaaaaaagtgaattgccacctaaaaagaaaacggataaaaatgcaaaagccccaaattaacaaaatttaaaagggaaaaaccccgttttaaaaaaccaaaatgccttaaaacaaaatgggacttaacaattgtaaccttttaaacaaaaggcccccttgaggggggattgtaaaaggaaagctgaactataaaggaaaaagtaaaattaaagcttagtaaattaggtaaaaaagaaattcaataggctaaaaatggctgaattttaaaaaaaaaaaaggagaaaactgaaaaatgttttaaactaaaacaaaatggcccaaaaaccctctaataaggaaatggttatctaaaggaaccgtgttaaaaaccatgttttaggcaaataatccgctaaaaaaccttttatcgtaacaagtatccaaggcgataaatgaaataaggagttctgatgttg

SEQ ID NO: 724503 - DNA, 347 bp, Homo sapiens
  misc_feature (95)..(95): n is a, c, g, or t
aggaaccagcacatcatgatttacttgggggctggccaccacaacaagaattaactgggccatggaggacaaacaggaaatggtggacatcatcnaaacggtgtaccccggggcccccaaaggccccggcctggtggtgtcccccaaggactactcccccaagtaccgctttttaggcgcccccagtttgcgcggataaatgtcgtggagccccttttgtatggaaacgtttttagctatttaaagcctttggaaaatacaggaagctccagggctggagccccttttaaatggaatttataacatggtttttactcccccaaataaaccagcccgtggttaaagga

SEQ ID NO: 724504 - DNA, 444 bp, Homo sapiens
  misc_feature (11)..(11): n is a, c, g, or t
  misc_feature (32)..(32): n is a, c, g, or t
  misc_feature (63)..(64): n is a, c, g, or t
  misc_feature (67)..(67): n is a, c, g, or t
  misc_feature (85)..(86): n is a, c, g, or t
  misc_feature (179)..(179): n is a, c, g, or t
  misc_feature (316)..(316): n is a, c, g, or t
  misc_feature (356)..(356): n is a, c, g, or t
  misc_feature (376)..(376): n is a, c, g, or t
aagccctgaanagatgtcttgtcttcccaacnacaaaacttacttcccgaacttcgacctaannaangtttgcccaggttaaggnnacggaaagaaggtggcgacgcgctgaccaaagccgtggcgcacgtggacgacatgcccaacgcgtgtccgccctgagcgacctgcacgcgcanaagcttgggtggacccggtcaacttcaagctcctaagccactgcctgctggtgaccctggccgcccacctccccgccgagttcacccctgggtgacgcctccctggacaagttcctggcttctgtgagcaccgtctncctccaaataccgttaagctgagcctcggtagccgttccntcccggctgcctccaacggncctcctcccctccttgcaccggcccttcctggtctttgaataaagtctgagtgggcggcaaaaaaaaa

SEQ ID NO: 724505 - DNA, 160 bp, Homo sapiens
ctcctgtctttggagaaccagctccttctcattactgcagacaatgccacacagatcaatgtcatccttggtgctgtcttcgctcttgtttttcttgtttcttccccacttgcttgtcacatggcgctcgtggccccagcccctctgaacggacaactct

SEQ ID NO: 724506 - DNA, 537 bp, Homo sapiens
ccgtctttccatatgtaaggggaggatgacctatcaagtcaaaaacagctgaccacatatggtggctcatgcctgtaatcccagcacgtgggaggcagatcacctgaggtcaggagttcgagaccagcctggccaacatggtgaaaccccatctctactgaaaatacaaaaattaatcaggcatcatggtacacatgtgtaatcccagctactccagcggctgaggcaggagaattgcttgaacctgggaagaggttgcagtgagctgagatcacatcactgcactccaacctgggcgacagagagactgtctcaaaagaaaaaaaaaatggtgcttcaggccctgtgtagaaaaatgggaaattatggaaaagcagaggaaacaactgggtattaagcagtatagggtggtggctcagagcaaattcgcctctgctgctgaggcaggttacgtcatctctccgtgcctcagtttccctatgtgggataacgtagtacctagtgaatagcggtgacttgaggaataagtgagtaaat

SEQ ID NO: 724507 - DNA, 172 bp, Homo sapiens
gacggcagtgcaaccgcctggcttgattgcaggcacctactcatgcacactgaatttggagcgccaccctagcaattatcaaccattaaccttccctctacacttatcatcttcacaattctaattctactgactatcctagaatatcgctgtcgcctgcaatcaagcctgt

SEQ ID NO: 724508 - DNA, 1081 bp, Homo sapiens
cagcgtgcacagcgaggtcggcagtggcacagcgaggtctggcagctgtgcacatgctgatgtgtctgtgcatgctgtgcacatgctgatggtctgtgcatgctggcacagctgatggtcaggcagctggcatgcgaggtctgtgcagctgtgcacagcctgaggtcggcagctggcagcgaggtcggcatgctgttgcgcgctgtgctcttccgcggactctgaatcatgtgcgaccacggccacgatggcgagctcgtggctcggcgctgaaacgccggtgctcaaacgaggaaggacatgactaaagtggaattcgagaccagcgaggcggtggatgtgagccccacgttcgacaccatgggcctgcgggaggacctgcttgcgtgggcatctacgcttacggtctttgaaaaaccatcagcaatccagcaacgagcaatcaagcagatcatccacaggcgagagcatgtcattcgcagcagtctcagtccggcacaggaaacaaacagccagcttcagtatctcagtcctccagttgtatggatattcaggttcgtgaaactcaagctttgatctgcggtcccacaacgagagttggctgtgcagatcagaaggcgctgtagctctcggtgactacatgaattgtccagtgccatgcctgcaattgggaggcaccaaatgtggggaggacattcgtgaagctggcttacggacagcatgtggtccagagcactcaagggcgtgtttggtatgatccgcgcacaagcgcttaggaccccttctatccaaaggtgtgctggctacagccggatgaccagttgactaccggtttcaaacagcaacatttaccatgtattacaggaaccgtgcttccacccaacaagggtgcccacatagtacccccgtcacaggacaattggcgctagcacaggttttagcgcacaacgatttgggaaaacagataataccgacggcaccgccaactcctgcgcaggcgagctacttgacgtctattaacacagacccattgcggctttcgactacgagtatgtaaaattaccatctgctgcgcagcatt

SEQ ID NO: 724509 - DNA, 412 bp, Homo sapiens
aacgctctggaaggaggggacgatagccagaatgagttacagagcagcttctccttccctgcggaggagctgtgtgtggaggcaggtgtggttgagagaaagatctacctccaccctctgtatctggaaaaggaacctgcctacaggtctcaggggcagcatagccctctactctggggacagtacaccgtagaacgacagaagcggctgttaccaacagggcgaaaggctgggaactgggaggaggatgggtggctggcatccttctccttgtagcctgctgggagcatccaggaggtggtagacagctgcctgaagaaaattgctccacggcttggcctgcgagtgaaagggcaccccagatgcacggtcacccatctcgccttttgcagagccttgggtaccgagctcg

SEQ ID NO: 724510 - DNA, 699 bp, Homo sapiens
cgcaggagcccagggccgtagcaccatggggcccacccgggaattgcatgtcttgagccccacttcccccaggactggcacggcgccgtggccaccgtggtctcaccacccggcccgttagatccgccgacgttaggcgcccgccaaccaaggcgcccgcatcgccccgcgccccgcgtcgggtcccatccggcccatcgtgcgctgccccaccggttcggtaccacacgaaggtgcgcccggccgcggcttcagcctggaggagctcaagggtggccggcaattcacccagaaaggtggcccggaagccactcggcacttttctgtggaatccgaggaggcggacaagtgccacggagtccctgcaggcccacgtgcagcggctgaaggagtaccgcgtcccaactcatcctcttcccccggagagccctcggccccccagaagggagacccgttctgctgaagaactgaaactggccaacccagctgaccggacccggtcattgcccgtcccgggacgtctataagaaggagaaagctcgagtcatcactgaggaagagaagaatttccaagccttcgctagtttccgtatggcccgtgcccacgcccggcttttcggcatacgggccaaaagagcccaggaagccgccagaaccggatgttgaaaagaaaaaattaagccctcctggggacttgga

SEQ ID NO: 724511 - DNA, 876 bp, Homo sapiens
tgctgtgtgattctcttttttatggtggatactggcctaaattgcctgtgctggtaaaaatgtttaccggggaaataacttgaaatgatggctacttggtaaatgtcttatgaaattttcatgaacaactccaagcataatgtgttaagaaacacggtgttttaaatccattgtaaggtgggaataaagagtattatgaaagtgggacttttcaactactttctctacagctttgcgtgtaaatcagtctggggtctcgtggaaacttctctaagaggaaatggtcacatttttgggaaattcattccttattccctctgggcgagctaaggggctctttaccaagttttaaagcagcaaaatttatcataacaaaaatactactaatataactacgtgttgtccatgtcccagtgatcccctctcttcctccccacccgtgaaaaaaatgagttcctatgtccggggagagggggggatgatagaacacaagtgtgttgtgtcccatgtagaatctgggaatatggccattctaactaaggagcccccatgttctggccctcctgactttgggtagcataactgaagtttgtgctccaacccctttgggtaaggaatgcctgacactttaatgggctgcttcaatttgaccctctatctacctaattggggtgccagataccttctgttaagcctcctgtttgtcacaacccttcatttgcggccgtctctgaaaaggcccgatttggccccccggttagcactctcccttgtgacaaaattccttctgggggagtctcgcagaaggtttcccacccccaggttgggcacccgctcataaagcgacaccaatagggggacacagttgtccgaata

SEQ ID NO: 724512 - DNA, 1344 bp, Homo sapiens
ccaatacagagtccagtggatgaccgcaggatggtgggggcagcgggcttctccaggctaccaccagacgaccaaggcccgtgacgcacgtgccatcctgcaccttcgagcgagcatcccgtgtgcacagcttggaaggggtgcatggcaccgcatcaccattggttcagcatgggtggaaacgctggatgactacgcaggcatccttcaccgtgcctgatgccccatgccagcggagcatggcattgtgtgacacttggcatggtgtatttgcaggatcaccactgatgtgcattggccctccatgcccaaagccacatgttgtgacgacttgtgagacatgggcaaattgacgatctgtgtccggtgtgtgcaccgatggcacatgcacccaatacgggggcacccgacccaggaccttaacacgtgcacaggtccttgtggcatttgcagcgacgcagtgactcaaagtgctaaagcaaagccttgcacgtggctctgagtgccagaggaccccatcattctgatgttacacgatcaccagtatcatagtacacgagacccgtatcctgtcttaactacaagtgcttgacacgcttcttgcttgggacagccatagaaccacaacacccatgacagacacggggacgtggacggggccatatcgttgccccaaacatccaggcaccagcatgcagataactggcgcgctggtcgttgcacaacgcgcacatggtacagcaggatcctgtgacagccagggatgcgcaccatcggtcgcagaacaggccccccgcaggaccgcgggacaacatcggcaagcggccggatgcgacaggcgccgatcaacggcacaaacaccatgctgcaaaccatggacttgcgaacacagagcacgcctttggcgaagcaacgggtaaaatacccggcagccatcaatcagcacacgctacactggatcatcgccaccgaggcgcaaccagacgagtctcaccgattaacaaccattaacacatagccatgagcaaaggggcacagaagccagcacccacgtaagcacaacgcagccatcacacaatgcgacaagcgagcacccacagcccacacgcacaaccaacgggggcacgcgaggcatccagcaaaccgggacacagacgaaccccagacagacgaagacacgtacaaacccaagcaagaccaacgtacgacaaccgcacacacaccccggctgtagacacaaagcgtcggttgcaacgcacaaagaacacaacccagagtctgtacccacacaacacgcgctagtacacaccaccaagagtacacacacaacgcgcacaccagcgg

SEQ ID NO: 724513 - DNA, 414 bp, Homo sapiens
  misc_feature (13)..(13): n is a, c, g, or t
  misc_feature (43)..(43): n is a, c, g, or t
  misc_feature (377)..(377): n is a, c, g, or t
  misc_feature (396)..(396): n is a, c, g, or t
gccttgaaaaaangaagtgtctgaggcacttaagtcagtatgncaacaataatgattattaaaactgaggccacctgtttcttatagccctcttgagcatattttgggaataggagaaataaaagttaagagcatacaattaagacaggcatggagaaccagaaggcctccatggtagctttgaaggagtcccttatctcttggaatcacagagcaggtaagggtgaggagcctctggtagacacattcttctaccacctacctggtaacaggttgactatattcagtctcttgtcatggagggtacaatgctttgtcctcacgggatattatttatgggatatgggatttgccttccctggaacttcagggcttcnggatgggcacactgttagnatttttatggggtgggac

SEQ ID NO: 724514 - DNA, 749 bp, Homo sapiens
ttgtttttacaacccaagtctttcaaatacttagggattgagcaggtcgtctggcctttaagcctttggggcctttgttttgcaaaactcaaaaccccccagggcccggaagtacccgaagcctccaggatgggtgaaatccaacgctttttttccgtgggtcaagccaccggttcattttggaggctctgtggttgggccacctcaaggagccgggcaacccccccttttgtgatgggttcctttgtggtgggggtttcctcaaacccgaaattgtggggattaacaattgccaaccattaggcccctccctttttccttccctttcttgccaaacagggggttaacaaccccaaaggcccggaaatgcccctttcccggcaaaggtttttaaggggttatttggtcccttctgggggcttctcccaaatgggttttcccttaccggttttatttttcccccggaatggttggggcccggcccatcccctttcccccttctataaagggtgggaattaaagtcccccaagggggttttcccttggttaaaaaaagaaggggggggggggtttttttcttgggttccctggccccaattaggggaaaaaaaaaaccctcctttcccttttttccccggtggggccaaattccccccaaagggggggggggttcccctttccctgggggccgggccctttttttggggttttttacccccccttttgggggattaacctgggccttggga

SEQ ID NO: 724515 - DNA, 600 bp, Homo sapiens
ttcgacggtgtctgttacatgctacaacgcagatgaatcttgaaaacatgccaagtggcttaagatcacatactgtatcattccatttatataaaatgtcctggccaggcgcgatggctcatgcctgtaatcccagcactttgagaggctgaggtggagggattgcttgagcctgggagattgagctgcagtgagctgtgatggtgctactgcattccagcctgggtgacagagcgagactccgtctcaaaaaaacaaaacaaaacaaaaaagtcttgtgggtgggggttggggggcagtggacagttcactgcttgtattctgggtacttacttgtgaatgtctgactcctgagcatcacagtcagctggtgatgtgggccaagttacagactgtctcttcaaggaacagttaccttcttacctttacggtgtaggcgttgtaaaatcaatttcatgtgaagaagagatacggaagagtgatagcttccaaagctctgcagtccttattgtgtatgtgtgcctgtatttacggtgtctctatctaaaaagtgctgatagtaatgaaagtcatctattaataaaagtaatgataaggtta

SEQ ID NO: 724516 - DNA, 203 bp, Homo sapiens
ttggcgcgcaacgccggtcacagcgcagagtagaagtctcgtgtccattcttgaccggtcactcctgcctacgctacatagtacgggatctctctaaaatgaccgggtgtcgcatctcctcctgcgatcttacgatatttcactccgtttctcctgctcaatggtctcttgggtcggcagggtgttcttctccgcgatcgaag

SEQ ID NO: 724517 - DNA, 348 bp, Homo sapiens
cgaaggcactgcggctccctggggacactcgtggcctctccaggttactacagatgggggacagcgggtcctttggattgatcgcagagttgaacaacagagaatgtgtgcacagtgccaggcacaggtgtggtcaagattcacctgggagaggaagtgggcaggggcagaggagtgtgcccacctgagctgaaaggctgcatggcaggtgaccattatcaccagtgtcgccagccaggtcacctctctgaattttgtggttgcaacctccatgattccctagagctgtttttacccagaactaatgaaaaattctgcacattaaattcatgctattagaaaaaaaaa

SEQ ID NO: 724518 - DNA, 123 bp, Homo sapiens
catttgggggaaatgacggagctgacaccccttctgtcagatgaggagctggagaaagattttgacgtagagtttatgtgtaaggagacttatgatatggtgtgtaaggagaaccgtcgacgc

SEQ ID NO: 724519 - DNA, 423 bp, Homo sapiens
agctaaaagattgtacttttctgcgttcagctgaacggtggagggctcagtgaggtgcctcacacctgtaattccaatgctttgggaggccgaggagggaggatcacttgagtctctcaagttgatggaacacaggtgccagccacgacacctgactaaatttggtttgatacggtttgttttgatgtagagatggactcttgctatgttgcctatactgcgcttgaactgctgacctcaggcagtcttcctcccttggccacccaaagagatgggattacaagcatgtgccactgtgcacagctgagatttttcgacttagtctttttgtacacccagtatcttatagaatatccataagatagattcataaataaaccattttcttcaatgggataaataaataaaccactgctataaatg

SEQ ID NO: 724520 - DNA, 702 bp, Homo sapiens
ctgtgctgtggtgtggagaacccctgaggttctgtgagaggtggccttcatgcgcgggactgaaccccatgcagactggtgggcagtatgcaccaagggcagagcagtgacttccctgtccgggagattctgtgccttggggagtggctataggaagcagggaaacagactgcagtatacaactctgagaactggaaagggacaggtttggcattcggctaaagggaaaacacacacacacacacacacacacaggcaaagagatgaatttggaagcagagagagttcaaaacttaaaaggaaagttgagtttagaaggaacttgccaagcttaagtgtggaagtctcgctgtggagatgtatggaaaagccaggcatgaaggaacatggctatggccagctagtgcaggctgcatggagggggtagacacaggtggaggatctcaaacgtagtctagcaccaggtcttacactgaagcaccaggtagtttataccaccaagccaggccttggactattctagaccacactgtctgccaccttcctgaagaactgtggtgacataatcatctttagtcaccttgcaggtaggcaagctctgcaccacatggtacagggccagagggagaacagtgaaggtttggcatagtttcacatgtgtggtcatcactgacatcagaacaagggtcttcctgggtcagt

SEQ ID NO: 724521 - DNA, 152 bp, Homo sapiens
cggcacaggttgctacgatttctgcaaacgggacaaagaaattggcaatatcatctcttattgcaattgataaaaagtttggatagagttgggttgtcattcacagtagagggattggattattacacctgaattgattgaatttaggtgaa

SEQ ID NO: 724522 - DNA, 159 bp, Homo sapiens
tgatcaacttgagctcggtaccctcgataggccacggatgtagtatttttcagtgcaatattagttggcggtttacgcagtatagtgagtgaaaggttgacgccattcatgacgttgaatgctccgtggaagcctggtgtgcaaggtgcttatcgagaa

SEQ ID NO: 724523 - DNA, 385 bp, Homo sapiens
cacgaggctgttgcagcagtttaaaggatccactcagccgccttaaccgccaaccagcaggctaagggaggaacagaatgaacaatgtttggatcccaatgactggagatgaaagttgcaaaagctctgcccaggcttctaccaaggattaactttccagggcatctgctgaactgctcttcggggctgtctgctgagattggcggtgggaccctcccgcctctcactcgtgcctttgttccccacgccggcctaaccccgcgcccctgcgctcgcggtcagggcacctgacccacgcgccgcccgccggggatgcgggagccgccactgctaccgctgccaccgctgccgggcctgctccgccaagcacatgcgcaatggcgac

SEQ ID NO: 724524 - DNA, 350 bp, Homo sapiens
ggctgtacttccagcatacctcgtgatacagtcgccacagatagtcttactatctctagtcgtaggtcggttgtacactgtcactcacctttagtcggtccagagcgcctgcacctagcttggttttgtaggtgcagcatacctcgcacggtccgactgaatatgcgtctgagggcagcaatgtggtatggtcttcgataatgcttggtgttcatcggcttcataaggaaagccgggtacttcaacttgtttctgtagatattaccagacatgttgacacgttcacagcgtgcgttctccaccttccggcccatcagtccctgtttagccacgatggtcgtcagtcggcc

SEQ ID NO: 724525 - DNA, 464 bp, Homo sapiens
  misc_feature (230)..(230): n is a, c, g, or t
  misc_feature (460)..(460): n is a, c, g, or t
aattttacatctgcaagcatattttagaaattcaccaatattgatgactaattatttggccaaaaaattgacagtgattgttgcaattatatttctaaagacccatgcaatacaatggtgatttaaaatatgttggtcatatgagtttttaaaactgaattgtttgttatagaagtaatataaatatttaaaaaatatatatctttgaaaaatatagtgttttttttttntaaactgtattccaaagccgattcctgagactgtgctttatatgcacctacggctcctaaaaaacatcagccacagcttcaagcctaagctcacccgagacccaagtcaggacacctctggtgtggagcctggggatctgtttttaaagaactccacagtgcacagtcagcattcagaaccaccattctaaagttttatatgtttcacatggataggcagatagttgaanttgt

SEQ ID NO: 724526 - DNA, 281 bp, Homo sapiens
ctgcaactgagctgtgatcattgtacactgcactcccgcctgggtggcagagtggagacccctgtctcaaaaacaaaagtttgttagtgtattagtctattttcatactgacttataaatacaatatctagagactgtgataatttatcagaaaacagagaagtttaatggcactcacagttcccacatggcgtggggaaggccattgcaaatccatggccagcaaggcgcaaggcaggagcaacaggcaactatctataaccacgggtggccaggccaag

SEQ ID NO: 724527 - DNA, 1569 bp, Homo sapiens
  misc_feature (1263)..(1263): n is a, c, g, or t
ggaggaaacaggcatgttgacagacggacccgcgctgcgttggcctgggagtgacttcacaggctccactgtcagcaagcacacctggtgcctctgtctccagccgccgaggcctgtgacaccatgaggatcataatctatctacctgcctggtggagccagaagatggcagtgaagctgtacctgtgccaacgtgccacctcttccaagcacaagctgcttataacatggagagcgtactgctgtgtcatgtgcagctgagaggatatgggtgcctcgaccgaggcacaggctacaccgtgcactcaactagaaaacatgcatggtcccataagccgctgcacactggacatcgatccacgcttgacacagcatggaagacatattggcatgcagactaataagcgcagaccacgtggctgacacgactgacccacagccactatgacgcaacaactatccactgttctgatactacaagcacactctgcgctgagcaaacacgcgtacataggccacttgcaacgtctactctgcagattggcacaacaccataaccaggaaatgacaagaagacacaatcaaggcactaactcgctccagtcgacaccatacgcccaacgaacgacagctcaccaccacgaaccgcccaacagcacaccgcacggaacacgcccagaaacctatcgacaaaccagcagcgaaggacaccacgacatgcgaaccatacggcaccacaacgacgcgcccccctacaaatacacaccgacgcaaacgcacacatgaacccagcaccacatcacaacaaggaacccgaaccacacgggcacgcgccgacaccatgtcaaaccgcacccaacccactcacctccagaacacgccggcaaacatgcgcacaatgcagcaacatacagaagaaaaaccagatcgacacacacagggagggccaaccaagtcggctgaccacaatgaccactagcgggaaaccaaaaacaaacgacagaacacacacaaacaaccaaagaaaagaccaacaaaacaagacgcacaagacacaaggagacaagaaaatacaagcaccacgacaaacacgggaaatacaccaacacaagtgcgaactggcacggacaacagcaacatcacaacagagaacagaggacacacacaaaaagaaacagacaaacgaacacaacgggaaaaacaacgatggagggaagcaaccaagcaaaacaagaggaagagcgacagggagaaagcacacanatcacaatcgacacagcacacaggcagcacacaatcaccgagacacaactaggaggcgacaccaacaaagacacccagaaaaagaacacaacacaccagaagtcaaaataagaacaagccacaagcagaccacgactaacgccacaccacgcacaccgaacaaaccaacgagagcgaacgcgaacgggaaacacgaaaccaccacaccagaccacaaccacaccccaagacacacagagaactcacagagcataagcgatatcaagaaccaaagaggaaacgaaccagacagacacaacagcgcaa

SEQ ID NO: 724528 - DNA, 141 bp, Homo sapiens
tatcatggtgactctgtcttagagaaactgaagagttcgtcagcagtttttacaagaattcgggacctccgcgttgcttcttttcttccaatatttggacacttagagtggtttttgttttttcttttcagatgttaatgt

SEQ ID NO: 724529 - DNA, 381 bp, Homo sapiens
ggcgggcggtggtcactgccgtgtaatcccagctctcagggaggccaacgaggggaagaatagcttgagcccaggagttcgagacctgcctgggaaatatagcgagaccccgtgttctccaaaaaaaaaaacaatcaaacacaacaaaaaaaacattgtgtggcgaccgacattcagcatctaggaacatgttttaaacacaacaatttctgttggtccacgcgcggcccaaagatgttatcaattgaacatatttggcaatgatagtcttggccccaaaagaagaacttcctgtcgcctatagcacacaggtcgtagggatccaacacaaataaaaaacacccgccgttggaacgccgtagttttcttcgaacacactcc

SEQ ID NO: 724530 - DNA, 355 bp, Homo sapiens
  misc_feature (13)..(13): n is a, c, g, or t
  misc_feature (56)..(56): n is a, c, g, or t
  misc_feature (350)..(350): n is a, c, g, or t
gtaatccccagcncccatgagaggccaaggtgggaggagcacttgttcgagaccancctgggcaacatagcgagaccccgtctccacaaaaaataaaattagctgggcttgatggcgcccatctgtagtccaaggtactcagaaggctgaggtaggaggatcccttgagcacaggagtctgaagttacaatgagctataatcatgccaccgtactctagcccaggcaacagggtgagaccctgcctctaaaagaaaaataaaataataataaaaagaaaattttagggccaggtgcggtggctcacccctgtaatcccagcctgggcaacgtggcaaaaccccgtcactncccaa

SEQ ID NO: 724531 - DNA, 239 bp, Homo sapiens
ccccccccccccccccgggggggggattttagggggggggggggtaggggccccccccccaccccctccctctttttggggggggggggggggggggggggcccccccccccccttttttttttgtgggcccccggggccccttttttttttttttttggggggggccgggggtttttttttccccctttggtcccccccttaataaggttttttttggccggggggggggggggggga

SEQ ID NO: 724532 - DNA, 304 bp, Homo sapiens
gcacagacgccagagcgaggagggcgctacgcgacttggcaagatgacccatgtcctgccgtccaaccttctgaccctctttgccccccgcgaccctattccatacctgccacccttggagaaactgccacatgaaaaacaccacactcaaccttattgcggcattgcgccgtacatctcgagagattgaggaccctcgagatgcccgtactccaacttgcgctgaaacccgagaggagcgcatgctgagcacaagacgctaaaagattgagcggcgacagcaagatgtggagacagagcttaa

SEQ ID NO: 724533 - DNA, 724 bp, Homo sapiens
tacgtcgctgtctttccactcgttgtacgccttgtagctttcggccttcttgtccttgtgggcgtacagcaggtcctggcgggtctccagcttgacgtggccgtcggtggtgccggaggcgaggttgtctgtgagctcgtcgcgatcgtcgagcaggccgcgaccgaaggaccacccggattcggttgcgcggtcctcgccggacgtcaggaacgatactgagaggttgtcgtgctcgatggtgtcgagcagggacgcgttgcgctcggcgtttcgcaccccgatgccgcgcagctcttcgcgtccgaacgcggtgaggttgccgtagccgccctcaccgggaccagtgagggcacggtttgcttgggtcatcgcttcgacctgggggatgaggcgctcgccgagctcagtgagttgaccgcgctttttcgcctcggcgagcatttgagccgccaggtcgtcgtacttgaagctggacaggccgcgcgaaccgtggcggttgacgctaccggtgtagatctgctggaagccggcgggtgccgcgctgtagctgtcgatcgtggcggcgggggagtacggctgcttcgttgagtagtaggtggtatctgccgcggcgccagtggcgcggctgcggcagcaagcgctgcggcacttaccgcagcgatgcggcgacgggatttaacggacacgggaagactcctaaaaacacaggtgagaaggggta

SEQ ID NO: 724534 - DNA, 387 bp, Homo sapiens
ccagagccataagagaaggcacactcctggagcagccagtcttgggcagagtggtgggacagaagcgagtgccggctaccgtacagggctgaggtgtacatgttcccattgtagagtggagaggtaacgggaagccttggtttgcttgtcgaacatgtcctgagaggcctataaaagtgctcaatccaggtccttgtaggtgtaggtgtcttccagctatcgccccccgaaagcctccagccccttatataagctggtttgtgtgtcactgatggctgacaggacgtcattgaacatcaggcgcaccagcacattctggaccatctagcaaaaagggtgtctgaacgctcatgtactgtccatcgtcacgggtgacgagtgccaggt

SEQ ID NO: 724535 - DNA, 150 bp, Homo sapiens
ctataccatttcgtattactctttgtaagattacacatgccagctactccccgataccagttgagtacaggcctctaacatcaccacgatcaaaagggacaagcatcaagcacgcagcgagtgcagctcaagggggatcctctcagagtc

SEQ ID NO: 724536 - DNA, 119 bp, Homo sapiens
ttttttgtttcctaagtaaattaaccctaattttccccctttcattttgtttcagcctcctgtataaaaaggcccgtattttttgcccctcatactttgtaataaaacttgaacatgta

SEQ ID NO: 724537 - DNA, 203 bp, Homo sapiens
  misc_feature (36)..(36): n is a, c, g, or t
aaaatgaagagagaagcatagaatagctgttctgtntctagcttgggtgtcctggtgctactaattaataatggggatatcagaggaaaagcagcttggtgacagaagacgatagttcagttcgtaagattttaccttgaggatgtttagcaatcagttggtttcactggcttaaaattcaaagaattaagttagtgctaaaa

SEQ ID NO: 724538 - DNA, 223 bp, Homo sapiens
gccggacgctgtacactatacattctgattaccatgcatgcgccagtctctctcacagaacagaccgtgacccaggagcagtgtccgtagtggagaatcagctactaacagagatggatggtctgtaaacacgccagcggtttaaccttatagggagccactaacaggccagatataattgaccctgcaatcctgcgcccgggccgcctggacgaaacactgt

SEQ ID NO: 724539 - DNA, 449 bp, Homo sapiens
tacggccccagcccgtgaaagccggtgatgcaatcgccacattatgtaagagtgtaggtatctcaagaaattacaaggcataagtgcactgcttgggggtcatatgcacagaacaaaagacaatggaccagatgtgactttgaaaggcctactgagtacaaagcatacacctgaaaaaccttagcgcttaaaggctaaacctgaagcttaggtgtgtgaaaggtaaccaaagaaatcgagtaaagtaaagggagtaaaacataataacagtaggaaaaacatgaaactggaaacgaacagaatacagtgtaataaattggagaaaaaagaaatgatctacatatacaaaaaaaataagtgcacacagaaaaaatgcagcttataagtaggataagtaaagtagataaaagaagatagatgcatagaaattaaaatagtaaatattaaaa

SEQ ID NO: 724540 - DNA, 334 bp, Homo sapiens
ggccaccccaggcaacaagggagatgggcccaaccaaaatctgccagttctgctaatcagtcccatcaggtccacactcttgcacgagggacagctctgcgaaaccagcatctggtggagttgactgagtgggtgaaactgagatcaagctgctgagagagaaatgcaacacagtgcacatgtaggtgcaccgcttatcctgaaggtggaggacggcaacaacttcagggtgtctatccaggaagacactgtggaccagctgtggaccgtggatagcacagcggcctcctctctaatgcggctctccaactactacaacacccagggcccaatt

SEQ ID NO: 724541 - DNA, 501 bp, Homo sapiens
  misc_feature (109)..(109): n is a, c, g, or t
aactgagaaagccagaggccaagagaaaaaccctcgccttccaaagaaacgattgaaccggagaagcaagcaggcgaattgtaatgaggcgtgcgccgccaatatgccntgtacattccccaagcatggcctttttattttactttttttagcggtttaactttgtaaaaggcaaagagggtggatcaagtttaaatgactgggcggcccctttcccatcaaaaaactactgacaacgaaggccgggcccccctttcccatttgtttatctatttggcgggcagggaaggaaaaaacttgcatgttggtaaaggaaaaagtggggtggaaaaagtggggggggcccccagtgaaatttagagtaaaccccagcgggcccaaggggtcccgcaggctgtaaacccgtttaatcagaggccccttttttttttttgttcaaaagattttaattattggaaggcccaatttttttaaaaggcaaataaaaagtttaaaacctta

SEQ ID NO: 724542 - DNA, 197 bp, Homo sapiens
cgaaacaccagtagcatgaggaacaggtgtcacggtggacacggggcgtgcgcgctgtctctccacctccatcacacttatgctaacagggacgcagacaccttcaggttcctttgctcaatgagatgccagaggctcttgaattcacaaaggggaggccgtgatgatcctcctgcatctcgtctcttctctcgtac

SEQ ID NO: 724543 - DNA, 410 bp, Homo sapiens
ggctccgtaacgaggacttacataattacctttttatgtatgtatgtacgtacttgtttatttatttatttttgagacagggtctctctctcccaggctggagggcaatggcgcaatcttcgctcactgcagccttgacctcccaggctcaagtaatcctccctcctcaaggcgtgtgccaccacgttcagctaattttttaaatttttagcacagacagcgtctcgccatattgctcaggctggtctccacctcctgggctcaagcgatcctcctgtctcgacctcccaaagtgctgggattacaggtgtgagccaccgtgtaatcccagcactttgggaggccgaggcgggtggaccacctgaggtcaggagttcaagaccagcctggccgacatggcgaaaccctgt

SEQ ID NO: 724544 - DNA, 872 bp, Homo sapiens
gcagtggcgtgggtgggaagcgcagactcgcaaaagcgatgccgatactggtttcctggggctgcggcccacattcgggtgtgaccccaggctgctcgtagagcgcgctgtgcgggctgcaggctcccaagacaaatcaagacaagctggggacttggctgagcaggaattgcgtccaggcagccgcgtggtgtgctggtaggttggaccagattcctggcaagcatgtgcgagttaacaggagccgctacgagcggtggcttgttgtcagaggccccaaatgcaaaaagctcttcttcggtggacactggcctccaaggaacaagggctgacaaagaagagaaccacaagtccagaagaagtcactgacttctcaagaaaccccgttcgggttgacgcatcatccatcgagaacacatccaaagtccctgaccccaaagacgtcctcgcaccacacaggtacaccaacgccaagaagctcaggcggaaggagcagcatatgggagaagctggccaagcagggcgagctgacccgggaggtgcgcagggaaccaggcccggaatcctcaacccatatcgtgacaacaaagggccaagacccgggacccaggaacaacgtagagcggaccttctacgaccatcatgggactcagacaaccccctggacaggccagtaggttggccaggatgagataaacctggagcagaccaagaagaaggagtgaagcggcagcaagcactgcaaacaagacagcccaggcgccgcagtggaggatggagctagcggagctacctacaatccatccgatgaagaccagcagacctgtactcagcggccacgaggtggagagcagcggagaaagagggggacg

SEQ ID NO: 724545 - DNA, 253 bp, Homo sapiens
tcaagcgcctggcgcactgtcctaactgctggttttccactctggttttagctcccggcgtttgcaaaatgaaaattgaggatgtgaagagcactacgaagacgcagcgcatcgcctgccacagccacgtgaaagggctggggctggacaacagcagcttggccaagcaggcggcctcagggctggtgggccatgagaacgcgcgagaggtgtggtcattgtaccagggagttgggggctgcaagcatggctg

SEQ ID NO: 724546 - DNA, 166 bp, Homo sapiens
ttttaacctaattggtatttccagggtttcacaaaggccagattttatttcagttactcagagcgaagaaaatgtctctgaagaggtgactcatcattacccatagaaaggtatccactgtatccatctcttataggaacagaaatatatcacatttccccccccc

SEQ ID NO: 724547 - DNA, 798 bp, Homo sapiens
ctagcatttcttgatggttgactcaactgtataattaacaaatatacatagcacgagtcaattgaatcatagtgccagttatgtcacttattggtcagtgtgctaaaggtattcagtcatgtcgtctagattgactgttaccatgtgtgcaaaaattgtccacgcatagataatgctattgtacaaaggatctgttaatcttccttgtaattgcctgcctattagtccatattctgattccttatgttcatcactgatatgttcctgatcagggtcagttgctagtagttgagcatttactgggtgaccatggtttaggggttagatgttatgtgttgtctgcgatgttaacgacaaattgtgtacatgtaattccactattggtattaccatattcagtaatcacatgatcaacggaagtgtacccaataatttcctataaaattttgcaaaagtcctttatacccctgaccacactcagggtgaatttttgtctcctcgggcatgtcgaacaatacaggagagaggacatggtgagatatcagacaaagcaccaaagtagcgtagtgcagtattttcctcttttctatacttcgagccattatatgaagagcaagtttggtcattacaaatccttgtggctattacctgagatccgataatttatcccccgctcataacatgggcgattgccatactcacctgcagcacacatccaacttgctaatgtgctgcgacggaaatgccttttcgccatgcctgcagagacccacaactcgctcgcaccacctcccaaaa

SEQ ID NO: 724548 - DNA, 100 bp, Homo sapiens
agggagcggggctttaatctgttggtctcctggactgaagagagggagaatagaagcccaagactaagatctcaaaatggtttattacccagactctttg

SEQ ID NO: 724549 - DNA, 261 bp, Homo sapiens
gcagacccagacttcgctcgtactcgtgcgctcgcttcgctttcctccgaaccatgtctgacaaaccgtatggctgagtcgagaattcgataagtcggaactgaaggaggcaagaccgcaagagaaaatccactgccttccaagacgattgacagagagcaagcagcgatcgtatgagcgtcccgccatatgactgtcatccacagcatgcctctatttactcttagctgttacttgtagtgcaagagtgatcagttaatg

SEQ ID NO: 724550 - DNA, 476 bp, Homo sapiens
tcctcctgcggtggaagtctagaccacactcgtttctttagtgccaaagttacgagcggctactctcacttacctactttactaaaatggcatacagattggcattgaccgtgttgaagaaattttaccactaagaaatcttttgcctcatctacaaagccatagttaagacttgaggcattcaacttaatgccaagtataagcatttcccccgtttttctttcaattttattcttcattctgactacagtaacttggccctgaactacgagattagccaagccaacagtcttctaattggttttcagaaacttcaggccgggtgccgtggctcacgcctgtaatcccagcactttgggaggccaaggcaggtgaatcacttggggtcgggagttcgagaccatcctggccaacatggtgaaaacctgtctatactaaaaatacaaaaattggccgggcatggtggtgcatgcctg

SEQ ID NO: 724551 - DNA, 326 bp, Homo sapiens
  misc_feature (293)..(293): n is a, c, g, or t
  misc_feature (307)..(307): n is a, c, g, or t
ttgaattcaccttttcccaaaagaaagcaactgttggccaggcacagtggctcatgcctgtagtcctagcactttgggaggctgaggtgggcggatcatgaggtcaggagatcgagaccaacctggccaacatggtgaaaccccgtctctgctaaagatacaaaaattagctgggcctgggtggcacatgcctgtaattccagctacttggggaggcttgaggcagaagaattcgctttgaaccgggggagtcggaggtttgcagttgagcccgagattcatgctgctgttanttccagcctgggcnaacagagccgagatttccg

SEQ ID NO: 724552 - DNA, 157 bp, Homo sapiens
tttctctgctcgctctaattagtgaaaaacaaaccagtattgtatatctcctcagccattcatttttatcattcaggttgtcctcagttgcagcagcaaatattcctttcatttcattcaaactgagtctatacactgtattgctaattattaggca

SEQ ID NO: 724553 - DNA, 342 bp, Homo sapiens
agactgcggagtcagacggcgctatgtacgccctcttcctgcaatattatatctctggaatctacctgccctatggttttctagatacacgggcttggtaattgttacccaggctgctatcacggccagtagctttaagagatcctctcaccacagatttccaaagtgctgggattgcaggtgtgattcatggcacccagcacttgtgctgccttatctgtacatgatccaggcccagaacccaaactccggcactgtatagatgaccactttcgtaaactactgacctagcttgtcgccaatggttgattgaacttcccataactccacttcgtgtctgta

SEQ ID NO: 724554 - DNA, 1050 bp, Homo sapiens
  misc_feature (307)..(307): n is a, c, g, or t
gccacggctgccagaccggaagcgctccgctggaccggatcctgctccgctgagttgaaacccgggcgcagcgaagatgccggctaccactcttctctcgtggatccgtgataccaaactcatcggagtacatggcactgtggcctatcagatagtcacatgtcaaaggacctgtccccaggagtagacaagaatgatacagatattgctggatgaagccatcgtacttgacttcaaggggcgaatggatcgttccttcaaagcagctatgaacactgatatgacatgaatgctgcttaggaccgangcactactactagtaagctcgtcgtaactagtcttcgtgatatgttcgtggacaggaagactgactagaaatagctgtcggagtttcccataagaggccgaaaggctggatgaagaagcacatactggtacgtactgcctggtggacactcagcatagagttcgtgtacgccagtatccgctgggatgacgcccgtgggcctgtgatctcgacgtgtgagactggcaagctgtctacgtgcctgacaaacgcgttggcctaacacgcagaagaccagcgcaccgactgcaacgctgcatggaacgaggccctttattattaagcatagcctacgtcttaaaggggcccacggaagcaccctggggcaccctggaggcaacctaccatggtggcacccacaatgcgttctttcgcgaagccccccgttccaacgaacactttggcacttactacatgccgccaagcgccgagaggtcctgcgatgggccacccgttggccgctgttggggtaggcacagagggatgggacacgtacggggtgtccaggcggtaacagcgcacaggggaacgcgatcccttctcatcacacgcgtaaaacgcgccatggcgaggcaagggggtggaaacaggggggaaagcccccccggggtggcccacgacaccgaagccccggagccattccccacgaaggcccccatggtgcggccaacgccacctaaaattacccagggccaacggaactt

SEQ ID NO: 724555 - DNA, 493 bp, Homo sapiens
gggggagtctgtcagagaggagaccctcaggagggctaggagaggaaggagcaaatacagaggatagaaggtcccgtggcctggtgtgccctcacacagggtatgggtggtccaggactgccactcccgctgccacaccaccatctgcatgctcgatggcttgggttcgaagtagatgccccacgtgcttgttcatcacgagtgtcttttcctgcctgacatagaccccaaagatgcccagctctgaaatgcactggaccactcgggcagggctgccaggccgtagcaggcaattctcaaaaggctcaggttcgatcttctccatgaggatgtaggaggccctctcctcacggtccttcagctgtttcagggcctgtaccatttcctccccatataggttgttacctccagcctctctctggggctttagcacaaaccggctaggggcagcaagggcctcggcgatggcctggtccccttcttcagccacatc

SEQ ID NO: 724556 - DNA, 155 bp, Homo sapiens
  misc_feature (38)..(38): n is a, c, g, or t
  misc_feature (48)..(48): n is a, c, g, or t
  misc_feature (73)..(73): n is a, c, g, or t
ctagctataactctccttcctgcaagtatatcactagnacctgcttgnagaaagtcgacacaaaaatgctatncaacgggctgcgagcataatcaatactaacttggcgcaagtagagaaagaccaagcacgcctcatcatgccctcggcatatc

SEQ ID NO: 724557 - DNA, 122 bp, Homo sapiens
gcccggagggcagctgttgaacatagaggagaataacagagagctcgctggccaaactcattcaatgagtgaagtatctccgtgagtctcagacataccgaaaggcgggtccgcgggattgg

SEQ ID NO: 724558 - DNA, 884 bp, Homo sapiens
ggggcaaagctgcccaaggctgtgggagcccaccttgcataagtgtcccctggatgtgagacatagagtcaaaggagatcatttggaactttaaggtttaatgactgcccttttgatttggatttgcacaggggctgtagcccctttgtttgggccaattttcttgactgtgtgtatttatgcaatgccctgtaccccaatgtgtgtatttacccaatgcctgtaccaaaaccaagtaactaacttgcatttgattttacaggctctagatggaagggatttgccttgtctcagatgagactttgactgaccttttgagttaagtgctggaatgagtaagggcttgaagggactgtggaaagatatgacggtgtctttgaaatgtgaggacatgagatcttggagggaccaggaatggaataattatggttggatgtgtactcaccccaaatctcatctgggaataatagttccataatctctgtatgtcaatttcccccatatattctcgtgatagtgagtaagttctcatgagatcctggatggttataaggggctccccttcactcggttctcataccttcccttgttgtgcagggtgacgaaggaccatgttactttcccttctggcataattgtaagttcctggaggctccagacatgcggaggggagtcattaaccttttcctctttccttataataaccagtccaggatggtttatagagactagagttagtatacgaccttgaaccgtgtgcttcatctcacaaataagaggaaagtgtccaagacatgggttcagtgcacaaggtaaaaacacgaggggttacatggtcaaaagttgcacacacagggtcaacgagggggaagtcggaaacaact

SEQ ID NO: 724559 - DNA, 948 bp, Homo sapiens
  misc_feature (51)..(51): n is a, c, g, or t
  misc_feature (66)..(67): n is a, c, g, or t
  misc_feature (69)..(69): n is a, c, g, or t
  misc_feature (78)..(78): n is a, c, g, or t
  misc_feature (95)..(95): n is a, c, g, or t
  misc_feature (97)..(97): n is a, c, g, or t
  misc_feature (99)..(99): n is a, c, g, or t
  misc_feature (106)..(106): n is a, c, g, or t
  misc_feature (119)..(119): n is a, c, g, or t
  misc_feature (144)..(144): n is a, c, g, or t
  misc_feature (148)..(148): n is a, c, g, or t
  misc_feature (159)..(159): n is a, c, g, or t
  misc_feature (161)..(162): n is a, c, g, or t
  misc_feature (164)..(164): n is a, c, g, or t
  misc_feature (173)..(174): n is a, c, g, or t
  misc_feature (182)..(182): n is a, c, g, or t
  misc_feature (185)..(185): n is a, c, g, or t
  misc_feature (196)..(196): n is a, c, g, or t
  misc_feature (203)..(204): n is a, c, g, or t
  misc_feature (212)..(212): n is a, c, g, or t
  misc_feature (215)..(215): n is a, c, g, or t
  misc_feature (266)..(267): n is a, c, g, or t
  misc_feature (294)..(294): n is a, c, g, or t
  misc_feature (297)..(297): n is a, c, g, or t
  misc_feature (342)..(342): n is a, c, g, or t
  misc_feature (349)..(349): n is a, c, g, or t
  misc_feature (380)..(380): n is a, c, g, or t
  misc_feature (385)..(385): n is a, c, g, or t
  misc_feature (398)..(398): n is a, c, g, or t
  misc_feature (405)..(405): n is a, c, g, or t
  misc_feature (926)..(926): n is a, c, g, or t
acatgtttcccaaatggggacctcaaaatctatactctccagctttaagantgcgcggggcatttnntntatatttantctcccatggatagganantnataatgntttcacataaaantacagtatgaactgatggacaaganctcngggccaggcgncnngnggcccaggnnctcacccnggnccagcgactcnttttttnntgcaaccntgngcgtcactgcctcctgggccaaagtgagcacaaaggtcctctctgtggtgnnatgcccttgcatttgtgttctaagggnggngggcagacaccattgcctttggtctacaactgaggaaacaatatngggagtnaggtcacagcttcaaggtgacatggccaggnaagtngcagagccagttntgggtcntcacacactttcctcttcttgactgttctggcgcaggtgcttaagatttgggggaaggtgggtgggtatctggcctcttctttgggactcaaattgtgttatctctctgagaacccacaggctccctctttagggctgaggtgagaagttctgaaagtcaagcagacacatccaggcatttgggcaagaaacttcttccttccaaatcaaaggtgaaatgaaaacgattatgagcccacgggggatgaacagaggtgaatggtgggctagtctcgaggatggcctaattcagagtttcctaagtgtcagccattcatggaaccacccctgtgatttttgctacctctctggatctgtgcccacttttacgttatgtttttctttaaactgattcactatttttttttacagttagctttatcctagacagaacatctatcaaactacaggtcaatatgctaatcatatttttatattatacattaaatatataactaaatagaaaatattaatttgaatancatctaaaatcttcttgtgaac

SEQ ID NO: 724560 - DNA, 115 bp, Homo sapiens
cctgtcgatcgcgctcggtcccgcttagtctcggagtttcccagacaccacaacttgcgcctttgtgccccactctccatgatgaaccgcagcacaccatagcagggtggatcct

SEQ ID NO: 724561 - DNA, 1777 bp, Homo sapiens
  misc_feature (535)..(535): n is a, c, g, or t
tctgtcccgcagggtgtttggttgtgtcttcggcgaacacacacggtcttgttttggtttgcccgacgcagcgagtgtgtctggtgtggtcactccacgtgctttctttccggtccctctttgaaagagggttgctcgcggtcggcccatcttctgtgagtgctccacatggccgacgacgcggtctgcgtgatagttctgtttattgttgcacgccagctcgtggtgtggtttgtcccacgatccgaccggtgtggtagcccgcccgccgcacgtgtttccgtcgtgtgatattgtcgccccgccccgtcggggtgtggtggtgtgcgcgccccggatggttggttccgttctcggagggtttcccccgcggatgaacatttgttggttgtggagaccccccttgttgggaagtttacgaatttgtgtctttggggagcccctcgtcgctaggttaacgtctgcccaccgtgtgtcctcacagatttctagctcgcccccacaggtatgtgagaccttttgtggagggggcccnccacctcttttcattgtgcttcgttgtacaacgactgctctattaacattgtgggggacattttttgctgttcgtagtagaagagactctgtgtctacaagccttcaatattgggggtgatgacctcagtgttgtgtgctgtggccagcacactgttatacagaagattgtggtgttgtcgtcacaccagcggcggcctgaaaccactacgtcgaggtagggtgaaaacccaccaccgcaacatgttttgtgtggtgccccccccacagcggagatagcacacaacgttggtctcttgtcgccccaccatttggtgaagactttttgtcgtttccgcggtgacatctcgcggcgagaaaagtgcctatatttatacctcgacatcaaagccgtcgctggtttatgagatatccccgcggtggtgtctcacgcgacccacacacaaaagagagagagagagatatacaagagagagtgcccacacacactgtggtagagagagagacatataaatacagagagtctctgacaccacactgcggggagaggaatagaagagagaagagatacgctccccctcaccgagagttgcgagagagagagagagataaaaagagagatgccctgagataatatgtgtgagagagaaagagataaaaaggagaggagaaagagagatattctcaccacagcagagagatagacgccacaaccctgatccacacaaagagagagggagagaataaataaagcggagaaagagatagtcctgacccacacaagagagaaaataccacacaccaaaagtgtggtggggataaacagactcgtataagtgtaagagtgtatacacacagaggagcacacacgcgcactcgtctttgagagagagactttataggactcgcccatatgtggagaactctcacacacagtgtacccccgccggtgggcgtctacattggcgcaccacgagaccccctttgggttaaaaaggtaaattctttggcaccacattgtaagagatacacccagaaagagcacacatctctttcttagatcttacaccacatccggagacctgctctctggtccattccccttgttatgtaacctgggtcttaaagaacctggttagatggggtgttagagtgatattttcccggtataccccttttttggctgcaaccctactggtccaataagaaaaatttgtaaataaagttcttttgggtttcttat

SEQ ID NO: 724562 - DNA, 184 bp, Homo sapiens
tgccgcccaccttccgacacgcctactaccgcggactacaccggctgaccaacgacacgtgacacggaacacacctgacacacgtgaccccacggccaagaccccacaacttctggatcgacgacgcactatcctgactggacactgcacggatgagcaccctatgatgacgacgacctacctt

SEQ ID NO: 724563 - DNA, 339 bp, Homo sapiens
cagagggccaccaggaactagggattacacagaaagacggtccctagagccttcaggagcatgcctctgacagcctcctgattgcaggtttttagcctatgagaaagcagatgtctgcttttaggcccctgagttaacactcatctgttagcaaagtctgcagaatccagacaccgacactcatgtttttacttaaaacgcagccttccctttactcgctgaggctcactgcaccccaccttatcaagagaagcccagcgtgtctgatgatgaagccactgtgccgctcatcgtggaaggaacacggcatttccctgttagtcaaaatttagacattga

SEQ ID NO: 724564 - DNA, 284 bp, Homo sapiens
ccccaccccccatctccaccctgaggaccctggcccccagcaacagcagcatcctcacgcatctgctagggagtccagtgcacgcctgctcgagagctccagtgcagctttgccacaggattgcaaaaacaaacccaccatgaagaggtcgggattgtgtgcagttcactccctgcccacaactgcgggtgccgtcaagcactgtgctcatgagttccttgggtcggcttctccaccgtcagtgtagtggtgccttcgttggaaatacagctgggttcatcctt

SEQ ID NO: 724565 - DNA, 907 bp, Homo sapiens
gctctcatggaactcatggacaaagagaccaagctggtgaggttgccccatccatgcagcaaaagccctgctccgtgcaagcctcagccctatagtggcacacagagccccctaaacgtccgacggtggtgccggtgttgtgggggccagtggtcaggtgatagaggggatggggtgtggaggcaagcagagggacattgggaagggtccatggatcgcaggcccagttcaggggttggataccaggaggcctgtggcatgagcagcgatggactatgtagttgactttggaagcatgcaggacctgtcctggccaagggacaatgagaatggggccagcaggtgggaggcaaggcctgacctccctcacctccgatctggactttagttgagctataggctggtaccatacaggcaaatattcaggtgcttgatttgcaaaccaatacctccccagtggccctgctgagctgcagacagagggagacgactgggcagccaggaggctgcagtggcagcaaaagctggtcatgcgaacgcggcatggagaagaacacatcacacatttgagattccatcgtacaccacacatacaccacaaaggagagccatgagcttgagatcaccatttgaggcctaacatggaagcaccacggtagagatgcatggaattaccacagaaaaccattggagaccttaatgcaaagggataccaacggcccccgagggagactacagcgtgagagaataccacaaacaaggaaacatggtcatagggaaagccaaaaggccgtaaacacaagaaaagacgggaacacaaagacacacaagaagatagagacgacaacaggctgggagccaaacgcgaagataccctaaaaccaaaacaacaggaaacgcaggagct

SEQ ID NO: 724566 - DNA, 212 bp, Homo sapiens
gcgtgtgcgtgcgtacgttctctgattttctggtccgcctgcttcggggcactcccatgtgttcgatccatgcttgctcgcggtttgctcccatcaccgcgatggttgcttcataccccacacactcatctgcagccagccaccattgcagcgtgacataccattcatggacgacaacggataccggttgggcaccggagctagcgcgactg

SEQ ID NO: 724567 - DNA, 599 bp, Homo sapiens
tgtcgtcttatatatattatttgagttcttcgcagtacatgtgttggtcattaaagttatagggaaggaacaaaattatttggtcagaattaaaagatgcttaattatttagtctgtttgtggagggcaggtattcacgtggactgagatatcaatgtaggatacagaaaataactgttcattgtcttcctgacagtgtgcgtaaggcactatgctgttgaaagcttcaaagtgtccagatgagggaaggactaattaataattactcctgattcgtagatcagtgaggtaagagtgtttcaaatttatgatagtcttttgggtattcagaaacctttccttatactgcactggccaccagagcttaattttcccagcagttacagcaatgggagatagaacagtctcaatcttttgccaacaatcaggttcctagaaaccaggtaggtgtatcccataacaagggaggagcataccacagaccctcatttgattaattcatttgatctatctatgttattaagtacctactaggaatacggcattgtggaaatactatccacacgatcacccttgtctagatgcttatctactttcct

SEQ ID NO: 724568 - DNA, 754 bp, Homo sapiens
gagcggcgtggttccgggctccgggctctgggtggctggcggctgtgagcgtgcggcactgcgtgcgcattgccattcggtgcgccgtcggcggcttggcccatgtctggccagcgtggcatgacggcaagcggtgacctgatgcccagtctgcacttgtgaagcattgagctgcttgcgcctgccgctgggtctcgtcctacctccggtctcggccgccgttggcgcttggacgcgcgactgcctgcctagaatgcagaaccatacgcgctgaacgggacctggctggcgtgctgagcctgcgctgcgacagccagacgcagggcaatgcaagctgggcagctaggcgcacggcgacaaggcgcgtgtaggttcgcgccttgcagcgaagatcacttatacatgtgatcacgagcggttgtaccagttgcgcattccagtttcgtcaatcagaagctatagtccctggacatacagggccgaaacgtgactttacgttggaatttatcgtacagagattcccatatttccattgactttgaaacaaaaccacgaggatcaagggttctgaatcacaccgtgtaactactaccttgcagccagaggaagacgtgaccattgggacgtctggcacacccgtccctgcaagtctggtggaacgaacgcccaatggcaacagaccagatgtggtatgagggatgccttggattccagacaccctatcattctgtacctgcatgggaacgcaggtacc

SEQ ID NO: 724569 - DNA, 366 bp, Homo sapiens
tgatatctgtctgacccacgctgtctggaacgcccgcactgctggtgcgtgccgagtgagcacgcgctcgtggacaatgatggcctctacgaccccgagtgcgaccccgagggccgcttcaaggcgcgccagtgcaagcagacgtctgtgtgtgctttggtgctgtgaactcgtgtgtggcgttgtgcctgcatcggacgaagggcgaccttgagcctacgcttgcgatgcagctggtgcgcacccaaccatatcctcattgacctgctgccaaccgccccactcggccggctgccgttcaagccacttcgatgaccgtgggacgccggagcttgaggcggctcttccacgaagcgcgtatcgggc

SEQ ID NO: 724570 - DNA, 914 bp, Homo sapiens
  misc_feature (18)..(18): n is a, c, g, or t
  misc_feature (84)..(84): n is a, c, g, or t
  misc_feature (156)..(156): n is a, c, g, or t
  misc_feature (166)..(167): n is a, c, g, or t
  misc_feature (171)..(171): n is a, c, g, or t
  misc_feature (177)..(177): n is a, c, g, or t
  misc_feature (181)..(181): n is a, c, g, or t
  misc_feature (185)..(185): n is a, c, g, or t
  misc_feature (191)..(192): n is a, c, g, or t
  misc_feature (195)..(196): n is a, c, g, or t
  misc_feature (227)..(228): n is a, c, g, or t
  misc_feature (236)..(236): n is a, c, g, or t
  misc_feature (330)..(330): n is a, c, g, or t
  misc_feature (334)..(334): n is a, c, g, or t
  misc_feature (350)..(350): n is a, c, g, or t
  misc_feature (359)..(359): n is a, c, g, or t
  misc_feature (398)..(399): n is a, c, g, or t
  misc_feature (497)..(497): n is a, c, g, or t
aacaccacttcaagcatnatagatgaccctctttttactactgaactaatgaagcctttttcattgcattgttctgcatttatntctacagggagaaaactggttgtcctggatgtttaaaagttggtcgttgtcatggtgtgttacttcatcctntctatcattnnctcnatggcncaangttntgccanncgnntccagcagcggttgaactcagaggagaaaannaaataagnagagaaagtttaaactgcagaaattggagtggatgggttctgccttaaattgggaggactccaagccgggaaggaaaattcccttttccaaccngtancaatttttacaacttntttcctganagcagtttagtccatactttgcactgacatactttcccnnctgtgctaaggtaaggtatcccccctcgatgcaatccaccttgtgttttcttagggtggaatgtgatgttcagcagcaaacttgcaacagactggccntctgtttgtcactttcaaaaggcccacatgatacaattagagaatccccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattcgtcta

SEQ ID NO: 724571 - DNA, 413 bp, Homo sapiens
ctgcccacgaagtgcagtcaaagtcaattccgaggccaggcgcagtggctcaggcctgtaatcccagcactctgggaggccgatcacttgaggtcaggaatttgaggccagcctggccaacacgggaaaaccccatctctactaagaatacaaaaattagctgggcgtgttggcaggtgcctattatcccagctactccggaggctgaggcaagagaatcgcttgaactcagggggcagaggttgcagagctgagattgtgccactgcactccagcctgggtgacagagcgagactccgtctcgaaagaaagaaagagaaaggaaattccccagggaagtacctcggcttatttcatgaagaggtactgaaggaagcagaggcatgtggaggacttccccacttcgtgggcag

SEQ ID NO: 724572 - DNA, 194 bp, Homo sapiens
cacagctgtactaatgtggcgactgaaagatcactgcagtggacactgtctggaagaggctgcacatagcccctgcttagggactggattgtttttgcacgagctttttttttttttaaactaccatctccccacttttaaagccagatacttgacagggattttagatcttaatgggtccgatggtagggaat

SEQ ID NO: 724573 - DNA, 1289 bp, Homo sapiens
gcttccctggtgtgattccgtcctgcgcggttgtctcgtggagcagcgtcatttaatctccgtccgccttcatctcctacctaagtgcgtgcctgcacccgatggaagattcgatggacatggaccatgagccccactgaggccccagaactatctttaacggatggtgaactaaaggggcgacaaacgacttatcacttataaggttggataactgactgacaacatgaggcaccagttaactacttttacagaaaccggatacaaggtacagagaggactggatgcaaaagggactgcacgttggcccacacttggtgcgaaagccagacggcacacgtgacacttacacgcaaacgggacagttccaccttaccacaggtaacactttggccaaacattgttgcaacaactgctcctggtaccaagccacagcgggtattccacgttgtgagaggccattgtgggcgacatcacacccaccccacccccaggttggggctccttcaacaggtacttgcaaaagatggtgggatcacacgctgggccaaggttggcacatcacatcccactttgggtgacaggccacctataccagtcaacacctgctgggccgggcccagcatcgccagccagctcccaggcaacgcgcttggccacacgcaagcggccagcgacaggcgacttgcgttgtacacacaccagccagttaacaacagcgaagatagcttcccgggcgacacaacgccccagggagcacctatggcccccaccatagggagacagcggaacacgagcaacagcacaacaaggcgatatcacacgacagagaaaacccacacacaaggtccaacgacacgagtttggcctgggcactggcagtcgcacaccgcacatctcgatgtgaaagcaacgtcaacttgctcctgcacacacaagcgcactcgcaacgagacctgcacaacgcccattgccacttgacgtcggccgctgaaccgtgcacatcgggccaacggaccgacacgcgcgcaacgctgttcaagctgacacacagggcgcgccaagaggcgccagagcacacacccagttgatcagggcagcaaaactccgccgacggccccccgcaagacggtgcacacagaacgagcaacactacccgcccgcggcgcacaggcacatcacacagcagcgacaagcagtttgacgacacgcagcaagccgctacaggaggacaggagccccatccgtccaacgccacccgagcggacgcaagcaactccaccatgagc

SEQ ID NO: 724574 - DNA, 102 bp, Homo sapiens
taaggtatggatgctatcctctaggatctattaagaggtgatagtcatcgcatgtccgaggtgtcatacaccaggttgttggcgaacatactccatgaggaa

SEQ ID NO: 724575 - DNA, 179 bp, Homo sapiens
ctgcacgtaaccctcctccttaggcctggaggccaaggtgtgggtccccccgcctgatctttgaaaaccctacccagggctgctgtcccttcccagggcccaggcctcagcccaggcctcggggccaactctttgtataacctccctgaatgtattaaaaactaattttggggaagcca

SEQ ID NO: 724576 - DNA, 417 bp, Homo sapiens
ttcagtgcccctgtactgccctgacgtctcaggccaaagggagggagcaagtggggatctacagtggccactcagcaaaaacttactcccggggcggggaagcaaacagcccctgctgaccctttgcggatctcagtttgctccttttatggacctttactggagagagttccctccacagaatgtctgaagtcttgcattctttcccttccatcactgtattgattcttttttaaaaacagccaccacccctcaaactcccacctcacctcatctctgcagaatgttcacagcaaaacacctttgtctgtttttagattcttgaagaattagtctgttcaagacattgtgtttaaagctgggagcccactgggagtccacaagtgctgcatatattgggtagcaaaagaaaatggg

SEQ ID NO: 724577 - DNA, 343 bp, Homo sapiens
cctgccgatcgttctttattcttatttcagattcaaagggtagactttgggatttcatgtgtaggtttcttacatgggtgtatttcctaatgctgagatttggaataggaatgatttcatcacgcacgtagtgaggaatatccaatacttcgttcttcagcccttgctccactccatccctccttctctgatagtcccccatgtctattgttgccatctttacatccatgagtactcgatgtttagctctcacttgtaagtgtgaacatgtggtatttggttttctcttcctgcattaattaacttacgaaaatggcctccatccatgttgctgcaaaagaca

SEQ ID NO: 724578 - DNA, 494 bp, Homo sapiens
agggcgaagattctgctcgctcctgcaagagatagcaggctagctcatctcccacacccacagggtgcataccagcactttactagttactaagatggactgaatgcctgttctcatattgactgcgtatctgttatactctgatatcgtaaattccctcgcgcaagccctgtagttggactgttattagtgctctgctgtcttctgttatttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgccaa

SEQ ID NO: 724579 - DNA, 301 bp, Homo sapiens
  misc_feature (19)..(19): n is a, c, g, or t
  misc_feature (172)..(172): n is a, c, g, or t
  misc_feature (193)..(193): n is a, c, g, or t
  misc_feature (217)..(217): n is a, c, g, or t
  misc_feature (230)..(230): n is a, c, g, or t
  misc_feature (250)..(250): n is a, c, g, or t
  misc_feature (273)..(273): n is a, c, g, or t
tacagctgaatcagtatancctgaaggatgaaattggaaagggctcctatggtgtcgtcacgttggcctacaatgaaaatgacaatacctactatgcaatgaaggtgctgtccaaaaagaagctgatccggcagccgactttccacgtcgccctccaccccgaggcacccgnccagctcctggaggctgcatncagccccggggccccattgaggcnggtgtaccagggnaattgcccatcctcaagcangctggaccaccccaatgtggtcnaagctggtgggaggtgctgggatcgacc

SEQ ID NO: 724580 - DNA, 189 bp, Homo sapiens
tgggtgtctcatgactgtcgcccgttcctggtgggcatccgctgtcttcgagatcggctttgtgttgctgatcccgctggtgtttatcgtcgcccggcgtccggcgtgtcgttgatcaagatcggtatcccgctgctggccggtctgtcggcggtgcacggcctggtgccaccgcaccagaacgaccca

SEQ ID NO: 724581 - DNA, 118 bp, Homo sapiens
taaatcatgctctgtaccggcatgtgctgtaagccagcgggggaacgtgttctcagctccgtgatgcatgagaagacgttcccctgtcgtggcacatggcacatgtccacggctgtaa

SEQ ID NO: 724582 - DNA, 423 bp, Homo sapiens
gactctaggaggatccccctccgtcgaccgctggatttgactcagagaggaccccagaggtgtctccatcttccctatatattttcagcccttgagggcttcattgtagatcaaagcaaggcccccaggaagggtgacatactccctgggaagttcacctcctggtccttgttccggtccaagtcttccatcagccttgcaatttcagcatcctgcagcttcgagccaatggtgagctccttctggatcagctccttcagctccttcttgctcagggtgtgcttgtcaccctccctgccggagtacttgtggaagatggccacgaggaggccaatggcctgatccagggggcatgccatggctgagggctgggcttggagcggtagggaggcggccaaatgcgacgcgagcggtcgacggacg

SEQ ID NO: 724583 - DNA, 485 bp, Homo sapiens
ttggtcgtactctagaggtatccccttacaatcagcttctagactgatcatttgttcttaaaattattacggaacacgagaagctgtgattgcccagacttccagtctatgttaaagctgattgttacactttatcagaccacagactactccggaatccgtaacatcagtcttcatggtgaaacgcatcatattcaatacgactgctgattggaaggatcctacaaatcctttccgtttcccaaatattggtgtggagaatgtttctaggaattgaattctgagcagaatcataatgactactgtttggtctatttcttcacagaccgagatttcgataattgccgtattatagtctggctagggtataggagcaccttcaggtagtgtatcatattaattatatcttatattactagttgaaacatatgggagttatcagagaatgttgaattttcaaagtataggaaaaagtgatgcctgta

SEQ ID NO: 724584 - DNA, 122 bp, Homo sapiens
actaaccctaagccttgtgttaggcaattactctgccactgagctccattcacagccaacttcttacctgagacaaagaaaaagagtcacaaagactgacacagcttcaaaagaaaaatcat

SEQ ID NO: 724585 - DNA, 234 bp, Homo sapiens
cagacagttcaatagcatatgctatgggcggggattacaggcatgagccaccaggcctgaacaaaatatatatatatatttacagtaatttcaacattgaggaaaataaatgggtaatacttcctaaacatccttaacatttatgactatccagatggacagaattttgattggctgggtgtcagtataagagtgggactattcagtgctgctattgaaacttctaaaactagg

SEQ ID NO: 724586 - DNA, 89 bp, Homo sapiens
gctccctcccaaacatctgtgttacttctgtgccagcagttacgggggagatacgcagtattttggcccaggcacccggctgacagtgc

SEQ ID NO: 724587 - DNA, 184 bp, Homo sapiens
cggcgtgggcgtgacacgaggcgagcgggtgacgggcagttgtcggggggtaggaggcatcggtcgcgatactgcgtgtcggggtggtgtggtgtggtgaggccgtaggggacgtgcggtttgtcagtcgtaatgtgatgtgtggtgaggagcgaagtgatgcggtgtcgcgagtgcgagtctg

SEQ ID NO: 724588 - DNA, 336 bp, Homo sapiens
ctttggccctttttgggggcccttttgacccggtttgttcaaaaaaccgggtgggcccgggtccggatttcccggggtttttttcccccccgggtccccgggggggtggggtttttggtttttcaaggatacccccttttttttttttttgctggcccccgccccccgtttttttttttttttctttttcgggccccccccttctttgggttttgggttttttttgtggggtcccttatttttgggggggccttttttgttttttttttggtttggcgccctttttggggaatttttttgggggtcccttttaagggtttagggacccggaaatta

SEQ ID NO: 724589 - DNA, 134 bp, Homo sapiens
actttcctacgtgtccacacgacgctgttcctgcgtgggacgctacccacgttaccacttcaccacacggggactttacgaccgggttctggtggtgcaacacctttacacacgtatgacacccacacgactac

SEQ ID NO: 724590 - DNA, 1010 bp, Homo sapiens
  misc_feature (237)..(237): n is a, c, g, or t
ggtgaaaacgaggtgctgcagaatgtgacctgctgcctggcgaaggcagacaaggatgaacacggtcactcaggacctacgggtcctcaagagtgactagaacggagcagagtagtaattcttgccgtctgacattatctaagcattcctctctagagggatctccatgtaagtccaatggtcggtgaattcgtaatgtggtcgagccatagggaataagcaccatcgagacacggntgcctgcatcttcaggtgggtatgtgatgggctcaaatgcgcaggaggcgagaatctcgatctcctgtcacgctaagtattgacctagctatgatagatgtcgacaaggagactagttggtcctacagggctgacagacggatgcttggagtaatcaatccggcacatatacaatccaagatctccaggagaccgacgaccgagaagagaaactaatggtcccagaagaaccctcggggggcacccttgggcgtgtccacaagggtaccggtcccatcaatgcagcgctgcatcttgtccgcgtgcatcagggtggtgagtcggaaaggtatgtcgcggggtgccgtgcaatgttaggacgagaaagtagctacaactggctcgctattcacacccgtttgtcggtaccaaaggcgattcttaccgccaaagggggacaatgggcgcgggggctcaccgcacaggtagaggttcaggccctgcccatggaataggaatattccttaggaaaatggtccctcgtggcaacaaaatacctgagtctctctgctttggctctccaccaattcaaaaatttgtaggagcactttatacaaagttgggtataatactattatcacgattccaagttatgcgccgccaagagaagagataacacaacaacaaaccacacacgcaatactctcactgagcaggaagcgaggagacgcatcatatctacatgcagtgacgacgcgcagccgtcgagcccacacggcgacgagcagcaaaaa

SEQ ID NO: 724591 - DNA, 390 bp, Homo sapiens
ccggacccagatgggatctctgggacaccctgccctgctctacaattgggatcctgggaaaagtgacagaatctggcaacaggggcctgctctgtcgcccaggctggagtgcagtggcacaacacagcggactgcagccttgacctcccaggctcatgcaacctcccacctcggcctctcaggaaactgggaccgcaggcacgtgccatcatgcctggccaatttttcagtttttttgtagagatggggtcccctgtattgctcaggctggtctcaaactcctgggctcaagtgatcctcctgtcttggtttcccaaagtgctgggattgcaggtgtgagctactgcacccggcccaataaaaaaatctcgttctgtgaaagaaatgttt

SEQ ID NO: 724592 - DNA, 175 bp, Homo sapiens
  misc_feature (144)..(144): n is a, c, g, or t
gaggatctgtacttaaacagagaatcagagccctcaatcaatttccagacttgagccagtttacagacccagaaccacttgaatgaaggggaagctgagtccccttgaggaaggaccccattacattaccgacaatttatacanatgaagctttcttcccacccattccccaggg

SEQ ID NO: 724593 - DNA, 103 bp, Homo sapiens
acacggagcctggctgtcagatctacagctggccccgcgtgctgctcctgctgctccgtcaaggccctggatttgggtgctcagctgactccgacgagggcat

SEQ ID NO: 724594 - DNA, 653 bp, Homo sapiens
gggaactgataaggatgagaatggtggtgccagcttctgagggcctgcttggctcctgggggcaaagctcttgcccgaagcaataacaacagcagcagaagcaatcccggggagctgccaggggtgtctgtctctgttctccttggcgtttccttcatggccgtgaatcccagctcacccatggacagaagacctcccctcatctgaaagcctttctgccttccttcctgtagctgtcgctttctcaggcttggactgtcccctggttcaccctgtctttgggatgtggcccttgagctgggcgggctccttgggtggattagagagctggccgagctgcaagcacctgagttacctgcgagggtgcccagagtggagcttggcctgagggcgtgttgcagccctggccccaccagtccacagaggcccccaggagcactgcctttcagtggaccgggtgggggctggtgggaggggccccactagctgagcttctgctgccctctgctgtctgctgagatgccaggctagtggagagggcacaccatgtgcccaaatggtgtgatgctccttgtagcaggataccagggtactggggggcaatgctatgattaacttgcttcaaataaaaagttcccgccccataaccggca

SEQ ID NO: 724595 - DNA, 385 bp, Homo sapiens
agcgggggtgcgcgcggccgtgcagcctgggcagtgggtcctgcactgtgacgcgcggcggcggtctggtcctgcctgtaacggcggcggagagtgctgctccagaacacccatgacaggcgagcagtgtcggcgaatccctgctggctgatgagcgccggagatgtgcgaaccgctggttagcctaggcgcctgattgcctaggagcatctgcgcagtcgcttagcagtgactcaccgctcagacatacagtatttaactacaacaacaacacatcctggtcagcaacttcacacgttatctgtacatagaccacttggtccagatcaattcacactagcattatgcttacctacatatcgggggcacaaaacacctcactgaa

SEQ ID NO: 724596 - DNA, 682 bp, Homo sapiens
  misc_feature (11)..(11): n is a, c, g, or t
tccaacttagntgcgaactcaggggcgagctgctaactcaggggcgagctgctaactcaggggcgagctgctaactcaggggcgagctgctaactcaggggcgagctgctaactcaggggcgagctgctaactcaggggcgagctgccaggggtgtctgtctctgttctccttggcgtttccttcatggccgtgaatcccagctcacccatggacagaagacctcccctcatctgaaagcctttctgccttccttcctgtagctgtcgctttctcaggcttggactgtcccctggttcaccctgtctttgggatgtggcccttgagctgggcgggctccttgggtggattagagagctggccgagctgcaagcacctgagttacctgcgagggtgcccagagtggagcttggcctgagggcgtgttgcagccctggccccaccagtccacagaggcccccaggagcactgcctttcagtggaccgggtgggggctggtgggaggggccccactagctgagcttctgctgccctctgctgtctgctgagatgccaggctagtggagagggcacaccatgtgcccaaatggtgtgatgctccttgtagcaggataccagggtactggggggcaatgctatgattaacttgcttcaaataaaaagttcccgccccataaccggca

SEQ ID NO: 724597 - DNA, 772 bp, Homo sapiens
gattgcttgagctgaggagtttgagaccagcctgggcaacatagcaagatcccttcccttaaaaaaaaaaaaaaattttggctgggcatggtggctcatgcctgtaatcccagcaatgtaggcagccaagacaggtggatcacttgagtccaggagttcgagactagcctgagcaacatggtgaaaccttgtctctactaaaaatacaagttagctggttgtggtggtatgagcctgcagtcccagctattcaagaggctgaggtgggagggttgcctgagacctggcagatagaacgtatgcagtgagctgtgatcatgccacctgtattccagcctgggcaacagaattgagaccctgtgacacgcacacacacacaacaagatagataagctggtaccactctggccagcatcatcatcagccgcttcccatgttgcaacacgtacattacatgcgtcagagcactcgcataaatgaagaggccttccctaacgggtggattggaagtcttccaacgagtacacaccagagagacaccacacacaaagagggaagaacacaagaggacactgggcaacaccaacagaagccgaacgaatagagaacaaaggacgagagccaacgccgacgaggaaagagacgcagagacacagcaagacacacaaagagggggcaaacaccacaaaaagggcgcacaccgagcacacaaaagagtgacgccaacagagaagcaggagagcaaacacacagacgccagacgagaacacag

SEQ ID NO: 724598 - DNA, 249 bp, Homo sapiens
  misc_feature (11)..(11): n is a, c, g, or t
tccaacttagntgcgaactcaggggcgagctgctaactcaggggcgagctgctaactcaggggcgagctgctaactcaggggcgagctgctaactcaggggcgagctgctaactcaggggcgagctgctaactcaggggcgagctgccttggttgtgctgtacacacatctgttcacaactcctttgacgctggaagccacagaagacatgttgataatattgccagatttctgagcaagcattttagt

SEQ ID NO: 724599 - DNA, 309 bp, Homo sapiens
  misc_feature (220)..(220): n is a, c, g, or t
aagcttggcacgaggccggggccggccctgacagactgcctcagctgctccagccacgcctccttggagcctgtggagcagacttgctcctggccaaagacagagcagccgagagtcccccccacagtagcagccacctcggatgcccccggaggtggaggcggagcaacggctgcgggcaggactgctgccctcacacctgcctgaggtggtgggcgcnctcagatgcgccttcatcgcgctggtcttcgtcactgtcttcttggtcctgcagctgcgctctcgttttagttttcggggggtgaaggt

SEQ ID NO: 724600 - DNA, 114 bp, Homo sapiens
agaggatcccgatcagcatatcagcagaggcatcatttacagggacctcaaactggacaatgtgctgttggaccgggatggccacatcaagattgccgactttgaggatgtgca

SEQ ID NO: 724601 - DNA, 319 bp, Homo sapiens
  misc_feature (11)..(11): n is a, c, g, or t
tccaacttagntgcgaactcaggggcgagctgctaactcaggggcgagctgctaactcaggggcgagctgctaactcaggggcgagctgctaactcaggggcgagctgctaactcaggggcgagctgctaactcaggggcgagctgccaacctttcagcagcttctacacacccagctcctgccacccagtggcctctttaggccaagctcatgcttctacaagggcctttccaggcccaacttttgtctcatggcaacctttcctggccagattcctgcctgtctcccagcagctcgcctctgagctgcagctcgccc

SEQ ID NO: 724602 - DNA, 3460 bp, Homo sapiens
gagacgctccggactcgtcgccgcaggtgtccaccccccagggttcctgacccctgcccctggacagcgaccccttctcagactccagttgggccggactctccaaacctgcttccgcaatgggtgggttgtgagtgctggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtccgctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgctccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccaaagctgcccccaaatcagacatacctctgtggctctcctctggttcacctttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggcggtgggtggtgggcaaggtgggacctcctgcagcctggaaagaggagggaggccaaggccattccctaactccctcctgcccctggtttgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccgctggaaagggctctgaccccctggcccggccgggctctctagtggtgatccggctcattctcctgcaagttggaagcacaattttccccccaagtggaggaaaaggaaagggccccagcgtactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcattttactgcctcacagaagccagccaagtgccaaggtcagcttggctggtctgaggccacctttttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtcaaaaaaaa

SEQ ID NO: 724603 - DNA, 387 bp, Homo sapiens
ccgtcgtttaaatgtgtgactgggatacctgtgtagatttaactcgataggctcattctactgtcttctccagtgtctcttctatagaaacagttacaaacctacggccaggccaggcagtggctcacacctgtaatcccagcactttggaatgctggggcaggaggatcacttgaggtcaggagctcgagaccagcctgggcgacaaaagcaagactccgtctccaaaaaaaaaaaaaaccttgcttaagtgtggtacattggtcaccacctgcatgcacccaatactgatccactcattatacccggggtgtgggtaccgtgtactctcagctactccaggtggggctcacttgagcctcaggattggccctctagccgggcgcc

SEQ ID NO: 724604 - DNA, 260 bp, Homo sapiens
  misc_feature (11)..(11): n is a, c, g, or t
tccaacttagntgcgaactcaggggcgagctgctaactcaggggcgagctgctaactcaggggcgagctgctaactcaggggcgagctgctaactcaggggcgagctgctaactcaggggcgagctgctaactcaggggcgagctgccctgcccttttgcgcttgcagaccgccttctatcccagagcagcttgagaactcctatgaagctcagattctaaaggtagcagcttaggttccgtcggtggaccctctagagt

SEQ ID NO: 724605 - DNA, 959 bp, Homo sapiens
cctactatgctccggcgggcgtatctcaataattgtctgaatcgggccacggcattgtcccgtagatgttgttcctttccagggcacactccatgggccacccctgtggtgggccctcgagcgcaccttaaaatccaaggaattcccgggccacatgtgccagtttccgcgccctggtggggaatctcccaaccgggctctttcaaggtgcccccgaaagtgccgtcaaacatgggaacacaattcggggtccacaacattgaccctgcggcgaagggcttcccgtgtgtgcgtggtcacaccacccccctgtgggtcataggcccttccctaggctgccgccctcttggaggtatctttatggctttggacatgaccacaggacttttggggggctgtcactttctctggtgccacacaaacgcccctcttctggggcacgcgtctttccaatgggggccccctcctcaatcgaaggccgcactgggggtggcccccccaccgctcgcgcgtgcgctttcggatgatggcaaccccagcgagtgtcttattcgccctcgactcggaagacaccgcgccccctctttgtccccctcgccctggaaccccgccccgcttttcgcccaatcgcactcacaggccatcggccttgttcccaccccggcagcggggcacacccctgttttcgccaccctctgatggaaaggctctgctgctccgattcacccctcggcgggcgttttattatctggggctccccccatcaaattgggcatcgcgattcgcctcctgcgagaagcacccacgtggggggagagtcgaagcatcgaactaacaaaaactcttatatatatcaagattcttaagactcagaaccttgacgtctttgaacgaccgcgccccccccctttgtgtgtgaacgtcccccctgaacctgaaatccctttttccacaaaaca

SEQ ID NO: 724606 - DNA, 548 bp, Homo sapiens
agcaagcggggaagaacaaaactatgaggggcaaggcagtccttccggagcaggtggactccagccatcctcggcgtggggctgtggccccaacagcagagaccgccccaaccaaagacaggtcagtttaaatgttcctggtccttctcccagagcttcaggggggtgggcgggctggcagagcgaattaatcaagggagaacaacggcctcagccgggtgcgtgcaagaagccggcgggcaggttaaaaaagcaaaacataagatgtggctccccagcacggtaaaaggcacttctgcaagtgaacaggtatgtggtgcaccagggaacggggtccacaggtgtaaacggagatggtccggggcaaaccagggggtgtggttaccgcagtcggggagagctgagaaaccctagtaaggacaaggacatgcgttggctccctccctccccttcacccttgcagcttatttcgggtaggggttctgttctatgaaagctaagccatgaggcagaatgagtaaggtggccttccaagtgtgtgatgtacc

SEQ ID NO: 724607 - DNA, 930 bp, Homo sapiens
gagtccagataagaatgccagcagggcgtggtgcgtggggcttcttctccgtgaaggggctgcaacgaggggcatggcttagactcatgtctgtccgttgtatctaggatatgggtgatcagcacactgaagaaagcgcccaggggccattggagccctacagatcaaagctgctagtaaggtcgacatggagccactttacatgttcacggcatcagactaggcgatcgcgacccgttccatacgtgtgatccagctttgtcgtcacggcagcgcggtcagcagaagacagcttaaaccaagctccttaaaacacatggcgtgaacattctggaaagctgcaggcttgttgcacttcacataacgtggtgacaaacaacgtgttcttctgagctgaacataacatgcacttcaagtactgtcaagtgaaaatctacaagacaggtatttcacagaggtacattttccctgcctagagactgcgttacccaagattggctgcgtttaccccaaaagcgcagcccgacattgcaacattcgcaagcatgtagcgtctccaatggaccacatgaccaactggcagtcacgtatacagtgggacgcagttgctggtgatagtctgacaacttgttcaacattttcaattttctacacattgactgttacgatcttaattcaaccgttttaaattgtgcaccaattggatgacagggtgagtttggatgaacaatatctggaagctattaatggaaaattaccattgtatataagggaagaaggtgtgaacagtggaattattcagagaaagggcagtccaggttacatgtgtaaaatttacaacttggtgatcaaccagagtattacctggaatttagcgaagagagagtaaccaggtaacataagaaactcagaagaacgcagagaaggaat

SEQ ID NO: 724608 - DNA, 946 bp, Homo sapiens
gaagctcacttcttcagtgccattgatgtgagatgtgctggagtggctatcaaccctttccttcctaatagattatgttgttaactacgatatctgtgcgctttggggacaggtccgaagttctcttcataggcttacaactgtcacttttacgcagatgcggtgagacgggatttactacgtgcacgcgtcagactgtcacgccatctcgttcgtcgacagacctcgacttacacatgcaacctataggcacacggcttgctttgacatctatctctgtcttactgtctcagccttatagacgtcttcaggtaactagtaggatacgaaacacctgtgttcccgagcaggtaaggagtagtaagcgtacttacttgactctagagtccgtaacccagggttaacttggcaagtcagtaggtcggtgactacttttcagactttttccactggtacacgtgatatgccatataagccaatgtagtccagtttctacagatcatgttccaagctaactgaatcccacttcaattacacactcatgaactcctgatggaacaataacaggcccatagtcctgtggtcatgatcgtgcacacttgctagactcagaacaaaatactactctcataaatgggtgggagtattattggtgacaacctactttgcttgcgcctgagtgaacggactgatattcatatattcatttattcccatggacatttagttagtgcttcgatatataccaggcatgatgctgagtgacactctgtgtatatttccaaattttgtacagtcgctgccatattgatatcatatttctagacttccaccgattgaggccccggtttttacggcaacctgaccagtaggattcaccccgttagcacctaaaccttccatatgcgtaacattacctcttggtctcctccggcaacaacgttga

SEQ ID NO: 724609 - DNA, 197 bp, Homo sapiens
  misc_feature (11)..(11): n is a, c, g, or t
tccaacttagntgcgaactcaggggcgagctgctaactcaggggcgagctgctaactcaggggcgagctgctaactcaggggcgagctgctaactcaggggcgagctgctaactcaggggcgagctgctaactcaggggcgagctgcagctgcaggctgcatgtgtggggtagcaggacacgccacttgggcagtca

SEQ ID NO: 724610 - DNA, 136 bp, Homo sapiens
gcgacctccttggtgccgcggccggtggcccatatggggtggatctacgtcgtcgtcgcagtggcgtcaggcgcggtattcatcggcgaggcggcccagttgctgcgccgtgccaattctggcctgcgtgatgcct

SEQ ID NO: 724611 - DNA, 251 bp, Homo sapiens
  misc_feature (11)..(11): n is a, c, g, or t
tccaacttagntgcgaactcaggggcgagctgctaactcaggggcgagctgctaactcaggggcgagctgctaactcaggggcgagctgctaactcaggggcgagctgctaactcaggggcgagctgctaactcaggggcactgctttgacaggtagaaagcacaagcaggatgggagaggcagtcgtgggaacctgcagcgtcctcttcacacactattttctgcagctcgccggggacctcaagatcgc

SEQ ID NO: 724612 - DNA, 158 bp, Homo sapiens
  misc_feature (42)..(42): n is a, c, g, or t
  misc_feature (87)..(87): n is a, c, g, or t
  misc_feature (125)..(125): n is a, c, g, or t
  misc_feature (141)..(141): n is a, c, g, or t
tttgttgccggcctcgccgtggacgccccgaccatgggccangcagggcgtctgcctcctcccaccttccgcagacctcaggccttnaaagctcttccttggtcctgcttagttttgtggcatgntcttctataaacttgnttcaaatgctccagatc

SEQ ID NO: 724613 - DNA, 138 bp, Homo sapiens
aataaataagtcaaaatcacaaatgacatatacggatacatcgggcaacattagatataagtacttgtatgatacagacacgagtcaaaatatccgtctttaaatcaagatatgtttagtaggacataaacacacaca

SEQ ID NO: 724614 - DNA, 247 bp, Homo sapiens
  misc_feature (11)..(11): n is a, c, g, or t
tccaacttagntgcgaactcaggggcgagctgctaactcaggggcgagctgctaactcaggggcgagctgctaactcaggggcgagctgctaactcaggggcgagctgctaactcaggggcgagctgctaactcaggggcgagctgccagcttgtaatttttagggactgcaaaacaaggctttttcttcagcgaggcgccgagctgacgcaaacatgcagatctttgtgaagaccctaactggcct

SEQ ID NO: 724615 - DNA, 233 bp, Homo sapiens
  misc_feature (11)..(11): n is a, c, g, or t
tccaacttagntgcgaactcaggggcgagctgctaactcaggggcgagctgctaactcaggggcgagctgctaactcaggggcgagctgctaactcaggggcgagctgctaactcaggggcgagctgctaactcaggggcgagctgctaaagtcctaccagtggaagatgctcaacacgctcctccttgctggagcagctgaacgagcagtttaactgggtgtggcggctggt

SEQ ID NO: 724616 - DNA, 532 bp, Homo sapiens
  misc_feature (6)..(6): n is a, c, g, or t
  misc_feature (166)..(166): n is a, c, g, or t
  misc_feature (260)..(260): n is a, c, g, or t
  misc_feature (274)..(274): n is a, c, g, or t
  misc_feature (276)..(276): n is a, c, g, or t
  misc_feature (278)..(278): n is a, c, g, or t
aattgnaggtgcatgtgcattatcacagatttaaaatcatgcatattctccataaaacttttcaaatgcagttaaacacacacacacacacacacacacacacacacacacacacacacacacacacacacaaaaccaagcaattataagtcctctgaagcatgtnactgtgtttagctgctactctcagcaatttaaaaatactttccccacaattacattccagcctgttatgtaattcaaaacaaacaagtcagagncatcgctcaaatgncngnaccaacaaatacaggtgctttgcatcaaggaaatgaatcttctggaggaatgcaactggggggcggcggcccctccggggcctggggctgggcttctggtggggcggcggggcccccttctgggcgggggcacacagtgcgccccgggggctgtgccaagctgccctgtggtcatgggggtggactgggggcttcctgctgtgggtaccctttcccgtgttgtgttccaaattttacattttagattttaaatt

SEQ ID NO: 724617 - DNA, 433 bp, Homo sapiens
  misc_feature (98)..(98): n is a, c, g, or t
  misc_feature (146)..(146): n is a, c, g, or t
  misc_feature (161)..(161): n is a, c, g, or t
  misc_feature (176)..(176): n is a, c, g, or t
  misc_feature (179)..(179): n is a, c, g, or t
  misc_feature (191)..(191): n is a, c, g, or t
  misc_feature (214)..(214): n is a, c, g, or t
  misc_feature (262)..(262): n is a, c, g, or t
  misc_feature (277)..(277): n is a, c, g, or t
  misc_feature (283)..(283): n is a, c, g, or t
  misc_feature (285)..(285): n is a, c, g, or t
  misc_feature (292)..(292): n is a, c, g, or t
  misc_feature (295)..(295): n is a, c, g, or t
  misc_feature (305)..(305): n is a, c, g, or t
  misc_feature (334)..(334): n is a, c, g, or t
  misc_feature (344)..(344): n is a, c, g, or t
  misc_feature (356)..(356): n is a, c, g, or t
  misc_feature (378)..(378): n is a, c, g, or t
ccgggcgcgctgcgagcatatgctgcagtggttcagcaccttgttcctcctctcccactcctcctcggcctcctcggcagctgagcgtgcgattgccnggccagcggtgtgaaattgtaccaattgtgcactgggaaggcctccanggccccttcggggcnctgggtgaagatgtntangacgtgttctcngttacgcctcccttcttgatgcnctttaacttcctgcctgatttgccgtaaaccggagcagcctggtctgntcctcgcgccggaantccttnangacgatnccntacttcttcntccgagcctcctcccgaagcttgcggttnaactcactgnccgcgcccgatncgggcatctcctcctcttggtnaatattcttgttgcccaattcccgctcgcagctgcggtcgcgggctccgagctcg

SEQ ID NO: 724618 - DNA, 320 bp, Homo sapiens
catagtaaactaaaagagagatcagctgagtgaggctgataagacaaagactggaatgcatagagctatctggaaggagatcctaataacccaattagaagatggggcccagagaatctgcattgggaagtcggccacccttcccaggtgattgtatagtacaaactttatgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggca

SEQ ID NO: 724619 - DNA, 148 bp, Homo sapiens
tctggtcgaagtctgacccggtgattaccatctcagcctcccagagtgctgggataacaggcatgaaccactgtgccatgtcagaacattgtatctattgccttcagccagaataatgtcagcttgacataatatttgatcttctttt

SEQ ID NO: 724620 - DNA, 811 bp, Homo sapiens
ggataagactcgaagacttagattgactccgttattccgaaaggggcacaggcatgccaatatctgcattcacgatacatttgtgacgaagacagttagcctggacatgggacgctggtgactctcagcagatcaaagatctggcaaattcaccttaatatgcaatgactcgtcaaggagatactgttcttcctttccagcatcctcaggacagctgacaggacgaaccacaggctatgcccgactttcctcaggctcatgaagggcaatgtcacacgcttggctccctatgaagcacagctcaaaggatatggaaacgacacagtcgggagagatttatctcacataatggacaagtcacagccgcacagcgttcttgctctcattatctgcacatgaacgcaatatcgacagctattcctagaacgaactggagctcgagtgttgacatcagaggcattgacacatgctgctacaaagatctgcgggtacagacgttagcatcgtgatacaaacaacatctcacctgctttcggaccatgagctcaccgagtcttggacggcacttgtgcctcaccagcccagacgcacagagaactctgacagcacgttgcctggtcgtttccaatgtgcaaacatgaggtactccgtgtaaatggcagtcccgtgcggaaacgaccgcacctgcaagacgtcaaagtacccgcgatactcctttagccaaatcacatgccaaatctctcaaccatgcctgaaagttacccaaggaacctgcaccaagtctggaacagacacaccgcgacggtgcacc

SEQ ID NO: 724621 - DNA, 729 bp, Homo sapiens
ggagagaatgggccctgaaggtgatggagcccgaaggcgtcatcgagagtaactggaatgagattgttgacagcgtttgatgacatgaacgctctcggagtcccttctccgatggcatctacgcctatggttgcgacgaaggccctctagccattccaaggcaagctgacgctcatatctaccttgctatcaagcggcgttatcgattgtgattagctcgagtgtcccaatcttgtgtgacttgcgtgaacacacggggcatcatttcgccatgatctgatgtctcgccaggcagacttgaattatgagtctatacagccacccgaggagttcgtctgcgtcctaggcgacccgatctcggatagaattggatcgagctagcgatacacgaacgtgtggtcaactggcaacgtagggaggactacaatgtggagaagccgtcactgtcacagcccttagtaatcaggggtatgtaccagacggtgcagtagcttgagggtagcatgacaactgctaggatgtgaacgctccccgacaatcgagtcgtgagagataaccccataggacgcgtgtgcttctgagtatggcttcaaccgcggcaggcataccgtgctgaacccacaataattagcatcaaagaatgtttgagtacctggacatgacggcatgacgaaaatgttgaaggccgcaggaatacaaggactcaggatcattatgaacatacatacc

SEQ ID NO: 724622 - DNA, 188 bp, Homo sapiens
gcataatgcagttggttggaagtacaggacacaacctgggacttctgcgtctgaagtgggagcagtcttacgggactgaacccttcacctgcaggatctgatgcttcctctgggtagatagtgtcagaactgagttgatacccaattggtgtctgctggaggatttatggggaacccccacccccaca

SEQ ID NO: 724623 - DNA, 214 bp, Homo sapiens
cacagagcagtcagtctgacaccagattctcatagacacagctgtctctgacgctgtcactgagatagctagtccaggtccactcaggcacagtcacagtagtaggtggtagccatactcttcttacttattattctagcttagcctaactctgaggttcaagattttagtcagtaatttgtgttgaagatatcattagacatctgatgaaaca

SEQ ID NO: 724624 - DNA, 101 bp, Homo sapiens
atacataatggcataccagatacaggggacacaaacagctctgtgtatatgaactacaaccagttgttgacttttgttatcaaggtggctccccttacccc

SEQ ID NO: 724625 - DNA, 275 bp, Homo sapiens
ggcagtatgtgagaagttctccacggagaggcacgtgggggacaggacccccgtataaactgacgaaggcgctgcaggaagagctgctcctgaagacagcgaggacctgcgcagccatgcctggtaccacggcacggatcccccgacaggctgtctgaaaaccttttgcagcgagactggtgactatccgtagggtgcgtgactctcgtgatcctgccctggggtcccatgggctaccgagactcgaagttcgctagatcagtggctcactaggc

SEQ ID NO: 724626 - DNA, 998 bp, Homo sapiens
  misc_feature (439)..(439): n is a, c, g, or t
agcgggttcttgaaacccagccaccatgctgtgaggaagtccagacaacctatggagaggcccctttcaattttactgaaagttctctctcaaaccagaaaaagaaatgaagataaaacagataccaatgtaacttttacctgacaaaacaaccctccaaagaatcagcacaatttaaaagtttagaataattctttttgtggaagctcttataggctgaggttgtgctcaaaataaaaagaaacagccctgacagcattaacatagcacagacactgtccttcgaagcgcaagcaggcagcaccacaagcacacggcagcacacaatacagcacagcagggcagggcacacgagaccggcaaggcacccagggcgcggcaaaccaggcaagcagcgcagaaccaaaagaggcacacgaggacaaaaacaagaactatntactacttactactggtgtggcgtccagttacatctggtactacctttagattttcttctttcctttgggagtacgattaatgcataatccttgctgcactgactcattctaggttatacctgttttatcactctggcttccccaaggtcaacctgcatgttcataccaatcattatctagacatgcatgcattttctagacaggctggaaatctccttgtggatgtttcaggggcatctcaagcataatatgtccaacagacatatcgatcttgccacagaaccatgttctatgcatcttaccaatggcactttggggtatgaacatcccatccacgtactcaacatggggaaactcaggggccatgctggggagcaactcttccctaaccctggccatctgtcttcaactggcctaacatcaaagcctattagctccgcctcccaactgtcactccctatactccattgctcgtccaatacctccatgtaaacaccctctctctcactacacattttaaactggtgtcgaaattcgccagagcacctttcatacata

SEQ ID NO: 724627 - DNA, 336 bp, Homo sapiens
  misc_feature (141)..(141): n is a, c, g, or t
  misc_feature (147)..(147): n is a, c, g, or t
  misc_feature (237)..(237): n is a, c, g, or t
tatgactgtgggaacgagagctagaagacgcactttagatgcttatagctcttacctgctggagagaggaagtggtggatgatacttgatggtagaactgacagcctccaacagagctgaggccacccccaatggctctgncactgntggaactgaagccacctccaacgccaagaccactgccataggagtagctgcttcctccacccaggcctatgccactgccgacaccactgncaccgcacatagccactggagacggtggactgcaccacagagatgttgactgtgtccaaccccttcgccattcagcctgcactcctcacccttcacacc

SEQ ID NO: 724628 - DNA, 298 bp, Homo sapiens
cagtagactcctaatcatcctgtctctggggttaggctaacactcattggccaaaatgttctttctaaggcaaaccgacgcatctcaccccattctcttaacagtagagtttactctcctaagcagaccaccaggaggacccaaaggaatgtgtttaatgggtacataggagctttactctgtgagtaaatgcaggactgtagccaagctgtaaagttaccctctgagggtaacttgggtacaaaatgaaccagataattgtggcactttactagacaagaggattgtagagggatcc

SEQ ID NO: 724629 - DNA, 405 bp, Homo sapiens
gataaggcacaagtgaacagagactttaggaagtggaagggagaactgtaaaagttacgcagtgggcagcacaggcccttggtcattgcgagggaggccgagccaggaggaggaggacaataagaaggcctaacaggcatctgaagattccagaaggaagggtcagaggatgaaagggctaaacttttccataattgctaactacggggccctgagagtcaaggagaaagcaagatgtctaagggacactgagagcctgaagttctggagggcagagccatgttttggacagagcctcactctaagatggcgaaagggcagtgagagccttaagtactggggggcagagccatgtattggaccaagcctcactccttgagggagaagagcatatctgacgatgaa

SEQ ID NO: 724630 - DNA, 969 bp, Homo sapiens
  misc_feature (7)..(7): n is a, c, g, or t
  misc_feature (70)..(70): n is a, c, g, or t
  misc_feature (115)..(115): n is a, c, g, or t
  misc_feature (135)..(135): n is a, c, g, or t
  misc_feature (144)..(144): n is a, c, g, or t
  misc_feature (212)..(212): n is a, c, g, or t
  misc_feature (239)..(239): n is a, c, g, or t
  misc_feature (286)..(286): n is a, c, g, or t
  misc_feature (288)..(288): n is a, c, g, or t
  misc_feature (325)..(326): n is a, c, g, or t
  misc_feature (338)..(338): n is a, c, g, or t
  misc_feature (346)..(354): n is a, c, g, or t
  misc_feature (356)..(358): n is a, c, g, or t
  misc_feature (360)..(360): n is a, c, g, or t
  misc_feature (366)..(367): n is a, c, g, or t
  misc_feature (550)..(550): n is a, c, g, or t
  misc_feature (878)..(878): n is a, c, g, or t
  misc_feature (904)..(904): n is a, c, g, or t
  misc_feature (952)..(952): n is a, c, g, or t
gcccganaagccgcagtcgtcgagagcggtcaacgaggtgtttcggtagtctctggccatcctttctgcncacccggtgtcgcgtgggctgcaccccgggcggggacggtccgcngggcacaggagggggccaanatgccgatnaataaatcagaaaagccaaaaagctgccataatgtgaaggttgttgttaggtgcgcggcccctcaatnagaaaaaaaaatcaatgtgctacaaanaggctgtcagtgtggatgagatgaggggaactatcactgtacataanantgattcttcgcaatgaacctccaaaaacatttacttnngatactgttttngggacccnnnnnnnnncnnngngggggnntataacttaactgcaagaccgtgattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaancggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcactaatatgaacgaacatagttcccgttcccatgccatctttacaattactatagaatgcagtgaaaaaggcattgatggtaacatgcatgtcaggatggggagctcntcttgtagatcttgctggttcagaanacaggcaaaactggagctactggacagcgctaaaggagctacaaaatnaatctttcacttccacc

SEQ ID NO: 724631 - DNA, 241 bp, Homo sapiens
ctgcgatgtagcaatgagtatcgattgtatttcactagtcccaagaattatcactgcattgttatattaggatggaatataaggacactatttaactgttttgatgtctacaagtagtgtcaatttagcttgtgttcagctcatattttataaaatagaggatacgcatacttgtagaaaagtctcctggttaacattaaggcttcgagcggtccaggtgctacacgcagtgttaattccc

SEQ ID NO: 724632 - DNA, 426 bp, Homo sapiens
gtcactctagcaggatctcgaaaatgacatagaggcaggatcctactctgtcgcccaggctggagtggagtagtgcagtagtgctatttgggctcacggcaaccttgactcctgggctcaagtgatcttcccacctcagcctcctgagtagctgggatcacaggtgtgtgccactacacctggctaatttttgtattttttgtagagacagggtttgaccacattgcccaggctggtgttgaactctgaggtttaagtgatccacctgccttggactcccaaagtgctgggattataggcatgagccactgcacccagccaataagttttattgtaatgaatgaacccaatgcaacattaggcaaaagtaaagccatattttaaaaaattgtctattagaatgtttttgatcttttatcaaaatat

SEQ ID NO: 724633 - DNA, 209 bp, Homo sapiens
gttctagaggatcccggacgtatggtgatcagagctgggggagcagtgtgagcagcaggagagagatcaccaccattcatggatcaccacctgtgtatcaccaccattcagggatcaccaccgtgtgtatcaccggccattcatgagatcaccaccacttcatggcatcaccacacattcagggaaaccgacgctcgcaaattcgtaac

SEQ ID NO: 724634 - DNA, 108 bp, Homo sapiens
tctagaggatcctctagattgaggatccgccaagcaacacccaaggcagagccggcccgaggccaccaggctgtctctcattcttcagcgattctcagtagacagtca

SEQ ID NO: 724635 - DNA, 802 bp, Homo sapiens
ccgccgaaggttaccccgccgtgttcgtgcgccgcggccgttttcttgtaagtaaggcgctacacacccaactttttggcgcgcgatatgtgtggttggttagtccaatctctctcccgcgagagcggggtatggtcttcaatacgcgtcccccacatactctataagtagtggtcgttacctctctacgggcgctatctataaaatggccctcaacgcgagagaacgctcatctctctagtggcgctcgcggtatatggacgcccgccggtaaatatctactctcttcgaggcgccacctatatagagacacctccgtaagtgtgcggggaaagaatatgataacgcgccctcgttgatatcttcgtgggcgtaaaataaataattaggtgggcaggcgataataatagttcaccaggagtgagcatagatgctcgtttccccgcgcagacatatagatacccataaagttttctcacgtggcggtgcgaaatggtgccaccactcgcccagtggaacgaacgcgcggtacctcatcttgggtaatttacccatgggatctatgacaagagacgcatggcatcagttcgccctacctcgtcggggtgggcaaacttctatgtgtggcccctcttgtctacaagcaacgacccacttgtaatgttcaggaggttttgtgtgattataaaaagaagataatgtacagtcttgatgaaacaatgatcgtgaacacacgagggttgttggttgatgtaaaattagggccaaattgattaacccgccccatacattggtcagagaa

SEQ ID NO: 724636 - DNA, 897 bp, Homo sapiens
tggcccccccttcccctccaaattccgggccccccaaaactgatttttttaaaaaattgacaaaacgggtctctttccttttttaccgggctgggaagcccagggaggtctcaggtcccgacagccaggggcccagggctgtctccattctttcttggagaagctcttgaactgtgctcttgtgcctgtggggggtgccccatctgtgaggccacaagcggattcccatctgtgaagtggggtgggttctcttatatatcctgtgggcccctttatgtagaggggtgctctcctctccaccacacgctgtgtgcgggttgttgaccacacagagatctcaccgtgtgctgtgccccctatctccagtatacctgtgtgaccccatatatttgtgagggagattgtcgcagcggggtatcccgtagatgtgagtgtctcccatatgtggggggtgtgagacacactgtgggctccacttctgtggcctcgtgagagagcctccttgtgagagtgcgacacacaaagtgtgtcgcgccccggagaaaagtctccccgggagagagatatctctccaaagacagagacacacccccgagagacacccggaggtatcaccctgtgcgcgagttaaccctgttgagaacatgtttgcccccgacgagggcttctcccagcaaacccgaggaggggggtttactctctcgccgggggagaagagcccccacacagtgatgtgtgaacctcctctccccaaagggtgttgttagggaagaagagccctctctaaatcaacactgtggtaccacagcggccgatacgtttgagagggagcaaaactttctccccgcgataataacccccgccgcgagacacgttttggagataatagagcgtgtg

SEQ ID NO: 724637 - DNA, 357 bp, Homo sapiens
  misc_feature (2)..(2): n is a, c, g, or t
tnaggctgaaggtcacaataataatgctgagtaaaagccaaccataaaaaatttgttttttaagacggagtctcactctgtaacccaggctggaatgcagtggcgtaatctcagctcactcactgcaacctccacctcccaggttcaagcgattctcctgcctcagcttcctgagtagctgtgaccacaggcacacaacaccatgcatggctaatattttggtaattttatagtacagaatggggtttcaacattgtaggccaggctaggtctcgaatctcctgacctcaggtgaactggcctgccttgagccttcccaaatgtgctggaataacctggcgtgtagtaaccatgctc

SEQ ID NO: 724638 - DNA, 180 bp, Homo sapiens
ggccaggcaaggagctgaggagcgctcggtggaccacgaggccttcagcctctagacttatgccctgcccccgccatccgccccacgctgtacagagtccatgaggagccgccggaccaccggggaccgactgccttcgtccagccgcggcccatccctgaggccgcctgtggccaccat

SEQ ID NO: 724639 - DNA, 176 bp, Homo sapiens
tcaagcttctaacgatgtacggggacatggtggcgtaggcgtgtaatcccagctgttcaggaggctgaggcaggagagtctcttgaacctggggggtggaggttgctgtgggccaagatcgccgcattgcacttcagctagggcaacaagagcaaaactttgtctcaaaaaaaaaa

SEQ ID NO: 724640 - DNA, 275 bp, Homo sapiens
gggcccccctatttttttgggggggaaaaaaaaaaaattttttttttttccccccgggaacccccccttttgggcggtttttgggcccccaaaaaggttttttttcccccccccaaaaccttttttgaaaccccttcaaaaaggggggccccggggggaaagggggtcccccaaagggtttccccccctttttttttggaaaaaaaaaaaacccaaaaaaacccctttttttggggggggggaaagaaaagaaaaaaatttcccttttggcctta

SEQ ID NO: 724641 - DNA, 893 bp, Homo sapiens
ggtcccacgccgggcggctgtgccgtcccgtgtgtgcagcacagctcccgccgtgtcgccggttatggtgagacgctttcctgcatgatggggtattatacacctggttttttgccggtggggtcgcattccccgctgggccgagtttgtgtgtacgccttgaaacttttccgtcggccgccagcgcgctcgttttctcgcaccttgtgcgtgagtgctgcacgactcgctggcctccctgttctggagtaatgagaggccacggttagggtggctccggggtggaccgctctctcctgtggtgggacaggggcgccctccctctgagcgtgggtgtggtcttgatggtttagccaaacctgggtagccccccctcggagctggcccatctctgctgtacaccgtctccctggtggccgttgattctttggccttcatcacaggcggttagtccagtcaggggttgccccgctgtgtcgtgtggccacttagtttcgttggaaccacttcgctctcgggccgggtgaccgctcgcacgctcgcctaccagtctctgcgccactgcgcgtggctctcggtttctctggagtacgcgccccccctccctcggcgctgtgcccttgcggtttatcgccccgtggtcttgtctgtcctccacgattttatgagggacttttttctagagtgtagagagaggaccctcagacgccgctgataattcgcgcggggccttggtcacccgcgggcttcttgcttatctttggtagaacgggcccgggccttcctcatgccttgggttgcctgcgggttctgcgagcggcaccacttttattttccttgatatgggaagcataccatttctgggctcgtggagaaaaacggcccaacatgtc

SEQ ID NO: 724642 - DNA, 836 bp, Homo sapiens
cgtttttagcgtggggtgttcttctgtgttcacgcgcgggttgttttatgtgtccggcggggccgccgggggggtggccccgggtgagtctgcgcgacggggggtgtacagcgcctggttgccccgggtgacaccgttgtggcgggctttttttaagagtacccctctggggtttttggggatcttgttgcgccaatggcctcgacgaggtgtggcccactggagttttttaacccggggttttctccaatctcgtgtgacaaaatggtgctcccacgagactttgcggccgtaatacttgcatctcccgcaggtgattctcaacgtggaacgcccccccacgggggggcaaagttttcttctccggattcacctctctctctccgctcacaccctctctggggggacccgatacaattgattcttttataattcttaacaaagggagaagcaaatgttgtcccccgtgctgtcttccccacacatatatacaggttgtaggttggggcccgcctttgaccccctagaggcgaataaacactctcgtgtggcccacaccggggagccgacccctcttgtctttattcgcttctcttcttgtggcaaccctctcttctaggacccccgcgcggtctcacgtgaacccccttgcgaatacgcaccccgctccctcatctgtggctctctagagacagaaatgtggtccgcccaccttgtttaaccaccatagataagcaggtcctcctgtcctcaccaccgagtttggagagtgtttgtccagacaaaaacaaaagagagcgggtgtttctctctgtcccaacaatatacagagaaaa

SEQ ID NO: 724643 - DNA, 309 bp, Homo sapiens
gtcgaagtagcgaattgtgccatgcactccagcctgggcaacagagcaaggctccatctcataaataaataaataaataaattgaccacaaatgtaagaatttatttcgtggactctcaagttttgttcacttagattcatcatgtcatagctcatatgctacgtaccacatagatgttaatatactattagctttatagtcaggtttcaaatatacgagttcttcaagctttgttttcttctttcaaacattgtttgtgtttaataattcatcattaagtgtaatatattgatagcggttagggttta

SEQ ID NO: 724644 - DNA, 104 bp, Homo sapiens
agtatggttcctgtcccacgccgtaccttccattcccagctcttgtgccagcaatcgagaacaccagcactttgcaaggaaagactgtccaatcacagataggg

SEQ ID NO: 724645 - DNA, 220 bp, Homo sapiens
cgagccggtacccctagttttagaagtttcaatagcacctagctatagaagtttcaatagaacagtagtaattgaagactgggtggacaaaatcagcacctgatggaaaatgaaaggtttcagcaaaagctctcgataatgttacctccaggggtaccatcatgccaccattatgggtgctacaaatctgtgaatttatttatgctatggaaacttctaa

SEQ ID NO: 724646 - DNA, 1020 bp, Homo sapiens
ctagttctagatcgcgagcgggcgtccttttttattttgttttatatcaaaatagcccgctgggatcatggtggtactagggagaagaggggaggaggggaaggtgaggcccacaagaaaaaaaaaaaaaaaaaaaaaaaaaaaaaaaaaaaaaaaaaaaaagaaaaaaaaaacaaaaagaaaaaaaaaaaaaagaagaaaaaaaaaaaaaagcaaaagagcgaaaagaaaacaaaaagaggagaaagagaaacacacagaaaacaaaaagaagaaaaagagaaaaaagagaaaaggacatacaaaagagagaaaagaacaagaagaaaaaaaagaaagaagaaaccagcaaagagacaaacgaaagaaaaagaaaaaaaagaaaaaaaggaaaaaaacaagaacgagaaaaacaacaaaagcaaaccgaaaaaaaaagaaaacaccaaaaagaaaaagaaaggtgaataagagaaagaaaaataagaaaagaaagaagaagaaaaaggataaaaaaagataacaaaaagagaaagaaaaaaaaatgagaaaaaaaagaataaaatgaaagaaaaaaagcaccagacaaaaacaaaaagcgaaaagaccaagaaaagaaaacaaccaaacggagaaacaaaagaaggagcagagaggagagaaaaagaaggacaacaacaaagcgaccaaaccacacaaaaaaaaaagaaaacaaagaaagaacaaagaagacacagacaacacgacaaaaaaaaaacaaggaaaaaaacaaaaaggaaagaaacaagaaaaaaaaaaaaaaagagacacaaggcaaaaacaaacaagcaaaggacagggggaggaagggaagaaagcagaaagaagagaaagagagggagaggaggagaggacgcgcggggaacaaggggaaggcgagaagaaagaacgaagaggaaggggaggaggaagagggaggggaagggggagggggagtgagcggaacgagacgggaaggggacaagaggagagaggaagaag

SEQ ID NO: 724647 - DNA, 113 bp, Homo sapiens
gcctgccggatatgactccccgtttcagtggaccctgtggcaggtgcttttccctatcacagggtgtttgtgtgtgtgcgcgtgtgcgtttcaataaagttgtacactttctt

SEQ ID NO: 724648 - DNA, 730 bp, Homo sapiens
gagcgtgtcatgtgcacagttttagtatgggaagatgagaaaattctggaggtggccgggcgcggtggctcacgcctgtaatcccagcactttgggaggccgaggtgggcggatcacctgaggtcgggagttcgagaccagcctgaccaacatggcaaaatcccatcactgcaaaaaatacaaaaattacctgggcgtggtggtgcatgcctgtaatcccagctacttgggagctaaggcaggagaatcacttgaacccaggaagtggcaggatcgcttgagctcaggagttaaaagaccagcccgggcaacacagagaaaccccccacctctacaaaaaactttaagattacctgggcacagtggctcacacctgtaatcccaacactttgggaggctgaggcgggaggatcatttgagcccaggaggccgaggctgcagtgagctacgattgtgctcctgtactccagcctgggccacagggtcacaccctgtctcaaaaaaaaaaaaaaaatgcagttccaaaggcgcatgggccacgtttccagtgcttgggggccatgtggggctgaccgtgcgaaaccttagagccgggggatacgtccgtacatcgaaaacgtttacctggacggccctgggactgcaggctgaccgtgaccgaggtacatcgaagccatgaccgtctgaacagcctgggcagaaagaccacccgggcttcccaactcgcggg

SEQ ID NO: 724649 - DNA, 137 bp, Homo sapiens
gtatatcctgtacaaccaaacaagttatataggtaattgtttgctatcttaatttgggttcgtattctttgatgttaccacatttggtataattgtatcgtatagctgtatagaatcatgtagtatcaaatatacga

SEQ ID NO: 724650 - DNA, 306 bp, Homo sapiens
cggagcagcatcgggcgttttatgagttgttgccctatctggtggtgggcgccgtggatgatcaggggcttccgtgggctacgctgctggagggggcgccggggtttgtgtattcgcctgacccctacagcttgcgtatcgacagcctgcctgcggtggatgatcccgccggggcggggctgaagaagggtgcgcggtggggctgttgggcattgatctgaatacgcggcggcgcaaccgtatgaatggagttgtggtacggctggcgctgatggttttgcggtggacgtgggggtaccgagctcg

SEQ ID NO: 724651 - DNA, 732 bp, Homo sapiens
tctgatgaacattcgtgaggctcgcggtgcccagtataggctaaagatgatacttgggttaatagtctgatagcgcctaggaagaattccgtaggatgatgactagtgtgttggaattctcaccaatagaaaaacgcaccggaggcaaaaccgtgatgtactgataacctcccaattggagtctgacggtcgattcctggattatgattaaacaaggtacgctacttagcagagactcgagtaattcaatattacgtctctctctgacactgaaatacaaaaacaattataacatctcaccaaagaagatacacagatgccaaaaaatttgaaaagctgtttaatagtatatgttattaggtaattacaaattaaaacaacaatgagataccactacacatctactagaatagccaaaattcaaaatgctaacaacaccaaatgctggtaaggatgtggaacaacagaaactgtcattcattgttgatgggaatgcaaaatggtttggccactttgaaagacagttttgacagtttcttgcaaaacgaaacatacttttaccatatgattcaacaatcttactcctgggtaattacccaaatgagctgaaaacttatgtccacacaaaaccctgcacatggatgttaatagcaactttattcataattggccaaaagctggaagcaatcaagatgtccttcagtaggcaaatggataaaccgtgatatatcc

SEQ ID NO: 724652 - DNA, 625 bp, Homo sapiens
gtagcgtttatcatcgaatgaagaacctaaaaaccgccacagcagaggatagtcaaagcatatgcatattgtacactcctcagattttattttaaaacggagtttgcattttccctacggaaactcaggattttacaagcaatgctctcctcagtttcaccagtactgtgtccagtactatattgctatattcacagtataacggaacgttcaatctctgagtgatccggtctatgtattaagtttctgatgaaactaacatacaccttagtcaaaaaccacaacaatccctcaatctgtttgctgtgttattgttcttgtgtgtttttctgaggcttgggtaatgaaagtacttccccactccattgtaatctgcgtttgcatctcaagtaattcattaatgtacaggagtagatgaggcctggcacacatagcagaaggtaatggttctataggtgtatcttctgtaatgcactttgggctagagaaatagaaaaatcacacgtaacaaaaacaaataactttatagagcacacgggtgtcgcgtgagtaggaccggcatacatgtagctatcatccttccccatttaacatgctcagctgtgctgcatctggggattagctt

SEQ ID NO: 724653 - DNA, 352 bp, Homo sapiens
ctatattagatccccagaacttattactctgatacctgaaaatttgtacccttggtaccaacaccgtcgtccagttgtcccgtaacccccatccccgggcgaaccgatcatgtcatctctctggcttcaagtgagtgtaacttgtttaagattccatatgtaaatgagatgatatagtatttgtctttttgtggctgatatatttcacttagcataatgacctccaggtcccatctgtgttaccacaaatggcaggatttcctgcctctcatagagctgaataatatttcattgtagatatgggacacaatgtctttgtcaactcatgtattgatagacacagtttgtttcc

SEQ ID NO: 724654 - DNA, 866 bp, Homo sapiens
attgttcaaaaattcactgtccatttttttaaaaactttaaagaatgtagctattttctgaggactggtatggtacaagaaatgtaatcaccaaattatcagatactacatgttgaaaaagtgaggatggggaaaatatgtatcagcatgaccctgatgtagaaacaccatacaagtctgcaattgaaccttggcaaaatacattacataattatttctgataaggataaatattcagctgtcatttaactgtcgtgaagaatgaaccaagtgatacatttgggctttttagatcatttgtaactaaatttgtacagaaattctcctgtgaaattaagtaaaccattttccagatcttgacctgcattgctgagatttctgcagtttgaaaaactcctctcaaatcctctcaggatcttccgtcatatttatctccttctaacaaatatatttaactataaaattaccattcagtagttagactcttcataatgccgcaaatggatgcgccttgacttgtataagaaccacatgagtctctcagcttacaccattcttgaacctaatagtgtatgtccgcaatttcgtcattcattcgtcgccttcgacggcaactctctctgcacctatgtcacttgctgatgtcatcctgccttcgtggttcagacttcgctcatccgctctccactccactctctgcccgtccccgtccgctctgacgttgtgtaccgacaggcagcaggtacacgtcttgcgtgccacctctttggtcccggtttgctcactcctgcccacgcatcgcttcctttctccacatgcgctctccgctcacccgttttctcccccgattctacacgcccaccccg

SEQ ID NO: 724655 - DNA, 222 bp, Homo sapiens
gctttctattagctcttagtaagattacacatgcaagcattcccgtttccagtgagttcaccctcttaaataaccaggttcaaaaaggccaaaggaataaggaccggagccattccggttttaaacggtttggcctggcacaaccccacaggggaacaacagtgtttttaccctttgcgcaaataaagcgagtttttactctaaatctatatctacccccga

SEQ ID NO: 724656 - DNA, 356 bp, Homo sapiens
tagtactagatcgcgagcggcgcctattttttttttttgacaaaaccgacagctggtaaagggaaatttaggtggctctctagctaacgaggttgaaccagacagcaggcggacccggacggcaatgcccgagctaatgccacgactacacgatagggaccactagatcgacagaaaagctgccctacagcgtagagccacgactttcgacgggatacctctacgagcggccgcccgttcgcaggagagaaacccaccgcagcgtgggagcgcagggacacacgccaccaaaaacgagagcggcgacaccagacaacagggcaacaaaagacgaccacgcacaaacgcccagaaaa

SEQ ID NO: 724657 - DNA, 1535 bp, Homo sapiens
  misc_feature (1)..(1): n is a, c, g, or t
nggtggatacctcctctcttgtgtgcgtgcccccccctctgtgtgtagtgggggtgctcgcccgcccttcgtggggtgggcgtcctctctattatgagtctgtttgggagaaagggggttttcgtttttgaggagaagagccttgtggagagtgtggcagcacgccaccttgttgggcgggtgtccacggtcggtggttgtgtgaagagaatatgggtggctcaaccgtgggcataatcgttgtccggcttgtgggggggaaggcgccacatataatatgggcgtccccatctcttgtgagaacggcgcgtttctccatctctcgctgtatgaagaggaggggttgcatcacgtcgggggaagaccatcgttgggtgaagagggagaacccccccggctgttggttgtgttgttggggggcttgtggggagttgtgtggagtccccacccatcagcgccatcatggggattttttcttcttgggggggcgcccacccacgaggggtcgctcggccccaagcagatggttgggaggaggatggctccaacccggcgacaggaggatgggcccgcgggttttgtgtggatggacgacaagcgattctcctttggcgactacgagcgccgcagctacaaccgacacgacgaggggtgtaatgcgacaggcgtgtttgttcttgttggcggtggcgccgcctcgtgtgcaacgggcggcagcctgcaagagggggcggctctgtctctgcgccctactttgctgtgcgcagcacgcccccctgtgtggagctctctcactgtcgtcgctactgtggagagaggaccccctgctgggtgtgcccttcgggggcgtgtctttgtgtggggacacaccgctctgggtgagacacagagagcacacacgcgcaacagagtgtcggggagacacacacgcaacagagaagacacacactaggggcacggacacaaagaggcccctcgggggggcgcccacactatgcgtgcgcgcactgtctgggtgtcacacacacaggggggcgctggagaggtgtccacacgcgagaagtgggggccacacaaagggtagagagccacagatgtccccgctgtgtctctcgagacactctcacgcacggcacagcctctccacaacacaccagagggtctccacaagaacctaagggtcacatggaacgaagaatgggagaaggcccccagggagagaaagggaataaaccctaccacacccacgagctccccgggcgtggagacacatgcgtgagacgtggccttgtcccccccacgcctcttggcctctgggttttttaagcctattttaacctgcacagggtgagagccacacttttttccctctttccccacgcactcacactccccaaggagaagagagcccaatggtttccacacccactaaatcctctttctgccgacccctagttccctttggtcagacccaggcttgttatcagctttcagggccctgggtccaccttagaattaaaggtagtaaattagaa

SEQ ID NO: 724658 - DNA, 98 bp, Homo sapiens
tcaacaacctgtccagtgcccgcctgcagcagatgagcgaacgcttcctgcaccacacgtggaccctagtttaataaagattcaccaagtttcacgca

SEQ ID NO: 724659 - DNA, 381 bp, Homo sapiens
aattagccgacgcttggtcatggtgtatacagatgctatgaacattggggagcatgtatcttttccaattatggatttctctggatatatgactaggagtgggattgctagatcctatgatagttctgttcttacttttttgaggaccctccaatacatgttttccataagtggttataccataaatttctgttattttaacgccatcacagtctgtagctattttgttacacgtagctccaggaagctaacagagggtcccgagataagaaggggcttccacggaaaacgagggcgttgtggctttggtgccagggaccacctgtttcctggggtggacctctcactgcacagatcacgatctggccgtcgggtaatttt

SEQ ID NO: 724660 - DNA, 297 bp, Homo sapiens
  misc_feature (19)..(19): n is a, c, g, or t
  misc_feature (74)..(74): n is a, c, g, or t
  misc_feature (86)..(86): n is a, c, g, or t
  misc_feature (103)..(103): n is a, c, g, or t
  misc_feature (115)..(115): n is a, c, g, or t
  misc_feature (132)..(132): n is a, c, g, or t
  misc_feature (143)..(143): n is a, c, g, or t
  misc_feature (223)..(223): n is a, c, g, or t
ccatcaggggccctcatancgggagtagagtccctggtgctttcataagagggagaggtacttgcgttgtatcncgcaagcagagngttctctttggttttgnggttgaagtgcnttggcccatttgtaagnccccatccctnccctacacaaagtaaaagcagaagatagataaaaaatgatgtaattgcagctggtaggatgtctggtgccaatcccaggnagtgagagccatttcttttgtaccggatttaatgactttgaactgtgctgtaaataaataatacagctggcctt

SEQ ID NO: 724661 - DNA, 285 bp, Homo sapiens
  misc_feature (12)..(12): n is a, c, g, or t
  misc_feature (38)..(38): n is a, c, g, or t
ctatggcttcgncctgtaatcccagtactttgggaggncgaggtggcaggatcgcttgaagccaggactttgagatccagcctgtgcagcatggcgagaccccatgtctacaaaaagtagatttttaaaaagcccggtgtggcggtgcatgcctgtagtaccagctactggggaggctggggtgggaggatcacctgagcccaggaggtcaaggctgcagtgagttgtgttcacgccactctactccatcctgggtgacaaagcgagacactgtctcaaaaaaaa

SEQ ID NO: 724662 - DNA, 904 bp, Homo sapiens
atggtggttgcacgtgccggcgaggcgcatgcccagcgcctcgccatcgagagcgccgtaaccgccggtaactcactggaaccggggcttgcgaaggatctggtaaacgcgttgtgcggcctgtacctcctcgactacctgaacaaacacgcggcctggtatatgagcgaaggccttatggacagcacgcgctaccgtgcaatggaggaacacctcaaccaacacagcgacttcctggccacccacgtcgcgctgttgatcgacgccttcggccagggtgatgcgagccgcgccgcaatcgccagtgctgacgcttacccggacgctctggctgccaagctgcaatgggcgcaaggctgaacctcacaactcacctgaaccgtgagggccatggcgtacgaagaattggtgaacatttcccagacattcattttcacttgggccttatcaaacttccggatcctcgtcgggcacctaggcaatggacaacatatttccatccaggagccgccccatgtcccgcacgctagacaccctgtcgcgccccagcctgttagccgtggcatcgccctcagtgccccgctggccagccttttgctgatcgacgacgagcaagcgtacagcgtgcgcgcctacaacctggccagcgcgcctttgggccagcacccttgaaccagatcgccagcaaggcgggcctcgcgctgaccttcagccggcgctggcctcgggcaagacctcggacccgtgtccgggcccacgtcgactgcgcccgggctctgcgtgcggccctgcgccgaaccggcctaacttgcaccacggcggcccggactcaccgtcggtgccacccgacaggctacggccctgcgtgctacatatccgcgccgcaccgcccggaagtcctgcg

SEQ ID NO: 724663 - DNA, 389 bp, Homo sapiens
  misc_feature (213)..(213): n is a, c, g, or t
tttatgtaaataataaatgttttaaaattgttacaatatattattttgagttatttcatttatatttcatttacctagcaaaatataggtttttttttctttaaaaaaacattaaatattaaaataactatatttaaataaataatgttatgatgatgatatttaaaagcttagttattaggttgacgtcttcttttaatgtgcacggttttnggtctttggttggtatacttgggaagggctagcggtttttttcttgaggagctgggtgaggaggtgcagggacctccctctctcattccctcacccccgtcctgtcctcattttccgtagaggagtcagcctcaggattgggttcggttctgaaaggtcagggacatttcctacca

SEQ ID NO: 724664 - DNA, 880 bp, Homo sapiens
gcttaacaatgaacaagatattcgaaagagatcggaggactgactcaaaactccatacctctcatctttaagctccctcaccattggcagcctagcattacgacagtgatatacctttcctcacaggtttctactccctaatgaccacattcatcggaaatcccgaaaaggctatatcgattagcatcataatctgcctgaagccctagtctattactctcattcgcgtagcctcccttgacgaatgcgcctagtatgctacttctgaataattcatttctctaccgctaacaaggtcaaccatctgcgttcccctagcctataggatagctattcaaacgagctagtaagcacgccacctcctaattaaaaacctcactattcagaacctggccttgtagcgatgtcaccggaaagaccctatgtaccgcgagcggattgtactcaatgtaacatagaacaaggcatttttcctcgaccggcaatcgcacgcactgttgcctagagacacacgaatccctcccatctaccctaaaagagttcagaaggccctcgtctggtggcgttgtccttatgggaacttctaggcagacccctaggacctcaaagctaacctggaggcaacaaaatcgttacagaataaaaatcgcccgactatggcatcgagttttaattttgctcgcaactatatgtcgggattcctgaccgcttacacatgctacatcaccgggacaaattcccccttatctaagggcccttctttaacggagaccgaaaaagctgtcccctctactcccctccttatagccttgaaccttgaacttagcaagagagctaatctaacctcaacaacgaaatttttcaacaggctaatcccaaa

SEQ ID NO: 724665 - DNA, 537 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttatggccgggctcacttaacattacaacactgaagctttctagcaaggtaagggagtacatttccttctacactttgccaacaccaattaatttgactctgtttactcttttccaacttgtcaaaaaatgacacctcacttttatttgtgcatttttgttgattagtgaggctgagacatatttcatatcacatgtttactagccctttgtatttctttctttgaactaatttaccaattcctttgtcaattttttgattagtctgtcttatcttcttgaggtctaaggatttttttacatatgctaaagttattatattctgccttctttttctaatttgtcattttaaaaatcttgtttggggtttatagagtttcctgaatatgcggcttgatatctcttgtcagttttggaaaattctctgccattatcttgtcaaatattgtttttgttccaatccctttttcttcctatcctgtgacaccaaattcacacacattagaccttttataccatgctgcctg

SEQ ID NO: 724666 - DNA, 870 bp, Homo sapiens
gggctctcgtcttcctaggtgccctgactcctcgtttcatgactggtgttcaacctagtctactacacgctaacactcttccgagctactacgcgtccattcccctgagtagatggtgcagtcgaggtctgctaagtaggttaagtctgtgggcagtcctcacagtaagcgagctccgggaaggtgtcactgctcgagtcttcactccttacagagagcagtccctctctctgctgcagcttggacgaccgctcgcgtgacggatgagaccaggctctcaggcttcttcagacatgatggtcgcggaggcggtctctcccggtgtctgctgcggctgggtccgatcaagcctacgcagacaagtgtgtgtgtggaccatcgcgcacctccagcccctcatccccacctctcttgtgtctcagcgtgttatggtgcatactgaccgtactttaaggtacaacccattccaactacagcatgttcagggttgatccaagcactgcctccctcctgctctgtccaggtggtctggacctataaactcaacttgagagggaaggcttaggggttgaggacttcgtgatcagagatatctcgaagatcggaagctatggggccggagctcattgagacatgagtcctcagctctgtgtcctgagcccgtgtcatttctccaacctacctgcccccacacagttatctcagacactgacagccatgtggtcatggaggtcccagcgcgccaccctaaaaagcttataccgtgagaagctccaccagacttgggagcaccaagtgcagtgcctggtgatgctcccatctgccgccccccttctctcctgcaatactctgtaggcactggactgtcgg

SEQ ID NO: 724667 - DNA, 308 bp, Homo sapiens
aagcattggcagattacatcagtgcaacaaaggaagtgaccccattcaagaaagttcgggacttagcagaaaatcaccactctgttgatcgcagcaaaagaaatatcattggatattctgagcagcaggactcggacaaactatagagttatagaccgagtagcgaatatttggcatgatgactgtgcctttctttctgcattcggggatgtctcaaaaccggaaagatatcgtggcgacaacataatctacaaaccaacagggcattctgctccggatatggtgtacttgggtactacgcttaggca

SEQ ID NO: 724668 - DNA, 258 bp, Homo sapiens
attgatagcacgcacagagtcttgtatatctgaatacagtctttatcaggttcatgattgtaagtatattctcccattccatggctgtcttctacttttcttaatgggccgggcgcggtggctcacagctgtaatcccagcacttagggaggccaaggcaggtggatcacctgaggtcaggagttcaggaccagcctggccaacctggcgaaaccctgtctctactaaaaatacagaaattagctgggtgtggtggcg

SEQ ID NO: 724669 - DNA, 132 bp, Homo sapiens
gatcccctcttgactctgagctcaggtatcgcctgcctcggcctccccaaggtgctggatttacagagtccactgtgtccacccacgtggtgcctctggttaatttaatgacccttgttatccattaacgtt

SEQ ID NO: 724670 - DNA, 1631 bp, Homo sapiens
  misc_feature (1)..(1): n is a, c, g, or t
ncctcgtactgcacgtattgagtacgtaatgaatacgcagtctgccgtgtgcgtcctccttcacggcttcgtagcctcgtctctggtgttgttcagctacttacgcttgtatatggttggattctctcctcctcgctgtgctggtgtggtttcttctctcttgtggttgccgcactaatatcatgctcgtgggtggtcttctcccacgctgtctcacacccgcggacgggcaatcactctttgtgtttgactaaaatgaagggagcggacggccagactccctcttcaatggagcgtacttactatttctggcgccccccaccacttggttggcccaccccccggggggaagcccccgtttggttgttgcgccgacccacaacgggccggtgtggctccacagaagtttgttcgcgcagccagtgactgccggaactgggtgcgaagacgaacacttgtgtgggcaccgccgcgacgcttgggtgttgttccccccgccgccccgatgagattaggccgactttgttggaaagaccctgttatagaatgcccccctttgttggtcacctctccgcgccgctgtgttatagtcccccatcccagcggcgcccgagccaagaccccacgtgggaccccctcttgatgttcacagggtgtacacccacggaaagggattttttggggaacaacaccatgtggcgaagtcaacccccagccccaagctttgatatacgggaccattgcccacaaggccccacccgaggggtcttaatgttattgctccacaaaaaggaagtgtttccccctttgtgcgccaacagaacacattggaccggggacatttttggggcaccaaagtgggaggagggatacccccccttttaaagagggagaatttacttatagttgagaattaatccccggggaaaaccatgtgttagacaccccccccatagggtttaccccttgtaaccccacacaacccatgggaatacattctcatggcccccccagaataaggcgatatgtatatgtgtccctcgtgcacccaaagagaaaagcgcctcgttggaaagaaacctcatgaaccaccctcgtgtgttttaatatctccccacaagcccacttatagcctttctccctctgccactacgaagggaaaccccgccccctcttttgtggttttgaaccacttggctgggctctgtggcgccacaaccactttcgccacttggaaccacacaagttctccacctaagcgcacatgctcgttggaccactcgaggtcctcgaccacacagaaagaaaaatgagaagctccacaaagtccacaaaattcttcgctgagaaaacgcgaagtttggccttctcacttctccacgtggatatatcccttccccacaaagggaacccacgggccaggcttattctttgtgtccaaaccggaagaagtcacaccccacctcgtgtggaaaaccagatagctctcgacagttgccagtacttacccctggctaagaactgccctgctttgtttataggactcgccagacccaggagcgagctttttctccgagcctgcttttcctttatttaaattactgatgccagaaaaaaaaggaaaaataaaa

SEQ ID NO: 724671 - DNA, 196 bp, Homo sapiens
  misc_feature (26)..(26): n is a, c, g, or t
  misc_feature (146)..(146): n is a, c, g, or t
  misc_feature (155)..(155): n is a, c, g, or t
ctcggcaccccttgtgattacttgcnaaataaggcttatgcttttgaaagatcaagacttatgaaatttggctccagtatgtatgtccaacttatcttggaccttgtggtaaatgtgaccgttacacttcacctcctccccattgnaccccactntacacactatgccagaagctctttgaagaagtcaattccaa

SEQ ID NO: 724672 - DNA, 250 bp, Homo sapiens
  misc_feature (4)..(4): n is a, c, g, or t
cgcnaggtcacttcaggctgagcgtgaatggcgatagcaacacgttgaccagcagcagcgcatacacgatcacgatggctgcggggatgaccacgggcggccgataaggcgggtaggcgcgtcgacggcgccagaggactccagccgtagttcctgtgatgaccagtgccagcaaggcgctggcccacgccagtgatgcaggtccggactcgtcggcattggtcgccgtgtccgaatcggtcagcgagat

SEQ ID NO: 724673 - DNA, 234 bp, Homo sapiens
ctaacctctaactcctcctaccatggcagaccacaggcctacagcattctcctcagtgggaaagacatcagcttggacaaccactatggaaaagccaacgttatcctagaaaagcttattaaatgacccagcaggacaagtctccggatggccttggcaaaaccggatgcttccctcttttcttggttgtagttctcagacataactagagaatgtactgggagtgttgtccgg

SEQ ID NO: 724674 - DNA, 248 bp, Homo sapiens
acagaaatagtatacaagtcagtgtgatgaaaactatattaacaacaggaaatgaaatacaataaactatacacaaaatactcactgctacatatcactaaataaaataaatagaatggtcaagatactaacacatacccaaaataccagagatccaatatgtgcctatccataatgaagagtacttaaattgttatagatacataccttccactaggcacaaaatatcacaggtcattccgcaaaag

SEQ ID NO: 724675 - DNA, 250 bp, Homo sapiens
atttgtctctcctgaacagctcctttttaaagccttttatcttgttgatggtctgcaaacaacaccagaacgtgcgtagcacctccatgtacatgacattcctggctctgattaggcctcagcggccccacccccagggaacctgcagagacttcggccgctcactccgctggcatgggggaggcagtgtgtgctgctccaccctgcgtttcagtttaggagactgaacatccaacgctgttgacaatca

SEQ ID NO: 724676 - DNA, 782 bp, Homo sapiens
tcaacttctctgacaagctagggcggcaggtcatcaggcaccagaaggatttgccagcagtagggctcctggatcagcgatatgcccgggcccctgtcctgggcaagcgtgccggcctggatccgagcccgtgtggaggtcaaagctaccttggggcccgccattgctgctgtgcggaagtttcaccggggagagagtcgggctcttgctgatgggcaaccacagcactgtcctggcgccgtgcccttcctttgtcgctgcccgctggagacagtgttcgtcgtgggcgtggtctgctggggatcctgttacggaacggtgaacagccaggaggagagtgtggagtccagcagtcgctggcaggtacccagggcacaggcgttacgctccgcgtaggagaaaatgggggaatccgtgatagtgaacagtgggtcctgtgctgtccttggggcgttccagggctagatcccctcctggaatagaatctttactttccactgctgctatggctgagagccaggttccttcctggtctccgtgggagggtgtgggcgctgtggtgtccacctgtggcatctacgctcctgaccagcttcttaagaggcgagatggtgcgggcccatcttggctctgccgttttaagccgaggttttaggtgccctggaatggttcatcccgggtgcaatttaaatggtccttgggcccgggtcctggcggggttgtccttcctacatctcgggtcaccctcgaagggcgggccattcgccaagcgcggttgtcgg

SEQ ID NO: 724677 - DNA, 350 bp, Homo sapiens
gctattgagattgccagagggtcaagagagaattggggaggaggcggtcaagctgctgtaggaaacaccacaggctgaacgggggaggaatgtcacattccacgctgtggtgtcccggtctcggggaggcagctcagctcttatgagcaagttgtgggggcttttcaagaggggccaggcttcctggagggtgactgatgtggctgaagcaggtgtcccggcaggtatgctgcagccaggagctccctgtggaccgcaggagctctgtggtactcttgccttagattttacacacactccacaggcaagcactgtcacggtcctccaggagctgggaagcaaaggcgcag

SEQ ID NO: 724678 - DNA, 144 bp, Homo sapiens
  misc_feature (43)..(43): n is a, c, g, or t
  misc_feature (54)..(54): n is a, c, g, or t
  misc_feature (82)..(82): n is a, c, g, or t
gaggatcccagtggcagatgtgctacacacaggatctagaagnatatgtcaaantataaacggctgtgatgtgaatgacttngttcttggcttgtgtttttcaatttcctataatgcacattcttccaatacacattctccaat

SEQ ID NO: 724679 - DNA, 1900 bp, Homo sapiens
tttcctaagcattgaaatggcaagtgcaaccaaaagtaggtatattcgtgacttcttgtttaggtctctgggccaggaaattcatactgttacatggataaggttgggattggggagagggaacagttgggactagaagcaaaagtgattctgggactaaaataggaagcagatgtcctttcccaatgtgtgttgctgtcttcacctgaatgcatttgtgtaaaaatagcggagggacaatgtgaacatttgtatttggaagctatgaatttactctgaagtttgcagttgtttccaatttgtgagctctaagagtttctgcctgtaagaactactctccttttattttgatttttaaaaacctgtctgaatttcacactcttagagcctggaagagccctgaaaagacacaagtcttgcctggctactgctttttaactttgagggctctatgttgacagactgttatctcctctgggtgacctcaaacatctgaaaagaaagatgttgcctgtgccaattccactttttccagctgccccttgatgaacactcccttataccagaccactctaggacttctgactggtgtcatcaagtcctcagaaaatattttaagttattttaagttattaaggaagggatgatttggagacaaggagtaatgaaagatgggtaaaaactggaaaagattctggtgctaagtactaccccttcatcttccatggatggtcattacctttcctgtcctcctgttctatgaacacacacacacacacacacaccccacatttcaataagtcttcattgttctgggtccttacctttcctgtcctcctgttatatgaacacacacacacacacacacacacacacacacgcacacacataccacatttcaataagtcttcattgttctgggtccttacctttcctgtcctcctgttatatgaacacacacacacacacacacacacacgcacaccacatttcaatgtctgcatggttctgggggtaacaaaggcaagaagttaaagtaagaccacatttgagtattacttactctgtagaatcaaaacagagtagttaacaccaattatgcaaactacttttttttccagcagaaagggagctgacatgatcaaatccatgttttcaaatgaactgaaaaaggcatccagcaccacttataacacatttatttcagttccaggctgacagccctggggcatctagcaggatgcataattgtcatctggtgagagttgggactttgctcaattttaataccaatctctcctgattgtaattacctccactactttcatgatccccctacaatatttttttaaatgatatatttattcactgaatcaaatgtcattaatgagttatcttctgtggaggatgactgttctctttgttaatgttcacaatcaagatcttgggctgagaagaggcccttcacccaaggagtttgaagtatcacagcgtgtgggaaggtgggaaccaggatacccattcatttccaaccgagacacagagaagtgagtcacagaatttgagcctgctctcttgactgcccagccagagacactgatttctgtaacctcttcacttgatcctgcctcttaagcattaaaacattctcctaaacctctgagtgttttgtgggttctgggtgttttgtacattttagccaagctaaccacttgtctgcaagtactgactttcctatgaattctttgaagattattgagtcagaaaggaaaaatatagccccaaattcccaggcttttaatgcattacattaactgcctattgaaatgagaagttcttcacaaacttgtatacccactaacaagattgcacataaacatgcattaaagtatatactaag

SEQ ID NO: 724680 - DNA, 394 bp, Homo sapiens
atggcagaaagactgaaaaataacagtaattaattgtgtaattcagaatacataccaaccagtgtagaaactcaaacatagcaaagtgggtggcatattccggggttaacactttttttagcgttggtacatctgagaaatgagtgctcaggtggatattatcctcgcaagcatgtagttataagaattgtgggtgtgcctatcataacaattgttttctgtatcttgaaaaagtattctccacattttaaatgttttatattagagaattctttaatgcacactcgtcaaatatatatatatagtaccaatgttacctttttatttttgggtatagatgtaaggagcatgctcatatgttaggtacttacataaattggtacatattacgggt

SEQ ID NO: 724681 - DNA, 250 bp, Homo sapiens
agaatgataccctagacactagtaaagacatattcttgcatatactgtctactccagagtataaaagatatgtacaactctatcactatgtaaggcgcagtctatttattggatgagcataagagaaagatatacctgtagcaaccggaaagttttacggtctttcaagttgtataaaatggacctgcagaaatgtttaagtgttctcaggatacagagttgaagctagaaatgtgacaatcaaaccagt

SEQ ID NO: 724682 - DNA, 533 bp, Homo sapiens
  misc_feature (303)..(303): n is a, c, g, or t
  misc_feature (313)..(313): n is a, c, g, or t
  misc_feature (329)..(329): n is a, c, g, or t
  misc_feature (334)..(334): n is a, c, g, or t
  misc_feature (449)..(449): n is a, c, g, or t
ctggggcactttgatcacctcggtgagcggacactgggacactatgatgaggccaggtgagtgcacactgcggtactatgatgagtccaggtgagcgcacactgggacactatgatgaggctaggtgagcgcacactgggacagtatgttgaggccaggtgagcgcacactggggcactatgatgaggctaggtgattgcacactgggacactatgatgaggctaggtgagtgcacactgcgacactatgatgaggctggatgagcgcaccctgggacactatgatgaggctaggtgagtgcncactgggacnctatgatgaggctagntgagngcacactgggacactatgatgaggctaggtgagcgcacactgggacactatgatgaggctaggtgagcgcacactgggacactatgatgaggccaggtgagtgcacactggtcantataatgaggccaggtgagtgtacactggggcactatgatgaagctgggtgagcacacactgggacactatcatgaggctaggt

SEQ ID NO: 724683 - DNA, 126 bp, Homo sapiens
gcatgcccataactcacatactggcctcaataggaccacagtcacgacgatcacagtctatgcagtagccacccaaacccttcagtcagcagcatacaactccaaccccgtggagagatgaggatg

SEQ ID NO: 724684 - DNA, 230 bp, Homo sapiens
cgaatgtatcctgttgggttggttcacctctatagaacatactgttgtaatgtatcctgtcgggatggttcacctcgggagaacatactgaagtactgtatcctgcagcagagtgcacctctacagaacatactcgagtactgcatccagttagtatgtctcgcctgtatagctcattcggctgcactcgagcaatggatcatgcggttctgcaacacccctatagacca

SEQ ID NO: 724685 - DNA, 777 bp, Homo sapiens
gccaagagtgatgcatgttctgaatgctgataccattgtagtgaaactgaactcgaagctcattgacaatgaccgattcacctgtccagtcgatccgaccaccgaggactgtgcaatgtgggacgaacacccaggtataacgaacaaaaaagctgcttaccctgtatgacattcgttacatgttggaggcccgggaattttctatcataataaagagcttatgggggaacgaaggtcgaactgtgaacggctgcgactaccatatagacctacgcccaggccctagccacacgagaccaagtgccttgttctttatcagagctgtagcttggtgtcacatgtcatcaattgcgaggactaaacgattgcatgaggctcctctgtctggcgaaaggctcttagcacatccggtgaatccatatactcgggctaggattgatgaccagagatcatcatactacggatgaacttgctttgtgtggctcgagtgccaatagctgcttatcgaatggacaatcggagttgccctagcaggatacggcagtggcatatccaccgctcgatagcggggatatatctgggcgagtaccctatagcaaggcccaagcagatcctggctcttctatcaggggcccaggtcggccactgaaagctagtgggttggaatcatcgtctgcaggtggttctcgactggcctctattttgccggaatcgacaggttgccgttatcaaacctacttgcgttgggggcatttgattggcccaaagagccggaga

SEQ ID NO: 724686 - DNA, 164 bp, Homo sapiens
tgcacgagggcaatgtgtgtggagggaaacatgggaagcctttgaacctgtatctatacatttgctaacttgggaccaggatgtgagttcaaatcatttcactgacatataacgcatatcttttgtgtaatgaattaggcccaaagagctttcggttctcttcg

SEQ ID NO: 724687 - DNA, 364 bp, Homo sapiens
ccgcactctcggaattaagatggtctgtggttcgtgctccacaggcacacattcacctcggtcagccatggtaaatatggagtcctcaggaatgcccacactgtgggcaaccactctgaagtcccacagaagagtttccctcagttgcggcgcccgcctgtagagcttgccagtaatggtgggtccataatggcggctgaatttcttggtcaggaaaatggcatactcatcatagttggtgtggcccacataggactccatgctcataagctacagagtgtctcctcacagacacctttccgacaaagagtgctggtcacgctgatctccgcctgtgtagcgccctctcacagcaacagcgtgc

SEQ ID NO: 724688 - DNA, 276 bp, Homo sapiens
ctggacttcccctggttcccggcccgcgtggtgtgccacgacattcttggccagaccgcactggtggacctggccggcctgcgtgacgccatcgccgaccagggcggtgacccggcgctggtcaacccggtagtgccgacccagttgatcgtcgaccactccctggccgtggagtgcggcggtttcgacccggacgccttcgacaagaaccgcgccatcgaagatcggcgcaacgaagaccgcttccacttcatcaactggaccaagaaggccttc

SEQ ID NO: 724689 - DNA, 315 bp, Homo sapiens
ctagctaggttctgatctaacttaagttggatgtcccacatagtatttgcgctacgaagcttctaagcccttgggcaattatagtagggtttaacctatttgccttcccaagtctaaatgttaaacaaacttgaaagtccaaagtcttgtttgaaaatgcacccatgaaagctttgaagtgaaagctctttcctggggaacaatgtgggccttcaatgtaaagaacgtgtcggtcaaagatgttagacgaggcaatgttgctggtgacacaaaaacgacccaccaatggaaagcagctggcttcactttctcagg

SEQ ID NO: 724690 - DNA, 689 bp, Homo sapiens
ctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagttgggatgtttttcagatgagtaaaggaccaggtgaagatgttgaacattctatgatctgaaacatcttaacacataaatacacccacaatatctatacgaaccgacataaacaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggagttagaagctactggggaaaatctacctccgacaagaggagatcattttagatattaccgaaatgaagaaagctgcaattagtgacatgaatggaaataaattc

SEQ ID NO: 724691 - DNA, 385 bp, Homo sapiens
tgtgatctagaggatcccgaggctgggcgagtggctgtgttgctgttgcaggcagtgcattgctagcgacagcccccaggtaaataaaggctggtacggaggagagctctgactggtcaactggtatctgcatggcggaaaagtgaggatgaacctggcagttggggagagcacacaggctcctatgagggagctgcctccaggaggactgtggggatgaggggacaggcagtgtgtaactgacagatgtcacgactccaagaagtccacaacaattcagtgacgaccggtactcacagttaaacgaaacctacgtcataataaccatgaggtgctgtgtcacaacaggatgaaacgatgtgctttctgtcctgttttgtctcct

SEQ ID NO: 724692 - DNA, 102 bp, Homo sapiens
caaactataatatatccctatcttgggggtgtctcagctctgcaagaaaggaaatagatttactgttagaggaactgataaccaactttaccagattgcgaa

SEQ ID NO: 724693 - DNA, 1538 bp, Homo sapiens
tcgccgccataatggcgtcgcatgacatgtctcccgggaagggcctgtgccagtcggacttaaccctatacgagctcagcgtccccacttggttgacgcttgacatctgacgagcagtgaagtgacgacagatctcacagagactggtcctaaggaaagggcctgtatgtcctatcacagcatcgtggagtaaatccctgtagcagattacaacagtaggtgcttagcgacagcagtacgctcaagctgacatggacaactcacccagtctcctaacgcaacgtatcgtaaccgctcctatgagcggcacctctgtgctcgcatggatgcgtctaccctgaaggcactcatcatacgcattcactacactctaacgcatcagccacgctatgcatgatgtcggcagcacgcccactcctgtgcagacgcgagagcacgcagaacgggaatacacgagcacgtgcctacacagcttgcacggcctcgggaaagtacctaaactcaccacggacgtcgcccgcgcacgttccacgccgtcacccgggagccgccggactactccactacacgcatcccacagctcgcaaggcaagcgctccgcgtccccaaagtccgggcaaccactacttgcaaagtatcgactccattaaccaaggcacgcatctatggcgccccccgtgacgctgcagccacgttaacaccctttctggctccatgcttgggttaccttcgacaactcggatacttacctacactcgcaatcctggcctccaactacacctgaccatctttgccacacgaacctgcactgcacccgaggcccgcctccccgccccccccaacgcgaaaccatgcccccccgacagcacgggccgaccccccgaaccacccacacctgccgagtcccacgcaacacccctgccccacgctacccagcccgcggcaggccccccataacaaaccgggcagcgccgcgcacccactaaccccacaacgcgccctttggcccacctaggccctgaaccaaccacccggccccccccgccacacaaaccggcccacccggggcgacccccccgccgcaccgcacccccctacctcgccgcccccgcaccacccccccaccgcgcaccccagccaacgcgccccccacaccaagccccccaccccgcccacacccaacgcccccccacgcccacaccccggcccccccccaccagcgcccctcccacaccaccgaccaacacccgccccccgccacacacaccgacacccaacatcgaccacccaaaactaacatagaaaccgacccgcgcgcgacgcacacacccaaactccacccggacctccctcactagacggccgccgcaccctgaaacaccctcgcgcccacacgacccgacatcccgcactacgacgccgtcccccgactccgaccgctccacccgccgcagcaccgtgcgactgcgtgtgaatcatcttagtgagtagagaggggcagaaggagaggaggagaaagaagtaggaagacgatgtgt

SEQ ID NO: 724694 - DNA, 229 bp, Homo sapiens
gtgcttctgcattcctatttagactggccagccgtggctttggcgtcttgtggcgttgtctgtgtgggtttttggttactacttacgtgctgtgaccgaagagcgtcatctgtccgggactgaccctgattacttgacatatatgcaatctgtgccttaccgttttattcctcgcatcttttgaagattattcatttggaactggctgaatgttttaatcgattcagag

SEQ ID NO: 724695 - DNA, 123 bp, Homo sapiens
atccctcgtctgcgtccggacccatctacgctgaggacggagaccgcggatcaaccagcccatcatctacagcatctttaggggaaacgtgaatggtacattcatcatccacccagactcggg

SEQ ID NO: 724696 - DNA, 270 bp, Homo sapiens
actacccaacaaacaaaccccctaaaccaaaaccaccctgtgaccaaaatacccccgagtccaggaattgctgtaaacaaacccatatgcaggatcaacccttctcagcggaagtcggatctgacggcagtttactgcagtatcagttctctaagcaggggcttgcgggagtgggcaccaagagggccaggctgccaatgcttgtctcgtgatatttacctggagctgcagacctgggggttgcccatcctcaagaaggctgaccttttt

SEQ ID NO: 724697 - DNA, 1512 bp, Homo sapiens
  misc_feature (245)..(245): n is a, c, g, or t
  misc_feature (1003)..(1003): n is a, c, g, or t
  misc_feature (1283)..(1283): n is a, c, g, or t
ccggcgattatcactctttttacccgccgggctccgttgtgtgcatcccctgggcctttttctggtgtgcgcactctatgggcggacagagtggtgtgtgccacccgaaacagaaggccgctgggttgtgatccctccgtccgcgatatttttccccggcgggactttttctgcgtcgacacccctcaagcggttgtctcctgcccccttctttccccccgcggcggggctcgcttttccccggncgttacacgcccgccccttctccgttcttccgcgaatttttttcacgaggccttcctggtgttcctacagacaccattggccgcgcccgtttcggtagttgtgttgtctcccgccttctcgatggtcgcccattccatgtgagtttatttttaccccgggggacccttcctattccaagccccccgggattggaagagaatggtttctttcccgaaaccatgtcgtaccacagaattccccgggggagaattcccccccggaaccggggtttgtgtcccccttgtggaggttggaagaggggaaaaagattggggtccaaacttaggggaccaacagaaaggagtaaaaacccattggatgaacctcgcctgtcaacttgcgttgggaaaaatggccctccccgctctgaaagggcccccccccgaagggggtcgcacaaagtgttatccccgcaaaaggcacacccgctaaaatacacactcgggtgttcagagataattgtgctccacatggagaacccacttgcacacgctcgccacaggggaaacaccccagtgtgtccacacacacaaaggaggaaggcgctcactcacacagagagagtgaacactctcacacagagagtttaaacactcgagagagtctcacagttgtcaaaaggggggagaaaactctgagaaagagacacacagaggagccccacgagaagagagagtgataaaacaccccgttttatatgaccaacgcgggggctcgncacgaggacacacacaattcacaagcacacacatcccctctgggctataatgtctgcacacaaaaaatctatccccacgctttttcttatattgtggtgtagaaacacacatgagaattccacgagatggcacatcgggttggcttctatattggagactacccgctgagggagatgcgtgttgagcccccacataataatgagattttcttttataaggagtgtgtttatgagaaatggagaaaaatggttaaccacaaatgtggcacaattatatttntggagatctattcaccccgtcaatcactaaactgggtttctggcttgtcaatccaccaccacacacccacggagacttatagaccacaaatgggagctgaatgttacttcttgaggctcttcactttatttttgagctgtgagatttatatttggagagtggaggccttgtttttaagaaaaacctgtcatgtaggttgtttataaaatataaaagcattttaactcca

SEQ ID NO: 724698 - DNA, 504 bp, Homo sapiens
  misc_feature (351)..(351): n is a, c, g, or t
  misc_feature (367)..(367): n is a, c, g, or t
  misc_feature (399)..(399): n is a, c, g, or t
  misc_feature (457)..(458): n is a, c, g, or t
  misc_feature (465)..(466): n is a, c, g, or t
  misc_feature (471)..(473): n is a, c, g, or t
  misc_feature (489)..(489): n is a, c, g, or t
agcagaatagcccttagcagaaagaaaagagctaagagaccctgtatctgtccctcacccttcagagctggtgcccaaacccaaagccatcatcacattggatggagcccctgcctcaggtttagtcacttgatcctatttgaggggaagcaaagatacctgtgactcatgaagagcatgagtcacatggtggagggacttgagaattaggaaatcaaaatgggcaagaacgatgtgtgccttcaaatggaacatgaatttgaagcaaatttcggttcaatttgctgtcacacataatgatcaggttcagtaataaagaattgtacttaaattttgattcattaaactttntggagagtcctaaacnatttatattactaacacatagagacttctttntggagaaaaatgaagtaccaggtgccaagtaacagatttacatgagaattttttaggnncaacacnntgccnnntgtagcacagtcatancccatttgaacccaa

SEQ ID NO: 724699 - DNA, 490 bp, Homo sapiens
  misc_feature (115)..(115): n is a, c, g, or t
  misc_feature (126)..(126): n is a, c, g, or t
  misc_feature (152)..(152): n is a, c, g, or t
  misc_feature (156)..(156): n is a, c, g, or t
  misc_feature (179)..(179): n is a, c, g, or t
  misc_feature (194)..(194): n is a, c, g, or t
  misc_feature (198)..(198): n is a, c, g, or t
  misc_feature (268)..(268): n is a, c, g, or t
  misc_feature (275)..(275): n is a, c, g, or t
  misc_feature (277)..(277): n is a, c, g, or t
  misc_feature (284)..(284): n is a, c, g, or t
  misc_feature (286)..(286): n is a, c, g, or t
  misc_feature (375)..(375): n is a, c, g, or t
  misc_feature (379)..(379): n is a, c, g, or t
  misc_feature (405)..(405): n is a, c, g, or t
  misc_feature (410)..(410): n is a, c, g, or t
  misc_feature (419)..(419): n is a, c, g, or t
  misc_feature (421)..(421): n is a, c, g, or t
  misc_feature (426)..(426): n is a, c, g, or t
  misc_feature (441)..(441): n is a, c, g, or t
  misc_feature (446)..(446): n is a, c, g, or t
  misc_feature (451)..(452): n is a, c, g, or t
  misc_feature (456)..(456): n is a, c, g, or t
  misc_feature (473)..(473): n is a, c, g, or t
  misc_feature (481)..(481): n is a, c, g, or t
  misc_feature (484)..(484): n is a, c, g, or t
atggatgcttcactttgtcaagcacctcagttacacattcgccttttctaggattgcatttcccaagtgctattgcaataacagttgatactcattttaggtaccaaaccttttngagttccaacncgatccaaaccaaaggaaaagtgttngctnagagaaaatttggggaaaaggtngaaaaagaaaaaatnggtnagtaattgagcagaaaaaaattcaatttcatatatgctactcgattggcaaccagatttcatctcaagtnagaactngnattcggntnaggaaaaaagaaaactgcaatgttaatcattttcctaagctgtccttttgaggcttagtcagtttattgggaaaatgtttaggattatncctngctattagtactcattttatgtatgnacctncagtaagtncncccantttagttttctaggnctganggttnntttntacattatacatgtgtnttgtcatnttnggcttt

SEQ ID NO: 724700 - DNA, 161 bp, Homo sapiens
tgaaaccacattttttgtaggtgataactcaatgaaaattggtgcttattttttacacttctctcttgtggctctcttgctggtgctatcttgttttaatgtgcctccttgaagtgcgcactggtggtccctgtgccatgcctctgttctccctgcctggt

SEQ ID NO: 724701 - DNA, 760 bp, Homo sapiens
gtctgtagtgcacgccgcgggcccagctgctgaccccggtcctgcccccgggatcccggccttggacgatctgttccctcctccgatcttcccggcagagccagcccaggcctctggcccctatgtggagatcattgagcagcccaagcagcggggctatgcgctttccgcttacaagatgcgaggggcgctccgcgggcagcattcccaggcgatgaggagcacagatatccaccaaagacccatacccaccatcaagatcaatggctacacaggaccagggacagtgcgcatctcccttggtcaccaaagggaccccttccttcaccgggccttaaccccacacaagcttgtagcgaaaggatcgtgcgcaggagatggcttctatgaggctgagctctgcccggaccgctgcatccacagtattccagaacctgggaatccagtgtgtgacagaagcgggacctggagacaggctatcagtcagacgcaatccagaccaacaacaaacgcccttccgaagttccctatagaagagcagcgtggggactacgacctgaatgctgtgcggtctgacttccaggtgacagtgcgggacccatcaggcaggccctccgacctgccgcgctgacctatacgacataccatctttgacaatcgtgcccccaacactgccgagctcaaagatctgccggagtgaagcgagaactcgtggcagagtgcctcgagtgggggatgagatcttccatactgtgtgaac

SEQ ID NO: 724702 - DNA, 974 bp, Homo sapiens
cgctgttatcctgggagtccccacccaaaggagccagtatcccctacgcatccgagcctctccctaggtactgttcttctctctgccaaccatggacttctctgatccaggctcagtatggggttgtgatcccagctgatgtcaccaagttccatcagctctcaatgaccatgcgaatccccatttgcccatcaccctagcgatgtgttgccgatggaacttggtatcccggcattcgatcagtaccagactcgactaggagttctttgggtttcccaacagatttgattggcatgtgtgatcgagcgctcaggtccacgcaagatcagcggagatccggcagatgttacgggcgcatatcaaaaatcgggaaaccaatcagagggcgctggggaacggcgatgtcacctatcactggctctccgggtctccatcgccctggcgccagtgacctcatcaactgacgtgtctagatggacgggcaagctctacgctctggtgaggacgcccgagcttcggctgcccgaagacttgcttggtcaccgttgtagttggctctggaggctgctgctgtgtgtgcgaaatgccctgtcggcctctgtatgagtgtccgtctacctgttcatccggcttgtgctgtgaccttctacgacttagcaacttgtgttactctgtcgacgactgctgggattggtgagtctacacctgccaagatgctcccttgttctgggacatccaacggtgattcgctgttgttttcaccctactgggaccctttggtgcaggaagcggctcgcgaacaccccgggggttttgtctggccaaacgctcgggattcgtcctcggtccacactcggtctgcgccaactggtgcctcttctcttctctcctctgcgtcttctccaccggccaccggctcatgggcccaggggcaccccccactgaatagggcaccaccctcggctggacgccca

SEQ ID NO: 724703 - DNA, 471 bp, Homo sapiens
cccagaggtcatcccagctccagacgtgacacatttgcttccaatgatgtctacggatgaggaaactgaggcctggagaggttaaagagacccgttcagagatcctacagtggccgactggtcttctgaggagctctgccctctacaacagggctctttcaggtgcacgggaggaacatggaagctgcgttctatgctggttccaaccccaatggcatctgtgttgcttcgaggatgtaggcttatggatttcacacaatggaggagttgggaacagctggacctggcccagaggacactgtacctgagaggtgaaccctggagacctgggagcatcattgtctccctggctggagcaatcaagagggacctgttgcagggcatagcaggaggccccccggagactggaagctaccttgagggcgactaggttgaatctggagagaggtcgagctagggaaaactttcccc

SEQ ID NO: 724704 - DNA, 136 bp, Homo sapiens
  misc_feature (5)..(5): n is a, c, g, or t
  misc_feature (41)..(41): n is a, c, g, or t
cagtnatctagaggatccctcaagtgatcctcccaccttgngctcccatagtactgggattgcaggcatgagccaccatgcatggctagacgggtacaacttttatctttaagagaaagatttaagtaaaaaatgt

SEQ ID NO: 724705 - DNA, 139 bp, Homo sapiens
atcatgtctcatattatgtccccctgtgttatcacattaaatcatgactccctcgccacctcgctcgcagcactcgtgttcacccacccacacatatatacagattagatacaagacacatatcaccacacagaaccac

SEQ ID NO: 724706 - DNA, 733 bp, Homo sapiens
  misc_feature (39)..(40): n is a, c, g, or t
caccagggacggtgactgtgttaagcaggtcaccgaggnngagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccacttatccctctccataaccccaccttgcccaccccacccccatccccaccaggcgcatgatacggtctaagcctgcgctatcttctacttt

SEQ ID NO: 724707 - DNA, 260 bp, Homo sapiens
  misc_feature (1)..(1): n is a, c, g, or t
  misc_feature (32)..(32): n is a, c, g, or t
  misc_feature (36)..(36): n is a, c, g, or t
nttttgtgtgtgttaccgtggccgaacatttnaatngagggggagcagtgtaggtagagatcaaaaagtgtaacacatacttgagggctggtgaatagctggaccagcaggcgtaggaaggtggtgaaccaagactgaaaggtaggtggggccgaattacacagagacgctgagttgttgggacttaactggcgacgcgtaacacccacatgtacgcgggtaccgcagcctcgaacttcgctaactcatggctcactagc

SEQ ID NO: 724708 - DNA, 148 bp, Homo sapiens
acctcaccatgttcattttacatttttaacatttttcttcatatttcctttgaaaagtagactgtgagttatttctcactaaagaagattaaagaagactaagatttttattataaggataaaaatcttagtcttctttgatcttctg

SEQ ID NO: 724709 - DNA, 958 bp, Homo sapiens
  misc_feature (39)..(40): n is a, c, g, or t
caccagggacggtgactgtgttaagcaggtcaccgaggnngagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtc

SEQ ID NO: 724710 - DNA, 1192 bp, Homo sapiens
  misc_feature (39)..(40): n is a, c, g, or t
caccagggacggtgactgtgttaagcaggtcaccgaggnngagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtcaaaagaaaaatcctatgagaaaatgaccacaagccaattatacactcaaaactgctgatcctgggctctgggagaagctgtttggagaccacatatttcatattaactttaacatgatgggattatcttactgtctggggtcatccaaacttgattttttcaagaaaaaccctgctggtgaggggaacaacaaaatacttatccattcaacagtagagcaaaggaactgaccaa

SEQ ID NO: 724711 - DNA, 152 bp, Homo sapiens
  misc_feature (4)..(4): n is a, c, g, or t
  misc_feature (136)..(136): n is a, c, g, or t
cgcntttaagctctctttcgagggtgtgtgaggggtacatacttttcctcgatggtcgagctatcctctgttccatctctcgtaatcacccataaacaaccacctctttcttcaaagttgtatttatgttatcttngtacggcggaacattt

SEQ ID NO: 724712 - DNA, 700 bp, Homo sapiens
gggccccccagccccccccccttttccccgggttaataaatacctctaaagtggaggcaaattgtccgtcctgccctataaaaagacttttttcttccccgggtttttggcccccaagcgttttttggatttggtccattttgcgggggcaacccacaggaaaaattctttgtggtaaatagattcaaaaaacctcaaaaattgggccgtgcctttccccttttcccccggttaaaaatatattttccccgccctttttggggcccccccccttttgggggttttttttttaaaaaaaagaaaaatttttttaaaaaaacgccaaaaccgggtgggtttttttttttaaaaatcccccccctgggggtgggggccaaaaagggttttttttcttttggccccttccccccaagggcggaaaagggtggtaaaaattttttcccccccccaaaggaaacccccttttttttgtggcttttttaggggggaaaaaaaaaaaaagaaaccccttttttttcccggggccccctccaaaccctccccccccccaatttggggtttggggtccccgggtgggggttttcccagtttttggtaacccaaccgggccccccccccttaaaagaaggggtttttttttcccccttggggggccccccccccccctttttttttccttttttggggggggtttttttta

SEQ ID NO: 724713 - DNA, 215 bp, Homo sapiens
gagtcggtccctctactcccagaaaaggggaagggggtggaggaggttgggcactccaaaggagaacaaggatagcaggaagggcccaaggttacctcctgaggttcttctgggactgtatcaacaatgtgtcaaagtcaagagaatcaaatatgctctttacaggtgctgggtcaaagtcttcccggttggagtcaagatcagaatagctcctc

SEQ ID NO: 724714 - DNA, 225 bp, Homo sapiens
cttggatctcagtggcccacggtgtagccgatgcccagctggatgcacccttcagggtggaggaggtggtctcgatggcccaacttcttcccatggccaggcccggctgtgccgtcatggacagaacctctgttggggccgccttcttcttccccagcgaaggcagcaacctcacccccgcccaccacttccaggacttccgcttcaagacctgagcaagccagg

SEQ ID NO: 724715 - DNA, 840 bp, Homo sapiens
gatgtgcagcatttcacttatttagattcacttaacaaacaaatttttctgctttaaaaatgtcttatgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctagacaaatacccaagcaacaactccgcaggcagttacccagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaaacctgaaattccaatgaagccatatgaacagtgttcagttgcacttctaagactttacttagcagtaaaattatagctcatgtgcatattttccagataattagcttatgagtagttatacaatttatgaagatttatattacagatcaaatggtaagtgttctttaaaatggggttcaattggaattcacagggctaaataaagattctcaaagtcttcgcaggatacttattagtaattttctgaaggttaatgttcattgatgatgtacttaagc

SEQ ID NO: 724716 - DNA, 242 bp, Homo sapiens
agctgattttagagtatcccgcaccatgcaccacaggaggagccgcgtcaggacactctaggaccctaaatcctgacgcaacaggccctgacaggccatgtcacaggtcacgacatcctggttgttactgctacccttccacagcacctcctggttggtatgcttgatggactgaactggtttcttgcaaatacttctgtatcttcttgcgcaatctgctcccaccgctgcttactctcaat

SEQ ID NO: 724717 - DNA, 369 bp, Homo sapiens
gtaaacaaattttacaatttccttggtatttccaagtcacatggtaaaactatgggataaacagttcaatagaaaatccctcaggccgggcacagtggccaatgcctgtaatctcagcactttgggaggccgaggtgggcgggatcacctgaggtcaggagttcaagaccagcctggctaacatggcagaaccctggtctctactaaaaatacaaaaattagccgggcatggtggtgcatgcctgtggtcctagctacttgggaggctgaggcaggagaactgcttgaacctgggaggtgaaggttgcagtgagctgagattgcaccactgcactccagcctgggcaacagaataagactccatctcaa

SEQ ID NO: 724718 - DNA, 150 bp, Homo sapiens
ccgatcctagtcaccgcgtatgcggcgaacaccataatattcaccggcagcccagaagttgcctgacctggatagtcctgcggcaggtgaggaacgggcgaagttcgcaacaagttgaggatcaaggtgccgtagatggccagcaacagt

SEQ ID NO: 724719 - DNA, 240 bp, Homo sapiens
cttttcccaggtttttattttttcccccgggcccagaaaaagcagaaccccaatgggagccccccgggtaaaagtttggggggggggggccccccctgttaacccccccccctccacccggggggctaaaaagggggggggggccaaaaacccgccccccaaagggtttttttcccccggttttttggctttgggggcccttcccccccctggggaaaactttaggggattttgtgttta

SEQ ID NO: 724720 - DNA, 296 bp, Homo sapiens
cgtcgacgggaaaactgaggtccaagggagaaatgtgacttgccttgctgttctttggacagataggagaggccgagtggggttggcattttgtgtgcctacttccaggccactctgtgctctgtgtgttgatatcatgtctgccagtttattctagcttagaaaatttctaatgcttcaagttcataaccattttttagctgagaaggtatactcagatgctcaaagggccagcctttagagcttactggtgtgtttgaaaacagctgtccttttgtgatattacaggtaaacgc

SEQ ID NO: 724721 - DNA, 380 bp, Homo sapiens
  misc_feature (29)..(29): n is a, c, g, or t
  misc_feature (34)..(34): n is a, c, g, or t
  misc_feature (273)..(273): n is a, c, g, or t
  misc_feature (289)..(289): n is a, c, g, or t
  misc_feature (311)..(311): n is a, c, g, or t
  misc_feature (316)..(316): n is a, c, g, or t
  misc_feature (333)..(333): n is a, c, g, or t
  misc_feature (339)..(339): n is a, c, g, or t
ccaccatccaattgctggccccatttaancttangctttttaaaaagatttataccattaaaatgcccatccttcttccttaaaagttttgtgcctaggatgccagccatttccatttatcgctcttacagaagaggaccgtctgggcaggtgatcatacttaaatagacggcagctaaaggagaatgaactttgactcatttaaattaactccaatatttattgttacaagcttgacaatgctcttggaaacgattaggtatgacctctagnataaatgagtttaatnaaagagactaaaaaggagtacnatatnctagttaagggagtcanttttcntcagaaagcagaagggcttgggacgactacttgacacgtag

SEQ ID NO: 724722 - DNA, 101 bp, Homo sapiens
tgaagtgaactaatacattttcatttaccacatctgggtgtcgttgaaaaaatactttatggcacagaagcggttttgtctctccttatgtctccacttcc

SEQ ID NO: 724723 - DNA, 142 bp, Homo sapiens
actctagacgatgctttcctttaacaactgtacaatcaccgatgctctgggcacaaagggacccagcctcagcatgcgtctccttgggcagctacggaggaataccacagcctactcaccaccactatcacccatgtggacg

SEQ ID NO: 724724 - DNA, 475 bp, Homo sapiens
tacttttccacaggcgactcgcaggtacattgtcgcagttagtcctctatcacagtcacatggggtgggagattatcctcacttaacagagttgcgaaagtgaggtatacactagaatcattatctcgcctaggtcaatcacgttggtggattatttattgctgtaaatagtcaccaggaaaacatccttggatcttaagttcatccttttactcatcaactggctcagtgtcccttgatgaaaggatacatgctataaattagtagaagagttcgtctcctggggccaacatgcttgcttcccataattggatgattaaaattataaatcctgatgtgtttctctttttaccaatggctgtcaggaaactcaagagtaaaacttaattgcatgattatgggaattacaccagttagatttacagaataatttctctagcttttttacttcttatttttattttaccgaagccct

SEQ ID NO: 724725 - DNA, 114 bp, Homo sapiens
gtcttgtcgggaagtacggtggaaactaagtctcattactgattcgtttatgggtagtactgggatgaacccaccaccacagaagcaaattagacaacttaatgtgaaatcata

SEQ ID NO: 724726 - DNA, 314 bp, Homo sapiens
  misc_feature (97)..(97): n is a, c, g, or t
  misc_feature (297)..(297): n is a, c, g, or t
cttccagagcattccactgggaaggcacgtgaggggcctgtgccgccctccaccttgagtcccagcactgacatccttcctgcaggctctgcattgntgcgggagcctgggagctaggaagccactctcagatgcaaacaaggaaattatgtctgtggaaaaaaaaagtttcattgtgggcaattgcctgagtctccccgggactggcttcgtcaccatggcaacccatgtttgtattgatggatttggaaagtgttattctgtttgacttctccctgctctgctcaggcacatgcntttgagcccctgcggtg

SEQ ID NO: 724727 - DNA, 419 bp, Homo sapiens
agctgtcgatctggtagagggtctcgtggaaaaggatcacaccggtgatgctctggttgatgaaagtgtcccagaagaagaggatttctcggaactgccggcggttctctgcagtgtttgccgccttgatcctcggcagccggttcgccatggtaccgacagattcatgtgcagccaggatcgcctttccattggcaacaatgctctgggcaatttgtgagagctccttgttgtgctcctgggtgagggctgaatatcggtgggccatggtgacaggtagtttgggagacaagagtcctcctatttatcaagagctgtgggtgaggcagcagctctctctctctctctctctctctctctctctctcactctctctctatctctctctctctctctctctctctctctctctctctctc

SEQ ID NO: 724728 - DNA, 542 bp, Homo sapiens
gcagcgcaccacatcaatggcactgaaaaggtgagcttcagaaacaagtcgaaattaagaaactcctttaaattcttggttggagtagcggatcttttcctggttcccgggaagaacacggcttttgacggttgtgaaagacactcaggctttgttctgacacatcccaggactattttctattgggttgtattccttgtgttttttgtacaccaggagggagatcacagtgacaaatatggccaagcagccaacggagatcagggcactgtttgccatccttaaaggcgaggctgggtctctgtcaggaacaggaatcagggtgctcgtgaaagccaggcttgtgtcatcccccagggtgaggttcacacagtacgtcccagacccattgaaggttcgtctcacagtcagcagacacatctcatccacatccacagggctgcagactgtgttctgggtgatctcgcaggtggggtcagaaatgatggtacagacctccgtgtgaatgctcccttggcaggtcacgacaaagtctattaggg

SEQ ID NO: 724729 - DNA, 1159 bp, Homo sapiens
ccaaagtggtggtgcgtgatgtcgaagggccgagtgaagcggcatctgccctgaccggtgagtggcgtgtacctggctcctcctgtcagtgcaaataaagagcccaccgaaaccgaggactatctgagcggagactgtggaatcgagagagtcattcagttgacgtcataggtgtcggatactggtctggggaggtggcgcgcatgacaagagcatgccgggatcttgaaagcagtgaatgaaatcggcgcaaaggactaacattacctacgctcctaagcatgccctacggtaccaacccaaggcttccagttgtcgcgagggcacactacgaatgcctcgatgtcgtggcatgcatgagtgcacttccagcggttgtacatgcgtgtattgtaggaaaatgcttgcaccagatacatttgtggctatgcgtgtgagcaaagagttcgcgatccttggcatacaggtggataagcagcaatgtatcgttccactttgaatgtcgtcagttcttgtgcggattgtgggtgcccttgagtggcggctttacgagctcggagtagcccgagatgagatgggccgactgtccttcgcgtcatggtatgtggggcgatggagtgcaactactggcgtgtgtcgggcagacagacgatgttgcactgagtgtttggcttgttacatagacctcgcttcggaactatgggtgccctgtctgggtatcctgcccctggtcttgggtgatagatgcgtcgtgtagtgcattgtgcgtacctggcggaaatggggtgggtggttaaggcgtgacgagaggaacgggcagcctctagtcaggcatttgagcaccgatagtatagaatgctatctcttgagtggagcattctgaggtcagtaaacttcacgtattcaccattttgttcctcagtctccttttatgctttggaactttaagggcgtaaggccctcgattacaggtggactcgattggaaaacgatgaatgccttgtgtgagtgaggggaccactatggttattaaataaccgtggggaaccaaaattcttgggcactacataaattttgtgtgcacacactgggggatttctccaccaacaaggggcaaccgtgggaaacagcggcgggctgtaacaaaaaaagaaccaca

SEQ ID NO: 724730 - DNA, 201 bp, Homo sapiens
tagaggagctcggtgagaagctggcagggggaaggggggaaggaggtcgagctgggcttgcgtgggggcaggtggggaaggggatgaggcttggtcaggggtaggggaccaggcagggtctgctccaggatccttccttcttccttctcccgcagccggtgagggttgggaaacaaggattggggtctgcccaccaccctg

SEQ ID NO: 724731 - DNA, 791 bp, Homo sapiens
ctagaccattcgttaggtgcgcgggacccaatacggtaagtgaacagttgcgttccatagcatagtttgcactaaggagatcctcggtacataggactaagttgcttggtattctcacctatattacaataaaggactgtcctcgtggctggctagatgcgaggcgttgctgaagcgaaatacgccatgtagtttggagtctacttgggaagtgttgcattactcggaatcatattaatactatgagatgttggctaaaacgcaagattggcggtcgaggacttatgtcgagatatattaatctgagcctctctcgaggcggctttggaaaaattggggattgggtttttggttaattcttaagatttaagtttaaaaaccaaatttttaaaagtttttttttaatttaacttttaaattttttttaattgggttaaaagtttttagcacaggcttaatgtattgttggattgagattgtattaaaacgttctaaagattatcttagaaagaacgtttttgttgtagttaaacttaacatttttccccattgggcattgggaccagttgggtagttaatatttaaagccagttatttgataattatagataggagtaaagttattagatctcggtataacaagaaaaagttataagaacgcacggatttgagcgtttaaattttcgcatttgttcccgctttattgcatgataagttaaaagggaccgtttttgtgggggaccagagttttagaacaggaggtttaaaatgtggggttataggtaaacttg

SEQ ID NO: 724732 - DNA, 226 bp, Homo sapiens
tgctgagaatatgaggagggggaagctgaaggcgtggagcccaggtagtggagggcacgctgccaatgtgcgggagcaaagtgccaccagctccgggaccacttgccagtggatgctgagtatgctggtgaagagtgccgcagtcccagtgagatgtgtatgctgctgaccacatagcccaggtgcactgcagccagaatgcaggcccatggaggagcacttagct

SEQ ID NO: 724733 - DNA, 267 bp, Homo sapiens
tggagccggccctgttcatcatagcgcttccgccaatttcagcatgacgttgccgacgaacccgtcacacaccaccacatcgcagactccgtgcatgatgtcgcgggcttccacatttccgacaaacgcaaacatttgtcgcgagaacagggaataggcttccttcgtcagcgcattgcccttgccaggctcggtgccgacattgagcagcccgatgcgcggtttgtcgacagcgagcacatatttggcgtacagattgcccatcac

SEQ ID NO: 724734 - DNA, 363 bp, Homo sapiens
cgacgaggaaacatattcagctaatactctcttagatcgcactttgaagactagccttttggagacaatctgaccggttaacacaagaactgttggaattattctagctgtaactacctattggctatatgtagaatgatcctagaaagccacaataatttttcattttagatcttgattgaatttaagatgtatttatatgcctaccaaaggtctgtcttgtaactgttgtataaaataaacctaatctatggtttcatatctaatctaacacaagttgtgccttaacaatagggcctcgtatgttaataagggacaacaacccatttagtcgatgggggcacataggaaccttatgccatt

SEQ ID NO: 724735 - DNA, 328 bp, Homo sapiens
ttatgaagatggatcgtatccccagaaactatcagcagaacaagcttgctgtgtttcaatgttctatgatgggactgtgaagatccgaacaggcgtctccaaggccaaagagtctggaagtcattatcatgattcactgaagagaatacaggctagtctgattaatgtgcaacctcagaagcagaaggccagctgccagagagaagcgcattctggatcatttcaactaaggtcgtgtcctcgagggaatggattagggcatcttttaataggacgctggtaccatttatcttgggaagtccagttagacgttgcgttgactgaatga

SEQ ID NO: 724736 - DNA, 103 bp, Homo sapiens
acctggggcctctctgatcaaccgaacaccatcatcaccaccatcacatcacaaccatcaccatcgcctattttacaccaacccctgttcggttgagcggaga

SEQ ID NO: 724737 - DNA, 405 bp, Homo sapiens
ataacatccagtcaaaacaaaatgaatacacggatacataggagcaaacattaggcatgagccacagtatgatacagcacacgagtcaacatccgtcttttcaatcaagtagttcagcggcacatcaaaaaccacagctaaggcctttgaagtcaaccataataacttcttcagctgtccctatcagtttttgcggcacattgctctcacaagattccactgggtttcttcatcaaagggccaacattccagtcaaagcatccattctcatcagccacatggttctccaacccagcaggtcaccatccactccaagggaggtcagctggccaatcatctcggcagcaccattctcataggtatgtccgcgggcatccctctcagcagtctgcacctgccaggcta

SEQ ID NO: 724738 - DNA, 196 bp, Homo sapiens
ccatcctggccaacacagtcaaaccccatctctaaaaaaaaaaaaaaaaaaaattagctgggccgggtgcgggcgcctgtagtccaagatactcgagaggctgaggcaggagaatggcgtgagccccggaggtggtctttccgtggaccaactccgctccgtcacgcctgggccaacagcgcaagactccgtctca

SEQ ID NO: 724739 - DNA, 114 bp, Homo sapiens
  misc_feature (6)..(6): n is a, c, g, or t
gagtangcttgcacttgccacgtacgtcctggaagatcgatgatatctgctcacaccactaatgccgcccgacgttttttcaatgaaggaaaataacgatctgaatctaaatta

SEQ ID NO: 724740 - DNA, 513 bp, Homo sapiens
agcctgtccgcatcacataaattatcgaccattaatgaggtgtaaaatcaatgatgcatgtattgtgactagaaattattttaacaatgtcagaaataatacaatcatggcgcaacttgaaatttcctaattagctatctgagctatttaagtctgtacttacagtgtcttcatttttataaatgagagaactggactagattttatataagtacctactaaagcctagtgtttagcagttacttccttccctgtcaaaattttgcctcctttgattttcaatatatatatatttttttgtcttactctgttgcccaggctagagtgcagtgacgtgaccttggctcactgcaagctctgcctcctgggctcaagcaatcctcccacctcagcctcctcagtagctgggaccacaggcatatgctacaaagcccagattattttttatagaaacaggattcaccatgttgcccaggctggtcttgaattcctggggctcaagtaatctaccca

SEQ ID NO: 724741 - DNA, 716 bp, Homo sapiens
  misc_feature (458)..(458): n is a, c, g, or t
ttcatccggtgaccgcgctccattctcctgcctgtatccatgttgctatttgatttagctcgattctgcctagacacgaccatggataaccgtccttcaattggttgcaagtcgtgctaggcgtcgcagtgtatgaacttccagggggcctccgcacaattgcggcctcagcagctgagaagagaccctcgagaggagaataggcgaagtcgatagcatctttggaggcacatctatacagcacctctacttatttcccgttctgcgaggtgtgagcggagaaccagcgcatcgcgttctcgttgtcttgccaggtaatattgtatctgagatcatcgttctggcgactccatttttagctcatccatcttatctggacaggatcgctgatttcgctcgacacagtcttagcggcatctggcctcatttttcgttgctggatccaccatagcctcttngtggaatccgagccagcccaccccatgtggatatatcagggacaacccctcgtgcaccgcgctctggccggtgctccgagtgtagctctaccgatttgatcgtggttcgcaccaagagcgtccgagtccgagtgtcgtaacttgggccactcggcaccgtggttcgttggccctgccattagctcctggtcgtccaagcgccccaggatggccagtcctcgtgtcatagcccttgctttgttgtttctcaccatcatg

SEQ ID NO: 724742 - DNA, 378 bp, Homo sapiens
aaagtttggtcagatatatgcaaatgcagtgttagtgaagatcatctgaataatgatcactttcacatgccatattagttatattttagtatcactgctcattgtgcttcctctctttaataaagtataaatcaagcaattaaaagctgtgtaggccagtcgcggtggctcacgccggtaatcccaacactttgggaggccgaggcaggcagatcacctgaggtcacgagtttgagaccagcctgacgaacatagagaaatcccatctctactaaaaatacaaaattagccaggcatggtggtgggcgcctgtaatcccagctactcgggaggctgaggctggaggatcgcttgagtccaggagttctgggctgtagt

SEQ ID NO: 724743 - DNA, 299 bp, Homo sapiens
gaaacccagagagtgggagataatctttgcaaataaagtgaccgaaaatggattaatcgtccaaaatttataaacaccttccgctgctccataccaaaagaacaaccccttcaaaaaatgggcagaagatctaaacagacagttctccaaagaagacatgcagatgtgccgagaaacacatgaaaagatgttcagcgtcactcatggttagagaaatgcaaatcaaaaccactctgttttaccaccgttacaccagccaggatggccatcacataaaaggagttcccactcgtggcacg

SEQ ID NO: 724744 - DNA, 86 bp, Homo sapiens
tcgtacccgagctttctccttcaaaggccaataataaagacatttcctacctgtttaaaaaaagaaaaaaggaaaacaaaaagggg

SEQ ID NO: 724745 - DNA, 959 bp, Homo sapiens
  misc_feature (410)..(410): n is a, c, g, or t
  misc_feature (628)..(628): n is a, c, g, or t
  misc_feature (633)..(633): n is a, c, g, or t
  misc_feature (688)..(688): n is a, c, g, or t
  misc_feature (721)..(721): n is a, c, g, or t
  misc_feature (825)..(825): n is a, c, g, or t
  misc_feature (834)..(834): n is a, c, g, or t
  misc_feature (843)..(843): n is a, c, g, or t
  misc_feature (862)..(862): n is a, c, g, or t
  misc_feature (876)..(876): n is a, c, g, or t
gggtcactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaaggggacagaggatgagctggacaagtattctgaagctttgaaggatgcccaggagaagctgggaactgggagagaagaaggctgctgatgctgaggctgaggtgggctccttgaaccgtaggatccagctggttgaagaaagagctggatcgtgctcaggagcgccntggccaactgccctgcaaaatgctggaagaaggctgaaaaaagctgctgatgagagtgagagaggtatgaaggttatgtgaaaaccgggccttaaaagatgaagaaacagatggaactccaggaaatccaactcaaagaagctaagcacattgcagaagaggcagataggaagtatgaagaggtggtcgtaagttgggtgatcattgaaggagactgnggaangcacagaggaacgagctgagctggagagtctaagtgtctgagctggaggaggagntgaagaatgtcacaaaacctcaagtctcttganggtcaggcggagaagtactctcatacagaagataagtttgaggaagaatcaggattcttactgataaacttcagaggcagagaccgtgctgagttgtgaagatnggtagccangtggaaganatgtgactggaaatgagtnatgccgaatgagtnaggcttgaggggtggaagcccagagacaaaataacggtgcgggaaggctattgggaaaggcttgggttttggggggccaaagg

SEQ ID NO: 724746 - DNA, 816 bp, Homo sapiens
  misc_feature (485)..(485): n is a, c, g, or t
  misc_feature (490)..(490): n is a, c, g, or t
  misc_feature (545)..(545): n is a, c, g, or t
  misc_feature (578)..(578): n is a, c, g, or t
  misc_feature (682)..(682): n is a, c, g, or t
  misc_feature (691)..(691): n is a, c, g, or t
  misc_feature (700)..(700): n is a, c, g, or t
  misc_feature (719)..(719): n is a, c, g, or t
  misc_feature (733)..(733): n is a, c, g, or t
gggtcactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaaggggacagaggatgagctggacaagtattctgaagctttgaaggatgcccaggagaagctgaaaaagctgctgatgagagtgagagaggtatgaaggttatgtgaaaaccgggccttaaaagatgaagaaacagatggaactccaggaaatccaactcaaagaagctaagcacattgcagaagaggcagataggaagtatgaagaggtggtcgtaagttgggtgatcattgaaggagactgnggaangcacagaggaacgagctgagctggagagtctaagtgtctgagctggaggaggagntgaagaatgtcacaaaacctcaagtctcttganggtcaggcggagaagtactctcatacagaagataagtttgaggaagaatcaggattcttactgataaacttcagaggcagagaccgtgctgagttgtgaagatnggtagccangtggaaganatgtgactggaaatgagtnatgccgaatgagtnaggcttgaggggtggaagcccagagacaaaataacggtgcgggaaggctattgggaaaggcttgggttttggggggccaaagg

SEQ ID NO: 724747 - DNA, 374 bp, Homo sapiens
cgagaaccctttcgtccttccggagggagggccgaataggttgagggtttaacatttgatgagggggcggggcccttggcccattttttaaagggggaataccgaaacttttttataaaaaaccccctcccccttccatttttcctgggaacaacatagggggcattttcccttgaattttacaaaaaatatttggtccccaaacccctatttttacccccccggtttttaggatttggaacggcaacccccggattcggttaggcccaattcatacccttcttatgaaaaaatttcctccccttcccccgggcattatttatatgataggtttccaaccccattacattttccggctttccccctcaacccta

SEQ ID NO: 724748 - DNA, 198 bp, Homo sapiens
gtttttattctttatagacaaggcaggccgggcgcggcttgctcacacctgtaatccagcactttgggaggccacggtgggtggatcagttgaagccagtgagttcaataaccatctttgagttcagcccatttctcattctgaagtttccttttttcacacttctcagattatactgatggattttcactttgggct

SEQ ID NO: 724749 - DNA, 126 bp, Homo sapiens
tgtgcacacgccgaatgtcacaccactctgacttgcaacaacttcgtccatcacgacctgcaacaacttcgtccacccggatctggtccatactgagcagaccggtatggtcgttcggcgtgtgca

SEQ ID NO: 724750 - DNA, 561 bp, Homo sapiens
  misc_feature (545)..(545): n is a, c, g, or t
  misc_feature (547)..(547): n is a, c, g, or t
tcaataatgaaacagattcaatttccatcacccagtgagacaccatgggattagaataaatttttaaaaaaacaaattgaaaaaaatgcatttttaaaacaacaaaatcagaaaggatgaaaggtgatatttctagcatatcagtttgtggtggtaaattaattaccttatacaaaggcctcagtgactttctgctccttacctaacgaatcatctttaaaataagtaaaataaagaaacaagagcagcagcagatgcttcctaaaaagaagttaccaaatctgttcaccacaaacctgagaattcaactgtggacatttggacaccagcaatgaacatgaaactcagcttatgaggcatatttggctaaaggtcaaggtgacttaaaattcatcataggacatctacaatttgcaaagcaggtgactggatatggactccttccaagtctcatttaattggataatgcctacgttttaagtatcagaagtgagtctttctctattaaatgaagtcagttccactaaaacctaaatcttgtttgncnggcaaaaaaaaaaa

SEQ ID NO: 724751 - DNA, 126 bp, Homo sapiens
tgtttgcatcccaggtgtcagatccctgaggtcggacgtcgagacctgtctggcaacatgttgaaatcccatctcaggccgggcgcgtggctcacgcctgtaatcccagcacctgggaggccagca

SEQ ID NO: 724752 - DNA, 302 bp, Homo sapiens
  misc_feature (126)..(126): n is a, c, g, or t
tggcggacagaactctctccacagcacaggagtccccaccccacccagacatggagactatctttcaataaagggaagctccaggtctcagcttcagagctttctctgagatcaatgtgaacgcanggccttgccccaaactagtgtttcagggttgcaaacctctgtccaactccccttctccagcgtcctggggaagggtctttgattctttgaaatgagaagtctaaggatcaagaaccccgtttggctctcagctctgatctgacctggaagaggagaaacattgaagaggttccagc

SEQ ID NO: 724753 - DNA, 233 bp, Homo sapiens
  misc_feature (18)..(18): n is a, c, g, or t
aagatgccccagactatntacttctttcaaaaattagctgtgttccatcaaggagcatgttccagagcatttcccagtagatgtcccaaaggacactgtccggtgctgtggcgtacagtggcaacagcattgagactaagtggaacatcccagtcaggctgctttagaaatccagcgtcactttgactagaatacgcaatgtaattggcgtgtctttacaaaaacgcgcacac

SEQ ID NO: 724754 - DNA, 158 bp, Homo sapiens
ctctccaaacacagaccccatgacctgggacttcccagcctccagaaccataagaggtaactctctgttttttgtaaatgatccaactcaggtgttctgtgatagcagcacaaaacagactaagacatgctctgaaacctcacttcctgggtttgcaa

SEQ ID NO: 724755 - DNA, 287 bp, Homo sapiens
gggggtatgctgctcgaattcataagaacagggagtttagaagtagggtcttggtgacaaaatatgttgtgtagagtgcaggggactgagtcctgtgcagacactgctgaggctggggacaggagagggtgctgaagactggataggagatgtgacagggctgctgctcatttgagtgttggcctgcgggctgctgtcaggactgtacagatctccaggcttctgcccccgctggaccatgctagagtatttacaatgactccactggaccatggatgggttctgag

SEQ ID NO: 724756 - DNA, 536 bp, Homo sapiens
tcgggacgccgcacatcttgtcaaccaggacgaccctaatgtgactggatgatctggaaccttgtgttcatccagtataacagggaacgctgatggcattctgaaacctcttcccaatgaaaagcattgacacagggatgggcctggaacgactggtatcatgtgctgcagaataagatgtccaactcatgacaactgacccatttatatgtcccatttactattgaaagcccaatttcccagaaaagaggcaacaagtggttggccccgaaacacaattaacaacttgggggaaaaaggttatgggattgccattggaagtggattgccccagagaatttgggaggcacttattgaaacaaaatttgggtacaccatttaaaaaccgggggagttgattgggtccatttatcatgcagtttggaaaccaccaaaataagtacacatacagacgggaaaacacccaaaattcaaaaacatgtatatgagaagaacaaaacaatttgtggttgtaaatgtgagaacataatggagaa

SEQ ID NO: 724757 - DNA, 900 bp, Homo sapiens
gggccgggcgcagtggctcacgcctgtaatcccagcactttgggaggccgaggcgggcggatcacagggtcaggagatcgagaccatcctggctaacacggtgaaaccccgtctctactaaaaatacaaaaaattagccgggcatggtggtgagcacctgtaatcccagctattcaggaggctgaggcaggagaatcacttgaacccgggaggccggaggttgcagtgagccgagatcgcaccattgcactccagtctgggcaacagagtgagattccgtctcaaaaaacaaaaggaaccgggaaacaagaattagcattatacctcttcctggtttcaacggccaggaacatttttgacagatttccaaatcaggtgtgaatatttccaaaacaaaattttatacagtttaaaatatttttacttcttatagtaatagtattacttttaaaaagggcctcagggtaatactatcttttctaaacaggctaccaattcagtggcagttacattaacccaattagtgtccctctagtggagaccaacttaggcctatttcacttgtgtgtagcctcaagtgctaacatgtgtgccaaataaatattccggaagaattacacttggagtttgtaaaaaccattccgtctgcgttaccagttgccaaacaatttccaaaagggtctgtattatggtaatctgtgacgatcatatctcaatgggatacccgtcatggacggtggggtgcttagtcatacgtctcatattttaaacgtaataatgctggttacaacactcttcctgtctacaagtaactgttacaaacatggtaccccaaaaggaattttggctcgacaggcacaattgcttcggacatggttgttccacattttacgaactcgg

SEQ ID NO: 724758 - DNA, 888 bp, Homo sapiens
gatccgcatttctcttctttcttaactacaagctcccttcgccactgtttgtccaaccagaaatggacctgaaaatcgacttagatttcacggtacctgttcagcagcactctgctcccagtctaagccagactgggaatcccaattgaaactgggaccagaatttatcagcgtcccttcccagagcgcctcaactcatgacctctgagccacaaggaccactaacagtttcccacagacccaccagtggattctggactgttcctcctccgaaatgaagttcttgaaactagatactgagatgaggctggggaggaccacagatccaggactcctggcaccctcaagcctggcctgaaccagtagcaggacagataatgactagtctgtgttcccctaagtgtgtaaaggaggaaggagggatggcaggatacccttctacaggtcagatgtggtactggtgggctggatctttaatgacacctgccaccggcgcctccttcttgcacccaggccccagccgaaggtcgcgtccctcccccatgccccagggacgtcgaggcgggtaaggggctgtttagagacccgagccggcctgaaatggcagcgcggggttactgaccacagatcagcgccccggtcgagctgcgacccagcttcagcctctgaaccccgagcccgccaccacctctcccacgaagttgccctcgctggccgccagtcctctcccaggtgggaggctggccacaggcatagcgtaacggccctgccggcatcagtgggctggcacgctgcggggcactaggggtagggactggcacggcccgtgaccttgaacaggccgccgcggccgcgcgttgcggcctccccgctgcggccaagccagcc

SEQ ID NO: 724759 - DNA, 330 bp, Homo sapiens
  misc_feature (144)..(144): n is a, c, g, or t
atggctatgacactgtgaagcctgtacggccggaatcgggattggatctatatcatcttccacagcattattcccactggtctcagcctgcaccacctactttgggacagtgtcaacagtagccaagccccccccttggttggntttttggacagccaacccttaagttcagtctgcatttgggctctggaacaactcctaattctagttcggctttccagtttgggcagcagcactacaaatttcaacttcacaaacaacagtccatcaggagtgttcacatttggtgcaaattctagcacacctgcagcctcagcccagccttcaggc

SEQ ID NO: 724760 - DNA, 436 bp, Homo sapiens
cggaccgcctcctctgattgacgttttttatggacgctagaccctcgtgtctttgcgctgtctctccatctatgcaggtttctgccaccctcccatcccctcctcaccatacccggcttctccctccagggcatctgacctctgtgtgtacctgtgtaccacaggaggcccttacttctggtttctcctcttgggctgttgttatacagagcatgcctgggtgtcctcagaagatctgtggggtgctgtgcagtcccgccctgggggtaaccacagtggacccacaacacttttcctgcctgctgctaccccttgtagctgcgagcaaacttaaccagctggttatgttcttgcaaccctttcccttcctggcttagttttgaagcaaacttcttttccccaaattgtaaaggctacttatttctcaaattaggat

SEQ ID NO: 724761 - DNA, 325 bp, Homo sapiens
  misc_feature (287)..(287): n is a, c, g, or t
cagaagaggtcagaatggatcgccaaaatcccaaattttggggtaacaacattggtcaaccatccacaagtgtctgcacggctgggggaggaagatgaagaggcacggcattattggaccagagtggaagtgacagaattggaagatattaaatcaggttacataatagatttttatttggatgaaaatccttacttggaaaataaggttctctccaaagaatttcatcggagtgagagtggggatccatcttcgaagtccagcgaaatcaatgggaaatctggaanggatgtgacgaaacgttcgagtcaaacgcagaataaag

SEQ ID NO: 724762 - DNA, 135 bp, Homo sapiens
gcagcctcgggggtgtggagaaggagctgacgctgcgcagcaagccctggagctcaacaagcggaaggctgtagaagccgccagctggcgaggacccaaggtgcacctggcaccgtgcacacccgccccggcaac

SEQ ID NO: 724763 - DNA, 1447 bp, Homo sapiens
  misc_feature (151)..(151): n is a, c, g, or t
ggactgatgatgcacatgtactgtgttcattctgggttgactgggagtctgcccgactatgaatgggcgtcctatctctgtcgcgagtcctcgaagcctggattcacgctacacgatactccagcggaagaatctcctctctgaacctgtntctgcgcataatcagctagctccgaagggcaagtagagagtgatctgggttacagatgcgagttccaagcacgcgcgtggccctatcacgcgtcacgagccactcgacatcgagatactggtgacttgcccacagcaagcactctgtcttgcattgcgagcgctcaaggcctctcgcacgcctgaacgtcaccgaggaattggatatctatactcatgtacaatatcatctctaggagtgagttgcatgattcccctatgagctggcacccaccatgcgcgtgctaggttgcgcatcttctagtcaacggggtcgcgcgttggctactagtcttgctccctcgccttgtcattcgacgcgtgaaatggttcggtctagcttcctgacacccacttgtcgttaaccttacattcgtcttggctcccttatctcgggatagacccactttacatcccctgcgaacccaaatatggggggacttcctctaaagttcccgggacctggcgccggcaagcacaactaaggggtggtctggtgcgtttggcatgaacccggtcgttgccttctgagccgattgggtggtggtccctatttctttgcactcatggtcgctaggtcttgatcttcctgattcttgtcgggttccaatcccgggtcataccctggaggcgtggtggccgagttaccccctgtttggttgccctttttgacattatttgaatggggttggcccttggttcattttgccttgattactacgggataggattccttctgcaccattttgtcgccttttggatcgaaaagctttggagcaaccaaatcacgcgagggaaaccccggatgggactccattgggtaggcccccgaaaggcaatattggtagttgagttgaacttgttgtgcacgagaaaagtcatggggcactcacattaacccggttagtgagatccactaatgggcaaacacaaacagacacaaccccataaccaggtggtgaaaacggaggttgatcccaagaaatattctagaacaaagtagcgtgaccacggacagaaagcaagagggagggaaaaaactagggcaattaaaaaaagattagtaccccaaaaagaaaaacaatgcggcgcgcaactaacaccgagacaacaggcacgatcacactataatataaagacaacaaataaaatagatacgaatatgttataataaatgaacactacaaagactaagcacttataaaacagcaagaagatcatcaatgtactgtcattcttgtgtatttatgagtctatc

SEQ ID NO: 724764 - DNA, 357 bp, Homo sapiens
tcagaagcatcctgagtcatgacccacccactctcggcctccaaaggtgctgggattacaggcgtgagccaccagtgcccggcctccatgctattcttcatagggacggtactggtttacattcctatcaacaacgtataagagttctcttttttctgcctgctcactagcatttgttattgcctgtctttttgataaaagccattttaactgggatgaaatatttcattatactttcgattagtatttatctgattagtgatgttgaccattttttcatatacctgttgaccatttacccatatgtcttcctgagaaacatctattcaactcaggatgcttcttgacgggtaccga

SEQ ID NO: 724765 - DNA, 1472 bp, Homo sapiens
  misc_feature (470)..(470): n is a, c, g, or t
gcgggacgctgagcgagtcagtcggtccatgggctggcgtgtgtgtgtagaggcgttgcaggcgggagctcagcatccatcagggccggactagcaatgcgcgtgatggacatgtggcgtgtgcttgcttgtccaacggcagacgtgtgtgattatatgatctattgagaacgtctgggtgctggacggcaggcggagctgggccgggggcgctgtcgaccctcgttgtcttgtagtcgtgtcgtgccgaaggtttccatggtcgtgttggcagacatagcggatggtcgggatgcttatcggctaggcattggactcgaggctctggcactaagataatcgttctacattgacagaatcctttctgacagggtatctactgctggaccgaccgaagacaatggcgtccacgtttctctagcggctcgtgtctacttggcgcgggtagaaccaattgataggcgctcaanattgcgatttatgcaaagaggttagccgcatattgggtggagctgggggttgggtacgcatgatcattgtacttactcgaacggtttaggtcttgggatgcgttggcttgataactagccgcgtacgggtggtaaagggactcgggctgggacaatctccttgcaggtactactcgtgaaaagatctctactgtactgaacttcggaaaaaggagatcaggggttcgggaggtgagaatccgggtataagtacagtataggatttgtggcacaattcaaggaagctagtagtaagtggatgtgatgacggaaaactgactttgaggaaggtcgtaagtgagggttcaaaattaacaagtttgggatatgccagaaccataataataagtgtaaataggaagggtacgtccaattgacgagtctgtgggccaaaaggtacctaatatttaattctcgtactttcctggtggacatggttcatcgcagaggtaagccaattacctgttaacgaaagtgggatgggccttataacgcgcccgaagatatatgggaaggtggggcacaaatgcccccaaggtttagcgcaaccagttggagaggaagggggcagaaagagattcttggaaaaaagcgcactcggaggaggcaacgaagataacaagggggggatcacagagggcgccaacccgatacggctgtagaaggatttgtggcccgaccttggtaatgtcaaggcaatcacggcacaacgagagtacaaaggcgcacaacaagggcacgcagaaaacacaacgagagtacacgcgggagcgacaacaagggacccaactcaagccagagctaatcgtcgaggcagtgcgaaaactatacgcaatggaaccagggggacgcgaaacaagcatcgacatctcacataccagagggtacacaaagcagcacgacagcgagacacacacacaggacgagcacaggaagaggtacccaaccgccagacaaagcagc

SEQ ID NO: 724766 - DNA, 283 bp, Homo sapiens
  misc_feature (30)..(30): n is a, c, g, or t
cttggggggtttttccccccgtttgggggngggttttccggtttccccccggggccccccaaaaggggcccccctccccccccggtttttgggggggccccccccccccctggttttggggccccgccggttcccggggttttttttttttgttttttttcccccccccaggagggggaccccccgggggggccggctttttttttttttttttttttcccccggggggggccccccttggcccggggctttggggggggttttttaaattttttttggccca

SEQ ID NO: 724767 - DNA, 385 bp, Homo sapiens
  misc_feature (342)..(342): n is a, c, g, or t
  misc_feature (367)..(367): n is a, c, g, or t
  misc_feature (378)..(378): n is a, c, g, or t
atcattacactttattttacagatgagaaaactggggcgcagataaagcaacttgcccaaggtcttatagctgtaagtcaaccctacggtcaagacctacaagtagccgagctccagagtacattatgagggtcaaagattgtcttattacaaaaaaattccaagtagaatcaacctttaataagtctttaatgtctcttaaatatgtttatataggagtctaatcaccaattcacaaaaatgaaagtaggggaaatgattaacaataatcatagggaatcttaacaatccaagtgggctttgaggatattccattcttctttgacagtattggattccttnacattttcgttaagttcccattgtntgtttttgggnttttgag

SEQ ID NO: 724768 - DNA, 323 bp, Homo sapiens
  misc_feature (103)..(103): n is a, c, g, or t
  misc_feature (171)..(171): n is a, c, g, or t
gggggttacacacgcatatattaaaccttgctaggcttttgtggcgctaatcgtgtcgtaagcaactagcattttcccttttctaggctgcattctttcttgntatttcttgccctacgtagcctccgcctacttgcttgcttcctattccaagtcctcgctttccactgntatatcccgcctatttgttgtagccgtaagtcgtggtgttctcttcctagctcgcgttttatcccaccatctctttttctaccccaaccgtttatccccatctactatcccttttgcatagcctatcccgcccctccccctaactccttagt

SEQ ID NO: 724769 - DNA, 404 bp, Homo sapiens
ctttcgctgatgcaagagcctagtgcggtggtgggagaggtatcggcaggggcagcgctgccgccggggcctggggctgacccgtctgacttcccgtccgtgccgagccactcgagccgcagcatgtctggggacgagatgattttgatcctactatgacgccagacgacaccacgaagaagaagaagccttttatgttcagatgcaggaaggggattacccaaaaactatgaggaaaacccagtcttcagaaaccaaaagaagtggagccagagcaactgaggacaaggattggaagctgctgaagaggacactaggaaaaaagatgttctgatgatctagatgacttgaacttctttaatcaacaatgcaaaaggatggaaacaacacttaacacagatact

SEQ ID NO: 724770 - DNA, 343 bp, Homo sapiens
  misc_feature (14)..(14): n is a, c, g, or t
  misc_feature (96)..(96): n is a, c, g, or t
  misc_feature (149)..(149): n is a, c, g, or t
  misc_feature (206)..(206): n is a, c, g, or t
  misc_feature (245)..(245): n is a, c, g, or t
aatgagattgtggngatgtggagattaaaatatatgtatttgagttggggaatttgaatattgtgagttttagatgttggaaatttgggattttgnagttttgttttttgaaaatgattaagttttgttagtttgtgtttttttttttnatgttttttgggaagatgggtggtggtagagtgagaaggttattggttttgtgttgnagtatgtaaaatttagaattttatagattagttttatangtagtgaggatttagatttagagaaattgattaatatttatttttgtatttgtgtgtgtgtttaattttgtaggttaataaattaataagataaatga

SEQ ID NO: 724771 - DNA, 138 bp, Homo sapiens
aagagacgagatggagatgatatcagtttacgggggaaggcgctctggtgaaagtaggtcatcatttctcttggtccttgtcgttcaggcaggaatttgaagtagatagaaaccgacctggattgactccggtctgga

SEQ ID NO: 724772 - DNA, 298 bp, Homo sapiens
acacagggtcagtttatataaagctgtggtaaaaatataatgagatatacaaatcattcagtgtattattagctacataaaactattcttagttcctttttcataagtttcacatgaacattaaagctgaatataattagatctcatacatggtcatcatggttcatgattttcaacagcagcattcatcttttatagcatcatattaaacatacttaaatgtgtataggacagcacatgaagctgacccatgaaaccaaagtgagccatgaattcgtaactgtagcaagctcaaaag

SEQ ID NO: 724773 - DNA, 1235 bp, Homo sapiens
ctggctattgggggagccagagacaggggaaggcagcctgtccatctgtgcataagagagaggaaagttccatgtgatgtgtatgtttcacgggagcttcacatggaggagctgcagatagatatgtggtttctgtgtatgctgtactgtctgccttgttttctctaagtgggggcttctacaggctttagggaagtagggtggactgtggagtaggtgctgggaggagcggggccacagcgttaggctttggacgctcatggagtgtacatacactaaagtacggagcacgctggagacgtgatttctggtcatagatgcaggcatgaacgggctggcagtgaagtacaggtacataagttctcagtgtttgcttatagcgttgtgggtcaccgtcttgtaactgtatgtagcagatgtttacagtcttagcggatccgggactggcgagaccccaggtttagcaacagggctcggtcactccgtttaatccatctactcaaacaagtgtactcctatttactttgttagtattaaaaacgaaaagtcacacaaataaagtactgctggccgtgagaaaagagacacatcgaagagcagacagagcaaaaaagcaagaagcaacaacaacaaataccggcgcagcgaacccgccattcccgagagtcgggaacggcaaaaaaccaggaactctgtccaataagggccagatgagcgtcgacatgagacgacagaatccgtgcacccactcccatgcactggaaatttgaaaaaaacagcgggggaaaaataaacggacaggaaggtaaccacacgagcaataaagaagaacgagcaccacacgatgttgccaaaaaacaaacgccaagaaaacaacgtgacagtaaccgacagagacggcaggagatatacacaacaaacgagcatgtagaccagtagacgcaagtcaccagcttcatacccggggataaccgatacacgtaataacacaggggagagaagcaggtagcggaaagccaacaaaaggctgatgacaacagcaacatcgtgatcgtcagagtcacgcgaacaacacgccacaagctagtgcccaatgacacgctgtgagaacacctgagccacgacaacccgcagcagaccaaacaactaaaaaacgcatcgaaaacacggagatagccgcgttcacaactgacccgacgcagcgatacagacctgcgatacgacaataagactcc

SEQ ID NO: 724774 - DNA, 168 bp, Homo sapiens
gatcatcaaagacaaatggatcttctattcccatgaggagcatgtggacaccaaaacctccctcttcagaatggaggtatgacatgataaaatgagatgtggtgcttgacgtgtcacatgacaaatcttgaaaggttactaattagtgggcctcacttgttgggggca

SEQ ID NO: 724775 - DNA, 482 bp, Homo sapiens
cacgatgatcacaattcgtcctcatagcaactccatgaggagggcgttagtagcccagtttctctgtcctttaaagcctaagagagtgggataacttcctgaggtcaaaggacccaccatatgaagccctgggaagacgctgctccatttgggaccattctcaagcagttctataagagctgcatatctttacctaaaatctaaggtcagccacaatggcctccaaaaacagaactcctctcctcccactctgattgctgatgaccacgccgtcgggatctggcgtccaggagaggacggctctggctgtagaacttgctgtgtttcctgcatttatggctgcactgaccccaaaacagcgctctgttctctgcttttaatctactctgactttgaaggttctattgaggatgtttcctgcctgtatcttgtttctcctccctcagcacagcctccaaattaaaaaacgaaacaaaacaaaa

SEQ ID NO: 724776 - DNA, 344 bp, Homo sapiens
cggattcggtatcctgagttccgtctatttgccgttttgaattcttgtcttccgaaataggtataagaaatctcccaccagtgaatatcaaacaggtacacagaactatatgtagaagaattagaaagcaaagaatacttacaggttcttatctgtagatatctgaaaggattgagtgtgaagccacgaatactgtgcaaggaatcatagtactgctactcagctttgcggtactagtctggtgaccaaactggtggatggcactggccatagacctcagtacaggcttcggactctgtgccgggccctgcgacctgctgcctccaatcacggtggaaaacatt

SEQ ID NO: 724777 - DNA, 1002 bp, Homo sapiens
  misc_feature (714)..(714): n is a, c, g, or t
taaccattctatctggtgccaaatcttcacagcgtggtgacagtgggtttaaatctctccactaactccactccccaagaaggagcccacccaaagcaaaaattcaatatttatccatcatcatcagagtgatccactccacgagaattatatcttataaccgtgatacgagctcatcatattgtggtagatttatggagaagggcttcgtattcgtgcccaagaagaaagtttccctcctttacagccgtgattctcggacgtggtctaccaaattgtgccacgttgtgggagacgtgatattatgaaggtgccataactctcctcgtgtgcgtgggtgagagaggtctatacactaatcgagagacacgaccgaggagtggagagaacaccaatagcctatctcacacatatatctcgtgggtacaggacaaaactctatcctatgagaggggataacaaaccccacagagagtgtgtgtgagagatacacaatctgtgaggaaacaaatagagctctgaagacaaaccaagactcacctctgagaatctgagcgatcacaaataccacagaatcacacgggcgtgagagagacataggctcatggtgcaacaaacaacaaagatggaagatacacaatcatataaactgcgggtgacgagaatgcgcgagacaattaccaaaaacggggaaaaacacaccagatattcacnatatatggacgaatggcggaccatactataacaccatggggggagaacaaaccccaaaatgtatatggatcatgtggtcttcataccataaaacctggggattctcctatgggacacaacaagacaagagcatattctacttattagacaaaggaagtacattctatggagagccactaggacacaaagggcgttctttcagcaacagtgatataagtataacagacaattaaaggatctaagagtagtagaaacaacccacaccaacttgatgatgtataggccagg

SEQ ID NO: 724778 - DNA, 178 bp, Homo sapiens
gagagaccttggtctcgagcttataaaaatataattagttcacttttaaccaacccttcttacagatatattttaattttttataagaaacggagatattaccgctcttttacaccccagatttgggggtccccataggacaaatattttcggttttatttcgtttaccccacccact

SEQ ID NO: 724779 - DNA, 369 bp, Homo sapiens
cgactgagatcgacaaggattgccaaggaagaaggctttaatcgggtgctgcagccagggagataggagctcagtgtcaaatctgtctccctgacctactaaaactagaggtttgtatagcagggaagaaatgtaacaatgtgtaacattttgggatgcagtcttgctctgtcatttaggctggagtgcggaggcctgatcttggctcactgcaaccactgtctcccaagttcgagcaattctcatgtcccagctactcaggaggctgaggcaggagaattgcttgaacccaggaagcagaggttgtggtgagccaagattgcaccattccactccagcctgggcaaccagagcaaaactccatctaaa

SEQ ID NO: 724780 - DNA, 379 bp, Homo sapiens
ggttgtccgagcacggaagacatcgaaggtatggtccaggaagctgagaagtacaaagcagaggatgagaagcagagggcacgatggtgtcatccgaagcaatcacttgagtcctatgccttcaacatgcaaagccagtgttgcagatgcagcacacttcacaggcacgcattacgatgcaggcaaacagaagattctggcacagtgtaaatgacatgatcaactggcttgataggacatcagactgttgagaaggcagcaatttgaccatcaacagaaggagctggagaaagttagcaaccccatcatcaccaagctgtaccagagtgcaggaggcatgccaggaggaatgcccgggggataggaggtgggtacccga

SEQ ID NO: 724781 - DNA, 138 bp, Homo sapiens
atcattcgcgcagtaggagatgactttcttcaggtagttggagttgagccatagtgtagcagtgtcctccaacaggtggtgtgaaacggaacttatcgatcctctggtgtaagtcgtggatctcctcatctgacgttt

SEQ ID NO: 724782 - DNA, 1042 bp, Homo sapiens
  misc_feature (229)..(229): n is a, c, g, or t
  misc_feature (264)..(264): n is a, c, g, or t
  misc_feature (273)..(273): n is a, c, g, or t
  misc_feature (277)..(277): n is a, c, g, or t
  misc_feature (291)..(291): n is a, c, g, or t
  misc_feature (306)..(306): n is a, c, g, or t
  misc_feature (310)..(310): n is a, c, g, or t
  misc_feature (325)..(325): n is a, c, g, or t
  misc_feature (349)..(349): n is a, c, g, or t
  misc_feature (441)..(441): n is a, c, g, or t
  misc_feature (443)..(443): n is a, c, g, or t
  misc_feature (471)..(472): n is a, c, g, or t
  misc_feature (483)..(483): n is a, c, g, or t
  misc_feature (487)..(487): n is a, c, g, or t
  misc_feature (490)..(490): n is a, c, g, or t
  misc_feature (493)..(493): n is a, c, g, or t
  misc_feature (497)..(497): n is a, c, g, or t
  misc_feature (503)..(503): n is a, c, g, or t
ggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggatttngtttagttgtgtgttttttttttttttccagggantgttgggcncttngcaatcctcaaacntggggttaccttggnggtntgggcttaactcagngacttgtacatttcagcaatagcntttggacgcaagttttatcagcaaggcaatttttccagttaataagggttccaaaaactcatgtagggattaaacttggctggaattgtcanangtttggaccctcaatgtcactggtacgnnttaagtaaatnggcntanatnggtnattaangttaaaaatatgcgctaggcctctggcttgtgtgcgcctggcggcaattattcccggagagttctcttttttacacatcttcaaacacgtgttgggactctggcgcacaaaaacacatctatcatcatcatcgcacgctactatacacacacacacactactctttgtgttttcggcgacccgcccacatttgggcgatcctccttcgggaaaaacaacgcgttttttgttgacagaaccactcttttgtggtctgtgggggagaccgcgcgagcgtggtccccccccataagggtgtataatgtgtagaacaagtggtggggctcacaaaaaagaggggtgttttcccccaataggaggaaaaaaaacttgctgggctcgcggactcagagaaaccaaacaggcgagcgcggagaagaattttctccccttcacgccgactatatattaaaaaaaacagacgccgcccccgcgcgcgggggggagaaccatcagccaagcgagtcgtcgtttttgtttcagcaacaaaactatccttc

SEQ ID NO: 724783 - DNA, 399 bp, Homo sapiens
gtgatctagaggatttccgcatttcgtcccatcagagtagtatgaatctgctaaaattgaagcaagaacaaacatcaaatggtggtgaagcatggatggaagaattgtgaaattattgatgctttacaaaaagcttatggggacaatgctttagtgattgtccccaaagaagtgggcagtttacaaaaggataactcactttaagaaggggccagatgatgttgaagatgaagcctgcagtagcagactatccacatcaatttgtgaggatcttgttcatgctctaattgaagaggaccaacaattaacagtagaaacaatagccaacaccacagatatctcaattggttaggcttatacaattctggttgaaaaattaaagttgagtaaactttctac

SEQ ID NO: 724784 - DNA, 272 bp, Homo sapiens
ctgctgtgttgttgtgtcgatctaaggtccctgtggagctggttctcaatggtcgcccggggttgggagtggagtggggctatctcggttcattgcaagctccgccttcgaggtacacaccattctcttgcctcagcctcccgagtagctgggaactagaggtgcctgccaccaggctgggttaattttttttggtattttaatcagagatggggttctccggtgtaagccagggatggtctccatcttctggaccttgtgatccggccggc

SEQ ID NO: 724785 - DNA, 184 bp, Homo sapiens
gattagagtagggttaggatgagtgggagagagaaagggaggaaggaagtggagaaaggaagggagaaagaatagaaaaggaaggagtggaggagtgaaaaatgattttttacttaagtaacaatatagcaaggaaggtttgtgagctatgattgtgggctgtaggggaaagcctggattctat

SEQ ID NO: 724786 - DNA, 450 bp, Homo sapiens
ataaactctgcattaaaccgtcagctgcggatggctcgacgatgactgtatccagcaatggtccgcgcgtaccagaagctcggcaaccacctgctgacttcgatgcagctcgaggacgcgcagaactccggccacagcttcgatagattcacggttcaaccgcgacgtccggatggagcagctcgacgcgctcgggcagctctgtcggtagcaacgagagtttcggtcgcgccaccgagaggggtgatacccagagcatcgcatcggaaactgcgacgacgacgtcgggcggtaccagcggtcggtcgatacacgacgagagcgttggacaagccaatcatattgggacgcggttcggtacagggattggcgcgaccgacagcatccagttgcatgccggcggaagtgggcatcttcggagtatgtattttcgcagggtggcggtattgc

SEQ ID NO: 724787 - DNA, 598 bp, Homo sapiens
gtggtggtatctatagctttgcttgtactcctcactgtttctgcctacgcaaaatatccatgtttcctctgagaaatctgttgtggactgaaagacgctgctggctgtgaaatttactaaagtgtgtatgctttgctaaaaaaattatttcttggacaataggaacagtcattgatactgtaaatcctggctcttaacagtgagtggccaaggacttgatcagcccatttcttgtgtccctcagtgcttgaaaatataaggtagcactgcatactcgtaatgttgaatatgactctagatgacttgtaggaggcaactgtgtgaggagatgctagcgtgtcagtgtacaatgatgctcatggcctgagtcagctcgagtatttctttcaagaaacacacttcagaggtgaagtatccagggtttccccggcctggacattgtgcagactgcgccaggcaggacacagccctgtaagaccacctagatgtgagctgataatatcctacctgcgtgatgaccacaaacgcgcatctctgctgtctcactgccacagccatacctccctctactcatactacatactgcccgtagacccta

SEQ ID NO: 724788 - DNA, 981 bp, Homo sapiens
gctgaatgtgctcccgcaaagaagggtggacgaggaagaaaaagaggccgttgctgccatcaacgaagtggtaacccgagaatactaccgatcaactattcagcaagacgcatccatggaggtgggcttcaagaagcgtgcacctcgggcactcatagatgagattcggaacatttggcctactgaagtgagatgggaactccagcatgtgcgcatttgacactcaggctcaaggaaatgctgtctgggccatgaggtacataaggaatgtgccataccgaactccggtgtgcggactgtccagaaaacgtagtgaggatgcaagattcaacatataaggctatcatagctttgggtgtacctatggtacctgttgaccactgttcaaagagatctacgagaccaggtcaatgtggatgagaactaatcggctgatcgtcagatcatataagagttataaatgttgcaaaaatgaattgacaaaaatgtcagaggtcatctaatgaagggggttgcgggcaagaaccagtgtaactgcaccatgggtctgtggcctgtagatagtagccgggacctgagctttcattgaccgcgaaaggggtgaatgtagccggactcccatatagtagccgaacgtctgttcttgaaaattgcggaaggagagccagtggtaacgcctggttgagtactctggtatacaggctattccctattaaccttggaaagtcggaccaggcctatgatcctggcccgtcggagcattctacaaggcacctttacacggaaatttccctaacttcaaggaaggtcgacagtccaacttccaaccacggttgcgggacggactggccgcgatccgaaagtctcccagtgaccaatgtggggtgcatctacctgcgaaggttagaggattctacccctgaaaaagctgtgttgactgcttgggtatccaggcgtgcacttcgcatgggaaaggaggcg

SEQ ID NO: 724789 - DNA, 920 bp, Homo sapiens
  misc_feature (919)..(919): n is a, c, g, or t
aaatagggtttaatttttttgtttgtgtgttaactctaaagctaaaaaagcttattatctaaaaccgaaatcttcctacttacatatctattttaggtactgtctatttgatgttgtcattactgtaagctttacctcctctaagattctaccaaacaagaaattttggggttagtttccttattgaaaatctatagtggatccactttgtacttctaggcccttccctgttctaccttcatctgcctccttttcatatctccatgctgcgattttcctggcccttatccctcttcagatataatgtcttatccttcattttattataatggggatattttctctctcttcacactttattttctgtctctcagaactgagcttatctccatttctgcttattctctagaacagatagtaagctagcagccaacgctacccttccctatcctatctcttcatggaagaccacattttatttatagagttatgtgtatttattgcatagcttcaggttctcttcagtatttgttaactagtttgctgaacaggtaaatagttgaaatcagtagtattaacttctttgccctttacacttttagatttattagtaactaataataatacatagcatatgccttgtatgaactgtgattcatacccggtctgacctaagtcctcttaactgaagtacactggatgcagaaaatatccggtacaatgttagccccgacgacccgtttatatgccgaagtaccagaacacgacgatgcgcccccttggcgtgtttgacctgttccgaacacggggggagggacacacgcacgcatgggcacgcctaaaaacgcggcacgcaaccaacggcccctcgacacacacactcaccagcccacgcctccaccctggttttattataatnt

SEQ ID NO: 724790 - DNA, 121 bp, Homo sapiens
ctcggtcccctggctctgaactttggagagcccggtgccgttatgagccgtgggtttattgtcacttttcctgtacgaccactgtcccgtatatttgcccgtgtcgcctttggtggactcc

SEQ ID NO: 724791 - DNA, 2273 bp, Homo sapiens
  misc_feature (366)..(366): n is a, c, g, or t
ctccagccgctgctcaccaggcagagcgagcgggcttggctggggcttcctgccctgagcgcgacaccgactgctccggaccgcgcctccaagcaggctgaagggcttccgctcttggcttccagaaaagtttggagaaagagaatttgaggcggattggagggtggtagcccctccccagccttctttctctcccagaagcctcactctgcacagcgtcccccattcttcccgtcctgattccccatcttcctgacccctccttctccctctcctgggtcgatcccagtcacattttctccttccgaatctcatcctccctcctcctctctatcccagtcctctgaacgatttccgcctatttgnaagccttctccctgtcattctcaacgcttctcctttctctccacctcccctgccactccattttatccatcaaacctctccacttgcatccacaccctcccttcatccttccctcccagcaaaccttgctcatggattctgggcctctgtgggatgccaaccccacccctcggggcaccctctctgcccccaatgccacaacaccctggctgggccgggatgaggagctggccaaggtggagatcggagtcctggccactgtcctggtgctggcgaccgggggcaacctggctgtgctgctgaccctgggccagctgggccgcaagcgctcccgcatgcacctgttcgtgctgcacttagccctgacagacctggccgtggcgctcttccaggtgctgccacagctgctgtgggacatcacctaccgcttccagggccccgacctcctgtgcagggccgtcaagtacctgcaggtgctcagcatgtttgcctccacctacatgctgctggccatgacgctggaccgctacctggctgtctgtcaccccctgcgcagcctccagcagccaggccagtccacctacctgctcatcgctgctccctggctgctggccgccatcttcagcctccctcaagtcttcattttttccctgcgggaggtgatccagggctcaggggtgctggactgctgggcagacttcggcttcccttgggggccacgggcctacctcacctggaccaccctggctatcttcgttctgccggtgaccatgctcacggcctgctacagcctcatctgccatgagatctgtaaaaacctaaaagtcaagacacaggcctggcgggtgggaggagggggctggaggacttgggacaggccctcaccttccaccttagctgccaccactcgggggctgccatctcgggtcagcagcatcaacaccatctcacgggccaagatccgaacagtgaagatgacctttgtcatcgtgctggcctacatcgcttgctgggctcccttcttcagtgtccagatgtggtccgtgtgggacaagaatgcccctgatgaagattccaccaatgtggctttcaccatctctatgcttttgggcaacctcaacagctgctgcaacccctggatctacatgggcttcaacagccacctgttaccgcggcccctgcgtcaccttgcctgctgtgggggtccccagcccaggatgcgccggcggctctccgacggcagcctctcgagccgccacaccacgctgctgacccgctccagctgcccggccaccctcagcctcagcctcagcctaaccctcagtgggaggcccaggcctgaagagtcaccaagggacttggagctggcagatggggaaggcaccgctgagaccatcatcttttaggaaagactcgctggggtctggtactgcccccaggactagtggaggttctctgcccacctcaggcactggaaatgagagctgggagggtaagggttggagttagaggaggccctgtctgaagcagagccaaaaggccagaatgggtcccctaccctggtgtcacagctgcccctagtgtgagggctgcctcataagctcccaatctcagacactggcagtcagggagaatcaaactgcctgtctccctggtcctgccatattcatagggtgtccatgcacacatggtgtcccagatctaggcaggcctaggatggtgctgtctaggggtccacgggtggcaggaattcagaggctggccttgtgccctggctacctgtctccattctaacctgactggcacatctcagcctaaccaggagaggggagaagtgaaaaaccgtgaggaggactctatttggatcctggatttgttgttgttgttgttgttgttgttagagagaa

SEQ ID NO: 724792 - DNA, 279 bp, Homo sapiens
  misc_feature (80)..(80): n is a, c, g, or t
  misc_feature (82)..(82): n is a, c, g, or t
  misc_feature (111)..(111): n is a, c, g, or t
  misc_feature (114)..(114): n is a, c, g, or t
  misc_feature (161)..(161): n is a, c, g, or t
  misc_feature (170)..(170): n is a, c, g, or t
  misc_feature (173)..(178): n is a, c, g, or t
  misc_feature (249)..(249): n is a, c, g, or t
  misc_feature (273)..(273): n is a, c, g, or t
aaaatgtgttagtgtgctgtgcaattggttttcaattcatattaatcttaatgacagagaacaatgtgttactaattatntnggttgtatgccattagtaaattgataganaanttaaggggattaacataacttcatttcattgccttatattacatctnataatacantannnnnngctaagggaaacagatggagctgtttattgagacaactggtgaggaattatcatgtgttcattcctatttnagagcgtgaactcctacattagantatata

SEQ ID NO: 724793 - DNA, 1983 bp, Homo sapiens
  misc_feature (76)..(76): n is a, c, g, or t
agcggaaagcctgctggtataagatggtcaattactttggtgcttgaagtcctctgaacgatttccgcctatttgnaagccttctccctgtcattctcaacgcttctcctttctctccacctcccctgccactccattttatccatcaaacctctccacttgcatccacaccctcccttcatccttccctcccagcaaaccttgctcatggattctgggcctctgtgggatgccaaccccacccctcggggcaccctctctgcccccaatgccacaacaccctggctgggccgggatgaggagctggccaaggtggagatcggagtcctggccactgtcctggtgctggcgaccgggggcaacctggctgtgctgctgaccctgggccagctgggccgcaagcgctcccgcatgcacctgttcgtgctgcacttagccctgacagacctggccgtggcgctcttccaggtgctgccacagctgctgtgggacatcacctaccgcttccagggccccgacctcctgtgcagggccgtcaagtacctgcaggtgctcagcatgtttgcctccacctacatgctgctggccatgacgctggaccgctacctggctgtctgtcaccccctgcgcagcctccagcagccaggccagtccacctacctgctcatcgctgctccctggctgctggccgccatcttcagcctccctcaagtcttcattttttccctgcgggaggtgatccagggctcaggggtgctggactgctgggcagacttcggcttcccttgggggccacgggcctacctcacctggaccaccctggctatcttcgttctgccggtgaccatgctcacggcctgctacagcctcatctgccatgagatctgtaaaaacctaaaagtcaagacacaggcctggcgggtgggaggagggggctggaggacttgggacaggccctcaccttccaccttagctgccaccactcgggggctgccatctcgggtcagcagcatcaacaccatctcacgggccaagatccgaacagtgaagatgacctttgtcatcgtgctggcctacatcgcttgctgggctcccttcttcagtgtccagatgtggtccgtgtgggacaagaatgcccctgatgaagattccaccaatgtggctttcaccatctctatgcttttgggcaacctcaacagctgctgcaacccctggatctacatgggcttcaacagccacctgttaccgcggcccctgcgtcaccttgcctgctgtgggggtccccagcccaggatgcgccggcggctctccgacggcagcctctcgagccgccacaccacgctgctgacccgctccagctgcccggccaccctcagcctcagcctcagcctaaccctcagtgggaggcccaggcctgaagagtcaccaagggacttggagctggcagatggggaaggcaccgctgagaccatcatcttttaggaaagactcgctggggtctggtactgcccccaggactagtggaggttctctgcccacctcaggcactggaaatgagagctgggagggtaagggttggagttagaggaggccctgtctgaagcagagccaaaaggccagaatgggtcccctaccctggtgtcacagctgcccctagtgtgagggctgcctcataagctcccaatctcagacactggcagtcagggagaatcaaactgcctgtctccctggtcctgccatattcatagggtgtccatgcacacatggtgtcccagatctaggcaggcctaggatggtgctgtctaggggtccacgggtggcaggaattcagaggctggccttgtgccctggctacctgtctccattctaacctgactggcacatctcagcctaaccaggagaggggagaagtgaaaaaccgtgaggaggactctatttggatcctggatttgttgttgttgttgttgttgttgttagagagaa

SEQ ID NO: 724794 - DNA, 251 bp, Homo sapiens
gggcaggcgggatgagaagtgacatctgcgtaacaaagagtatgttcctcgataagtctgataaagagcaatggaatctactagcatataagcaaacctaagccaaaggaacggaaagccacgaagaaggcacaagtcacaaccctcatgacaaagtacggcacaagtctaccaataagctaaatcagaatatacaaatacaagtgtcccaggctagcattgactcccgctcattgagagtgaaactggat

SEQ ID NO: 724795 - DNA, 174 bp, Homo sapiens
actctagagatcccggaggttacggcctgcagaagtacacgatcctggaagtctcctctggctgcttctcctctgcctcacgggttgcttcctcgccttcttgccctcggcttctcctccttgtcttccttcttttcctcctcctcgtactccacaggcacccagtacctgcag

SEQ ID NO: 724796 - DNA, 545 bp, Homo sapiens
  misc_feature (458)..(458): n is a, c, g, or t
gcacgaggggatatactcttcaaatcagagccgcgggaagagcgcgcgcgtgtggctctcctgtgtctgtgacaacactgtgacatcgagaccagagcttggagccgcagctgtgagccaggcaatgaaagggtggcagaattctgtgtaagaactgtagaaaatgagcaagtttcacagaatcaatggcatttcacagaaggggctgtggatattaatggagaggaatggcaactggttgaatgggctcagagaaccctggattgggaagggaaggtggagaactcttgaaacctcaatttagagggaagtgcaattaccaaaacacaagtgagcctcaaggtggagcaagggcaagaaccatggatggtggaaggagccaattcacacgagagctcttcacaatctgagtacccacttggtgatgaaccacagaagcattggggccaagacaattntttgaaggcaggtttgctcacatatcaattattgactatggagagagaacaccactttaatatgagcgcacaggttaattctgagag

SEQ ID NO: 724797 - DNA, 473 bp, Homo sapiens
  misc_feature (64)..(64): n is a, c, g, or t
  misc_feature (72)..(72): n is a, c, g, or t
ctgtctctacctgctgggaaatggaccgccgaatgtgtctagtccctacctgccgggaagatgnacccgccntcttgaacgtgtctagtccctagttcctgccgggaagatggagccgccatcttgaacgtgtctagtccctagttcctgcccggaagatggagccgccatcttgaacgtgtctagtcgttagttcctccgggaagatggagccgccatcttgaacgtgtctagtccctaggtcctccgacattcacccgtacaagctcccagctggcttgtgtatgtctgcagctcgacttgacaggctgttcattgttagaaaatgacttggggctgcttttcgttaaggagaaaagctgccgggcgcagtggctcacacctgtcatcccagcacttttggaggctgaggcgggtggatcattaggtcaggggttcgagacgagcctgaccagtgaaaccgcgtctctact

SEQ ID NO: 724798 - DNA, 271 bp, Homo sapiens
ttagaggatccaaagacccgaagacagctcacacaggtactcccggcttcgcttcttcaatcaccaccaccaagaccacctcacacagtactcccagcttcacttcttctattgccacctccaacacaacctcaagcagtactcctggcttcacttcttcgatcgccaccaccgagaccacctcacgcagtactcctggtttcacttcttcgattgtcaccaccgagaccacctcaccccatactcccggcttcacgtcttcgggtcgttt

SEQ ID NO: 724799 - DNA, 758 bp, Homo sapiens
gtgacatgatacgagcctggggagttacagcagtggtcaggggcttcctaggagtactgagaacagaagtgtgcacgagacgactagttacgacacgcagcgaaactagagaaaccattgtgtgtgagatctcatacctagagttgtttattttagaaagcctcacaaagaagcctctagtaagatactgtagataattcccaacttaaatatgctgtcttgaaacaatcctcttatatcaatttatacattgtgctttccctttgaagtctaaggtggataggggcataaactttggtgatgattaatagtaagttcagatcctgaaacattctgtctctgtcacgcatcattcttacctgtacaaaaaaaggttactaactacactcacattctcatggatataaaggaagattcagagggataatgcatacaaagattgttgacacaatgcactggatccgacatcagatagagacatcgagcaaatgtaaacataatattaacggctcctgaataggacctataacaggattacccaaccatatatttaagaaaatgattaattaaaaatgctatactacttattagggtgactggacattctgcaacgatgacagtaaaacacaagacatactgcctttggaaggaatgcacacagatagaagatgaggatatgcacaatacctcatgtagcacaacatccaccagtaataatagaacactgggaaaatgctaaagctgggcaacagacagtg

SEQ ID NO: 724800 - DNA, 212 bp, Homo sapiens
ataaaagccagcccagctatatcatcataaggagaatggccagtcctctcccaagtccacacaggggaggtgatagcatagctttcgtgtaaattatgtaatgcaaaatatgttgaatcttcgccttaatacttatagataatgtaagtctttagaatgatgagccttcgtgcccccccttcccccttttgtgtcctccgtcctccggccta

SEQ ID NO: 724801 - DNA, 326 bp, Homo sapiens
tgcctcagcttatcagcagcgcctcccaaactcttgaggacatgtggggaactacagctgggagtaagcaatgagacagtggtaatgagtgaggaggcggatagagtggatgctgttatgcccagaatggctcgtgactggtgggggacagaggccacggcaccagaaaacttcctaagggcttaatccgtcgactgttgtcacaaacgcatttcacccagagtggaaccggcagattttagccagggctcaggaggtctccatcaagagaggctcatcagagaatgtgagcaaagagaaggggttccgagctaacgactaacttc

SEQ ID NO: 724802 - DNA, 218 bp, Homo sapiens
gcgaggtgattagaggatcccggacggagatgtctgagtgagcatcttcatatgtgctgaaacaatgagtggttcaggtattcagtagttggtgcactttatatacgttggatttattaactgtttgagaatagcaccattagggggagattctgttaatgaatgtggagggaccagtattaatcctgatcttctttctttccccttttttctttttc

SEQ ID NO: 724803 - DNA, 830 bp, Homo sapiens
agagattctggcttacagtgccccaatctcaatgttttcataggttgctgagctaactaatgtgattattgagtttacagatttaaataattgtcactgttagagtatctactgtatttatagaagtcaaacttatgctgcctcagaaatccctgggtactgaaatggtaacatggaagtgaagaggtcactttgaaatattggtgagtcacacaagattaaaggaaaaggatcagtttgcagtatactcgaagaataaggttattgaaataattactgaacagcacattttctctctaaaaagtagtttcatgatgggttgtatttttaaagatcagattatcatttccgatatttggtgccaaaattgttgtaccttaggttacttgagagccagatttaatcatcattgaacattatgtggacttgtgtgctttcactacagaatatgtggaactgtagagccataagtatgttcgtctctaataacttgtcgattgcaaatatacagttctataaacaaaacccatatgtatatataaaatgtcaattttgcggaagctctggaaattataactatagcatctaagtttgagtctgtatgggactaaataagcaccatggctttctcaaatgattcagaaattaactcttttatttgcctctttatgttgatggtggttcggtttccagtcattgaagtagtaaaagccgtgaaacttgtgcaatggatggttggaaactgtcccgaggtatatctgtttgggttgtcctttagccgaggtgggcaaattaatttaaagtacgattaagtcagggaggtaagtaac

SEQ ID NO: 724804 - DNA, 261 bp, Homo sapiens
  misc_feature (38)..(38): n is a, c, g, or t
  misc_feature (77)..(77): n is a, c, g, or t
ggtttttgcccccccccccccgggatttttgaaaaggnccccggccccaaaggggtttaaaagggggttgccccttngaaattttaaaggtttggccgggaaaaaccctggtttttgggggggaggggtttccttccaatttcccccccccaagggaaaaggcttccggttaaatttggttttttttaaaagccctttttttttttttgggggggggggccccccccccaaaaggttttttaaatggttttttgccgccca

SEQ ID NO: 724805 - DNA, 1150 bp, Homo sapiens
  misc_feature (591)..(591): n is a, c, g, or t
  misc_feature (743)..(743): n is a, c, g, or t
cccctgttccccagataatcccctccagtcagaaccaattttcccaaaattaatgtttcttccaccggacccaatgggaaaagtccccccccggcaccaaaagttaacttcaaaagcccaagccctaaaaagatggttcttcgaatttgccttttgtgatccccttactccccccaagtacctgccacggtccctgatattgaggccagcacccgcgaggtctcccagatggatgcccaccacagcggtcttgtataacctcggggaaccttagtcactatggaaccccaaggtgttttttgacgcacgaagtctgtgtcttgtaaagccaccactccaacgaggtggaggagctctgttttctaatggtgtgaagaagagacgaaaatggtggtggaacacacagctgtgccaagagaatttttggggttttttttggaaagggaaaggagggagaagactcgcttttaaactctttgtgtccgtcgccaccacacgcttttgaagattttttggagacacacacatagacaccccccctcatattttccccttctctcactcacgctcacgagaacctcataccctcgncacacacacaccccaagggggacaccacgcgtctctggtgtgagaggtgaacacccacgagtgggcctctcttgtgttctcccaaagcgccacacacagtctgttctccacgcgctgagcaccacgagcctatatacactctccccaccccnccacgagcccacggcgccaaggggaccaggttctccccaagtgtccctcttcccacgcacaaacacacaccacgcggagaccacacaacaccactagccaccacacaaccgcgtgaaactcgtgagacctcgtgcacccctctcctctggtgtctccctcccctctggggccctcaacacgggtaacacacactctacctcttggcccctcggttttgtgagaaaaattccgctgttcctcgagcccacttgtttatgttttgttcctaccacatttctatatttcacatacacattttcacaacacatttataaccttgtaaaaatatagagactgtgaataattattaccataaagtaatttaaaatatgaatttaaatattcctaccagtctttagccatggga

SEQ ID NO: 724806 - DNA, 117 bp, Homo sapiens
acccggcctgcctgcgccagccacatacgaaacacaggaatgagagtatctgtgttccaagaaaactttcttgagtcggaggcggtcgctctgttgcccaggctggagcccaatggg

SEQ ID NO: 724807 - DNA, 515 bp, Homo sapiens
  misc_feature (9)..(9): n is a, c, g, or t
aacgactgngtcctcagtctacattctagtggttctgaatatttggctggtctaaatgacaccacacggaagatgggtgatacctgaagtataaaatcctagtaggatcaggggtcaaaggctgtattggtttttaatatacatagatatggccatatggccctccagggcttacaaccttataaccgttcattcgttttatgaactggcatatagtgcttacttggtgctagaaactatatcaaatgttttacaaatattaactggtttaatccccaaagctaccggtaggggagaggtattattattatcacagtttggctgatgaggaaacggaggcaggagagatgaagtaactggcccaaggttcacctcaagtagcagagcagagattggaacccacacaatcgggatcggcggtgggctcttaatcacggtgtggaggcggtttttcccaaaccggaaacctacagggatggcaaatattttcacctgtcctaatctgatcagtgaga

SEQ ID NO: 724808 - DNA, 722 bp, Homo sapiens
gttctccctgatatgagcgtctccagatggcccccctggagaacatgtgtatgtaatccatggccgctctatagttcttatgatggcttctaagtatcaacaaacttgaaatagatcataactcgtatcatagatatatgtacgcctagcctcatcaggggaggcttcaagatggagttgagtgtacaatatcctgtcatgggtaacagtctagcccttactgcaatgtcataaggctgctcaacactcctgatttgacacacgcaagacagagacggaacgtcggacatatgcgatcatctgtaaaataatccaactaggagcataaatataacagacatagactatgcctacgagcacatggtcacacgattccatcctagtgctaaatacgagttgcaagcagacacgtcaatactgttctttgcgtcctaggtatactcattgagcgtaggttcatgccctatatagcctcctcaccaatatgactatttccatgcaaacaaaaagtcacagagcatctgtaacttgtaatcgatatttataagtacaatgaacatctgagtattcaagaatagagatgggttcaacgagaataaaaaatctttggtggtatgtggaatatatatgggatctatgctgtagtgagcactactagggggaatgtagagtaagtgctctacataatgggtgtaggtcctcccagagttattctgtggtcg

SEQ ID NO: 724809 - DNA, 337 bp, Homo sapiens
gtagacctcaagttgaagtccgtgggggttgctgctttcgcagcccatgcactgggacgagtgtgccggcagtcttgcttcgggggtcatctctgatcgttgtccttaactcagcccgccacctacgcaacagggtgcggggggatcgatgaggtgtgggaaccggtcccgaacacggtctgtgctcaccactataggtaatactgccagtacctgttactgtccattacgcacacgcgaatggagtggcgcacaccacgcgcactatggggggagatggccatcaccaccggcacaggcgttaaccgtctgctagacggcgcttgcacttttggga

SEQ ID NO: 724810 - DNA, 245 bp, Homo sapiens
gatatcgcacagcccagcctccgggccaccaccctgtgaatgtaggtcaggtggtgacccatcttctagatcagcttcacttcctcatctaggaagtgagtctaccagagaagtcacagagatgggaggtccgtgctgggcacgaacccaagggcatgacagatccaaacagggcctggtaacagctattattctccagggaccataggaagcttaacataggcgtactgggagttttaaccccc

SEQ ID NO: 724811 - DNA, 376 bp, Homo sapiens
ttttgttttttttaaggggttttaattttaatttttgggagtcggggtctcgctcggtcacccaggcgggagtacaggggggagatcatagcttagggtagcctcgacctccggggctcaaagatcctcacacctcagccttccaagtagtggggactacgggcatatatcatcaggccgggctaaattaactattttatttaaaagagatgtggtctagctatgttacccagggcgggtctcgaactccgggcttctagcaatcctcccacctcagtctccggaatcacggggattacagggcgggggccatcatgcccagctctaggtttaaaaatggtaggcaaggaggtgcggacgtgggggtaccggagct

SEQ ID NO: 724812 - DNA, 1314 bp, Homo sapiens
ggcactgatttcccctattctcaggctacaccgatgcatacaccacatgaaacatccgtatcatctgtaggctcatatcattctctctaagcagcagtcatattgactaatttggcatggatttagcacgaagctcttctgcttcgacagcgaaacacgtcctaatcagtcacgacatgcaaccctcctataaatctggaagttgactcatattggatgccccgcacaaccgtatcgacacattcgatagaacccgtatacataaaatctagacggacaaaacggaaggaatcgaatcgcctcctaagagctggtttctcaaggctcgagacccctattgggccttcctatggagttctttgcagaattgagaacacactgaacggcatctgaggaatctacaacaaacgagagaaaacaacaagaaggacgcattcggcggtcctattagcgaggggagtggtgcctgaaggtgatggaaccatcacatccgtaccttgcacacaccaccgggaccagcattctcgcacctactggggcatccatcagaggacttaaaaaaggccaatcgaaacgacataatgcgaaatcacaccttgggcctgttgtagccaaacgcagtaccaactctggtcccaaggcactagcagacagccaaactcaagcaagcatggagaatagtcaatcccgggtagggcacacgagctataacttcgggcccccccaaacaacaaaccacaagtcaccaaacagccgctcaaatttccaattccgattcattcgcctaggacagaggaccttggggtgcaccaaacagacttggggttccaaaagggtctagttgcggaaaccacctgggcctccaaaatgctggccaaaggcgtcgacaaccgaaacccaaacagcccaaacaacttatgggaccaacgaaacaagggccataatactgcacaaacaaactggtgatcacacacctacgctcctccattcccacgaaatatgggacttccacccatcactttggtagacctttctactagggcacagggcaagaaggggattagcgcccacgcggaccaaaggcgcatcagaccgggggacactcatctacaacacacgaaaagggcaaaatcacccatattaacgaccgcctcaaacgaagatcgagtgggacgagacaaattcaaatagaaacaggccccctacgtaggcttctcgagccctctttacacacggcctccaacttgggatcttagctgagtgctcaggcccaccaactggcccgcccaagcacaattctaaacgataccacgg

SEQ ID NO: 724813 - DNA, 561 bp, Homo sapiens
  misc_feature (123)..(123): n is a, c, g, or t
  misc_feature (201)..(201): n is a, c, g, or t
  misc_feature (417)..(417): n is a, c, g, or t
accaagattcggggagttcgcagggccttgatccaggtccccggttaccagtttgacttccccagggggaaccagtacgggttgccttgggtgtacgcggagcacccaggggatggcttattnttaagggccaccggcccttggggttccaaaatgcggctattggaaaaagggttttcacacccggtgggggggttcatnggggtgcccttggggggccaggaaagaatccctgctttcttaggttggttccccctggggtttttaacccgccagccgggggggtagcctgcgggttggggggaaaaccgggagccatttggttgggcttgacttgagggtcccctgccccgccagcccagggtgggggggaggtcttgcttttccagccccaaagggcagcggcatgtttacaanacacgttgggccctaggtggggtttcctgtggggggggccggccttttttccaggggcagcccccaggggtccgggggctgggggggggggggggggcccccggcgggggttcctccccttgggaaaaaaatttttttccccta

SEQ ID NO: 724814 - DNA, 1490 bp, Homo sapiens
  misc_feature (212)..(212): n is a, c, g, or t
  misc_feature (357)..(357): n is a, c, g, or t
ggtccgccccgaggagcacagagcctcgccctttgccgatccgccgaccgtacacacccggcgcactagctcgactcgatggtagtgatgatctctgctcggcgcatcgtcagtaaggagtggatcggacgtccggagagtggtcgcaatgcctggcattctcggggcgaacggatgcctcccacagggccggtcttccccttcacatctgntggggctgctccctaggctgacgcatggacgatgcataggttaggtgcatggcgatcgaacatagggcattccgtatggtggtgccgacggaagagccccgagtagccagatgcagcatgtgcgcatcacatcatacacacatgnaaagtatacgcgcacaatcgggagacagactggtaattcgtgtcggacctcaaacgttggagcacgggaccatagtgcaggcacacactatctttgggcgacgccaacaaacgttttctaacaaattcgaaggctgtgtcgttgtttgggcaatctcgcagaaggggagccctaacccgcaccgcttgcaatggcaatgaaccgggatgagtcgctcactctcattgtagaaacacgcgcaataaaggggccccaaacctcaggcggaaatggaaacggtaattggaatcgccgcgaaggcaatcgagttgattctcttggagggaaccctattttcgaatcaaccccgcgccaagagcggcacagtgttgttcacttttttggccgttaattcccaagcgggtctatgtttggccctacaattaccgccttgagttcaccctggcttcgtcacttaagagttcccgggctagaccccaacagttgtggattcaacttcagagtgcaaaattggggcaagcgttcccccggagtttttggaaccctgggggagcgcatttcgaaaccacaccaaaggaggagacatttgggttggtccctcatccatctacgtaaaacgtaaacgcgagggggcattaactttgtttccctccattaacctggaccgcaccatttgttaggccccaaattggccaccatgggcacggattttctcttggtgggaaacacccttgcggcgttctaggtggaccaccgcggagcgaaaagcgcccttggtattcttggccacctttaagggcccttccaatttgtgaaacaaggcgaagtttcgcccgtatcaacaccgcctgtaaaaagcaccggaaccgggggctattacaccctaagacaccttattttcggagttcgcccaaattgccgcaaccgggcgagccacccgtgacacgaccggggggggacaacagaaatttcccggggttggcccgtgtttgggaaacccacatctttgtcacacccgcgggaacatggcacaagggcctgtgggattgggctttgaaacacggtatacgcgggtcacccccttgtgggtagacccctcattcttcgtaaagggcgcaaaggaagggaaactg

SEQ ID NO: 724815 - DNA, 760 bp, Homo sapiens
  misc_feature (305)..(305): n is a, c, g, or t
gctcgggaagcctgacatcgtgtgccagtcctgccctgagcaattctctgaacgccgaccgcccctcgatgcgccacgggacaggaacaaggcccgagcgtggaaaggtcgcagagctagcgtattcgctctagaggatcaatcggcacacatagtatagcgaatgaattgtcctgaagaaggatcatctgtgttgcagacgaataacacactggtgaggactgcctcaggtcgaggaatggcacgtcaaggagtcacgaagtgattcccattcgcctggtgaatcggaccgatgcggtgtcgtngaagtgagggtctagagaaacggccagagttactggctgtctatatcgtcaccaatacctgtcacgagtgccaccttgcgagatagacaccaacaccagtccttctgagatatacatagtgcttgccacctctatatattgcggaggcgtgaatgtgagagattttgtgtgatttacacactgagaggccacgtgaccgtcagcatagtaagaatcgatgtggtagcattggttggactagtgcaacacatatcccagtgttggcgacgccattgacattgccactcggaatgtggtgggggtagggccgattgtagggtcggccccatttcgattggattaagttcccgagcgttgattggtcgcgagggctccccaacgaaaaaagcaaaggcgtaagaagtttccggtcccggagttgtgccactccggggaagggggaaataaccggaaaa

SEQ ID NO: 724816 - DNA, 715 bp, Homo sapiens
cgagagtcgtcggggtgtacctgcgttcaacagtgctcggagggaacccggcgctcgttccccagcccgggcggccgcccatagccaggcctccgtcacctcttcaccgcagcctcggactgccccaaggcccctcgccgccgctccagcccgcgcgcaggcaccgcggcgacgccgcctctccttagtcgccgccatgagaccggtccacggctcgcaggtgcgccagaattaccaccaggtactcaccaggccgcacatcgaagcgccagatcaacctggagctcgtacgcctcctacgtttacctgtccagagtcgttactactatgaccgcgaagatgtggcctggaagaacctttgccaaaatacttgcttcacccaatctcatgaggagcagggaacatgctgacgaaactgatgaagctgcagaagccaagcgaggtggccgaatctaccttcaggaatatcaagacaccagactgtgatgactgggacagcgggctgcaatgcaacgagtgtggcatcaacattatggaacaaaaatgtgaatcagtcactaactggacacagcacacaaactgcgcactggaaacaaatgacccccataaggtgttgacttccattgagacaacattacctgaatgagcaggtgaaaacgcatcacaagaatggatgacaagtgaaccaactagcgacaagaagggacgcgcagaa

SEQ ID NO: 724817 - DNA, 328 bp, Homo sapiens
  misc_feature (6)..(6): n is a, c, g, or t
  misc_feature (27)..(27): n is a, c, g, or t
  misc_feature (35)..(35): n is a, c, g, or t
  misc_feature (74)..(74): n is a, c, g, or t
  misc_feature (77)..(77): n is a, c, g, or t
  misc_feature (116)..(116): n is a, c, g, or t
  misc_feature (130)..(131): n is a, c, g, or t
  misc_feature (136)..(136): n is a, c, g, or t
  misc_feature (259)..(259): n is a, c, g, or t
  misc_feature (272)..(272): n is a, c, g, or t
  misc_feature (284)..(284): n is a, c, g, or t
  misc_feature (303)..(303): n is a, c, g, or t
tgattngcatttccctgataattagtnctgtttcnagttctttgacttaaacagagatccttctgagagaaatncanttagtcattttctatggtagggagaaatccaccataagncaaagaggccaganntaagncaaagaggacctgtgttctggcactggctctacagtgttgtggctgcattatctagggtaaacacgcccatgggactctgcctggatctctattgagccacaggacactgaaattatccattngcaggtctgcctncccgtgtatagnccgtctgtcctggtctggnctggcgggtaggcattacaccttcc

SEQ ID NO: 724818 - DNA, 241 bp, Homo sapiens
  misc_feature (2)..(2): n is a, c, g, or t
anttgtaaaaaaattttttatacacacaggatggactgattttcatatttcccaaatcagagtccactgtacatttacacagaattgtctttgcatgaagccccagaggggacagcctaaaaatgagtgtttctgtagcccccttatttttgcgtgatcaacaggttggtagaaaagcagctgccggtatgttaccctcaaggtctgagacagtagaagagtccaaggtgttttgacattc

SEQ ID NO: 724819 - DNA, 101 bp, Homo sapiens
  misc_feature (2)..(2): n is a, c, g, or t
cntagatttatcccggctacagcccaggggcagcagcagtagcaacagcagcgcgtggcgctaagttctgcacagctgtgggaacgcctcaagtaaagcac

SEQ ID NO: 724820 - DNA, 956 bp, Homo sapiens
  misc_feature (183)..(183): n is a, c, g, or t
accaaatatatgtttgtagtaataacagatagaagacaacttgtcacctccacaatgagagagtcaataagtgctatcagataggttgtgcataggtacttgaatatagtggtaaaagatgtcttctatgaatatcattgtagtactgtttaagtgatgtccaatatcttcgtatagcctccntatgtgtatgtgttatggtcatctcacattctaaaggcgaatgtttaaccaattctattgttcgttctcgtagaaagacatgatactcacgcatgcgcgctattagtgtcaaatagattgtagaggatagaggccgtcgtagtatcttttcaccatgcttatgtcactttcgctgaaattacatttgggcttaacataatttaatactccaattcgtaatatgcgagactcatttggtcaactaatacttcctgtgcaccttctatcatgacatattaaccaatgtgatgtgtcacgagaagtaatggtcttatccactttgctttgctcttaccacaatcatttttagccctgtaaatggatgcgccaattgatatatacgagatttattagtactttgcatactatctcaatgattcatttctcaagaatgttccattattttgattgtcatccttttcatgaggttttatggtcccctggattctgtagttcctttagtgtgtcattggatctctttattagtaacctaggtgatgttacccctgagaaggagtcgcgtccctttgttgtttgggttagttgatctgtgactttttgttcctttattgactgttagttgtttccggggcttagtaatgggaaccttaagttgttttaactcttattttgctccaattggttatcccttggggcccgtcttccttttcctgcgcgcctttctctccctggcttcctggcgcttccgtctcccggtttgaggggcccccggg

SEQ ID NO: 724821 - DNA, 1598 bp, Homo sapiens
  misc_feature (253)..(253): n is a, c, g, or t
  misc_feature (788)..(788): n is a, c, g, or t
gtaactaaactgtattgtagttgtgtttatgacactgatttattgggatggcaaaaacatttttttataaataaaaagtgtagttcacatttaaaattaaaacctaattttccaggaaaagtaatactatcagtctagttaatccagtaatcattatgaaaaatatattcatgtttcttacttaaagctgccaaaatacttccaactgtatttaaagttgtggtcttttgataccaaacacatgcaggagatngctttgtttaacttttaaaaattctattcaagttacccccggtacatggagaaaggctatacctaagactatacaaatattttttactcttcttcatgtgttaggcatttctaacggatagttcagtagtgatgtactttagtgtaataatccatacataagaaaaatacatggtgaccaaattattaaatatcatctagaatagctgctttaaagagttactttctaaacttataaaactcatcttctacatgttttctataattgggcatgccttattgtgtaacgtcacccttaatgttttcaagtcattttgggttcataaggacacattcaattctcttctttggtggtctcacaggccgggttacgagggcccatatggagaaaaggcctccttagaccctggttcacacgtcgtgtacacaaaggtcccggccatcgagcaaagcgagggaggacgttccacaatattgctcttgttcctctcttttcttttcctttcttatccgcatgctaaggataggacacgggntaacacaaagtaatagaaagaatacaacataacacacaactcaacgagcgccgagcacgaagagaggcaaacagaaaagacgcgaagcaaggagacaagaaaagacgacaagaaggaggaggagaacgaaaaacgagagaacgcagagcgacagacacagagcgacacagcaggagccacacaagaaagaaaagtgaagagaagcgagaggaaaacaaagacagagagaaggagaacagacgacgacaacaaggagaagacagagaagacaaaaagaggagaaagagaaagaaaggaaaggagcaaagaagcgaggagagagggaaaacaagaagagggtaggagaaacagatcgacaagaaaacagcgaacagaaagcaggagcaagaaagagcgcaaaaccagacgagacgagaaacgagaagacgaaggagcgaagaagcgggagagagaggacggaagaagcgagggacagagagacaaaaagagaagaaaaagaaaagaaagaaaaaaggaaaggagaggagaggcacgagagagtgctcgggggcggcggaggcggcgcgaggagggagccaggaggggcggagcaggggggacggcgaggcaggcgagggcgggcgagggggaggaggggggaagaggaggagtacagcggggtagacaggcgcagggaggagggggaggagtcgcggacgcgaagggcgggtcggagagcaggggagggagaggcaggagggatgaaaggacgggcgcggaggggcgcggaggagacgggagggacggagcgacggacgcgaggagcgcggg

SEQ ID NO: 724822 - DNA, 432 bp, Homo sapiens
agagcctccacacaggactcctccgtcattgaggacaccgagatactcgacagcgcacatgtgtctgcagctccgccaacttgaggcgcaagcgtgtgcacacggccccggtcattcgggctgagggtaccttgggcctcgtctgggcaccagacttggatgcacacctgtgccaggactctacagagacacgggcatctctgatgcgcatcttcagatgaagaggtggtggaggaaccttagagccgaccgacaccgatgtccatgggcaccacacgggcttaaagtcaacctctttgctggactgaggcccttagtcctgaagggcaagctgtgcccccggaatctctcaactgaggaaggagagctggctgagagcgagtcgagccacaatgagttcgcggtccagcggaccggctgcaaggtgccgct

SEQ ID NO: 724823 - DNA, 904 bp, Homo sapiens
  misc_feature (203)..(204): n is a, c, g, or t
  misc_feature (206)..(206): n is a, c, g, or t
  misc_feature (218)..(218): n is a, c, g, or t
  misc_feature (231)..(231): n is a, c, g, or t
  misc_feature (239)..(239): n is a, c, g, or t
  misc_feature (246)..(246): n is a, c, g, or t
  misc_feature (248)..(248): n is a, c, g, or t
  misc_feature (254)..(254): n is a, c, g, or t
  misc_feature (257)..(257): n is a, c, g, or t
  misc_feature (259)..(259): n is a, c, g, or t
  misc_feature (273)..(273): n is a, c, g, or t
  misc_feature (281)..(281): n is a, c, g, or t
  misc_feature (284)..(284): n is a, c, g, or t
  misc_feature (290)..(290): n is a, c, g, or t
  misc_feature (294)..(294): n is a, c, g, or t
  misc_feature (296)..(296): n is a, c, g, or t
  misc_feature (299)..(299): n is a, c, g, or t
  misc_feature (311)..(311): n is a, c, g, or t
  misc_feature (321)..(321): n is a, c, g, or t
  misc_feature (329)..(329): n is a, c, g, or t
  misc_feature (333)..(333): n is a, c, g, or t
  misc_feature (335)..(335): n is a, c, g, or t
  misc_feature (339)..(339): n is a, c, g, or t
  misc_feature (341)..(341): n is a, c, g, or t
  misc_feature (343)..(343): n is a, c, g, or t
  misc_feature (347)..(347): n is a, c, g, or t
  misc_feature (350)..(350): n is a, c, g, or t
  misc_feature (369)..(369): n is a, c, g, or t
  misc_feature (372)..(372): n is a, c, g, or t
  misc_feature (374)..(374): n is a, c, g, or t
  misc_feature (381)..(381): n is a, c, g, or t
  misc_feature (440)..(440): n is a, c, g, or t
  misc_feature (460)..(460): n is a, c, g, or t
  misc_feature (501)..(501): n is a, c, g, or t
  misc_feature (521)..(521): n is a, c, g, or t
  misc_feature (830)..(830): n is a, c, g, or t
  misc_feature (891)..(891): n is a, c, g, or t
ttcgtcgtcgccgtcgagcagcggtccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttnntngccgagctcctncggccagaatttnacccggtntacattncnccgcancancngcagccgccaggtngcgggctnatnggcaanttcntnctnaaggcgtcgctnagcgcccctngcagcgantacngnagcncntnggtnatnagcgtcagcaaaggcagcnctnanggcagcnacccggtggtggtggcgccctacaacggcgggccgccgcgcacgttccccaatatcaancaggatgcggtctcttcgtncacccacttgggcgctggaccccctctcagcaatggccacnggcggctgcacacgaattcnccctggggcggcagctccccagcaggactacaccgaccctgggtcttgatgaagttctgagcagcatggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggcccggaaaaggaccgcacccacacttgtgattacgcgggctgcggcaaaacctacacaaanagttccatctcaaggacactgcgaaccacacaggtgagaaacttacactgtgactggacgntgtggatgaaatt

SEQ ID NO: 724824 - DNA, 114 bp, Homo sapiens
atacaaggggccagtaccacaccccagaagcttgaggagaggctcttattgacccccagtgacatgcctctcctggaagtagaatttctattgttctctacctttgccacacct

SEQ ID NO: 724825 - DNA, 422 bp, Homo sapiens
ccaagaattcggcacgaggggaaaaggagagagtccatgtcctttaacatcttccctatgaatgtcaccatcagttacggttctctgactgccagcaataaactggctctaacttaagtaagaacaaaaggatgccagggtaacccactggtctgaaagaagaattgaatgacaagcatagggtacaatggtaaccagggcagctctgaggactttggcctgaggaacttgctgaccatcaccctaagtgcacccttctcatgactcaatcccaactgccttttgttactgtgtgtctctactcaagaaagagaatctgattggcctggcttgagttacatgtatccttgaggcctggggcagcaggggtactgtgggaaagaggggtgatttctgcccacccaccaccaaccaaaaaccca

SEQ ID NO: 724826 - DNA, 372 bp, Homo sapiens
gtaggtggaatgagttagatcacagccattggcatgccatttggggtctaagagtatatacacagctcagtagtacatggagttgattcacagatattccacagccctttggcggctaggagtttatacacagctcagtactccctggagttgggtcacaacacatggatcagtcatcaggggagactaacactctatatacagttcagtactccctggagtcggtcacaagacaaggtaaagccatagggggctaagatgtctatacacagctcagtactgcctggatatgatgccacctgaggtgtatactacttggggatccgtgcacgttaacgattactaggactatgcagaaaccagagagtttaa

SEQ ID NO: 724827 - DNA, 172 bp, Homo sapiens
acatggttgtgggggcagtgcaccatcctggccaggttatcatagcggagggatcccacactggcatgggagttctgagcacatgcccggagctggggctgggcgaggcttggggcgagatgggaagaagtcttcctggaggtggttactttagagcaggttctggataaga

SEQ ID NO: 724828 - DNA, 156 bp, Homo sapiens
  misc_feature (1)..(1): n is a, c, g, or t
ntccggacgccatctggatttatttcttgctcatttaacagttcaggatggtattctaggcttgtttttgcctctcttccacatggtgactcagtgattcaggcttctttcacattgatggcttcagcatctcctagactcatgtcatcttttaca

SEQ ID NO: 724829 - DNA, 198 bp, Homo sapiens
gtgcggattcttgatacgtgtgagccatatgttcgtgttgcagagtaggaaacacagttgagacatactgaggcaattacagaaacaacagaaagcatggagaattgcggtgataagggcttacgcttcatttcttatgctgtctacttttctgaccagtattttagtatttccatagaacactaccacattattatg

SEQ ID NO: 724830 - DNA, 299 bp, Homo sapiens
tgagctcaagtgatcctcccaccccagcctaccaaagtgctgggaccacaggcgtgaaccaccatgccccgccagaaaattaaatttaaaattttttttaataaaaaattagctgggcatggtggtgtaacctgcaatcctgcactccggaggctgagacaagagaaccactcgtgcccaggaattcgaacctgcagtaagccatgattgcaccactgcactcccgcctgggcaaaggaacaagaaagatcctgcctcttaaaaatataaaaataaataaaaataaaagattgcggccg

SEQ ID NO: 724831 - DNA, 877 bp, Homo sapiens
  misc_feature (16)..(16): n is a, c, g, or t
  misc_feature (64)..(64): n is a, c, g, or t
  misc_feature (107)..(107): n is a, c, g, or t
  misc_feature (114)..(114): n is a, c, g, or t
  misc_feature (116)..(116): n is a, c, g, or t
  misc_feature (124)..(124): n is a, c, g, or t
  misc_feature (130)..(130): n is a, c, g, or t
  misc_feature (148)..(148): n is a, c, g, or t
  misc_feature (182)..(182): n is a, c, g, or t
  misc_feature (208)..(208): n is a, c, g, or t
  misc_feature (210)..(210): n is a, c, g, or t
  misc_feature (268)..(268): n is a, c, g, or t
  misc_feature (359)..(360): n is a, c, g, or t
  misc_feature (451)..(451): n is a, c, g, or t
  misc_feature (492)..(492): n is a, c, g, or t
  misc_feature (541)..(541): n is a, c, g, or t
  misc_feature (552)..(553): n is a, c, g, or t
  misc_feature (556)..(556): n is a, c, g, or t
  misc_feature (665)..(666): n is a, c, g, or t
  misc_feature (670)..(670): n is a, c, g, or t
  misc_feature (672)..(672): n is a, c, g, or t
  misc_feature (674)..(674): n is a, c, g, or t
  misc_feature (677)..(680): n is a, c, g, or t
  misc_feature (683)..(683): n is a, c, g, or t
  misc_feature (699)..(700): n is a, c, g, or t
  misc_feature (703)..(703): n is a, c, g, or t
  misc_feature (710)..(710): n is a, c, g, or t
  misc_feature (749)..(749): n is a, c, g, or t
  misc_feature (775)..(776): n is a, c, g, or t
  misc_feature (798)..(798): n is a, c, g, or t
  misc_feature (803)..(803): n is a, c, g, or t
  misc_feature (805)..(805): n is a, c, g, or t
  misc_feature (815)..(816): n is a, c, g, or t
  misc_feature (838)..(838): n is a, c, g, or t
ttgaaaagtttgtaanatagaggctggtacggttcggaattctcgggatgtggcttcgagttcntcttctgtgacagccgagattacgcgctcttttccagctaccngttcttncncacagttntttttnttttttttcttccccttntctgctcatgcagggagcccaggaagcctccgcntcagagatgctaccgctgctgctgcntntgctgtgggcaggggccctggctcaggagcggagattccagctggaggggccagagtnactgacggtgcaggagggtctgtgcgtcctcgtaccctgcagattgcccactacccttccagcctcgtactatggttatggctactggttnntggaaggggctgatgttccagtggccacaaacgacccagacgaagaagtgcaggaggagacccggggccgattccacctcctctgggatcncagaaggaagaactgctccctgagcatcagagatgcccggnggagggacaatgctgcatacttctttcggttgaagtccaaatggatganatacggttatnnatnttttaagttttttgtgcgtgtgatggccctgacccacaggcccaacatctccattccagggaccctggagtctggccatcccagcaatctgacctgctctgtgccctgnntctntnancannnnacncccccatcttctcctnnatntcagctncccccacctccctgggccccaggaccacccagtcctcgntgctcacaatcaccccacggccccannaccacagcaccaacctcacctntcagntnacgttccctnnagccgctgtgaacatgcagagnaccatccagctcaatgtctcctatgctccacagaaagtg

SEQ ID NO: 724832 - DNA, 156 bp, Homo sapiens
aagaggggtgagtatcagttaattatcatagtactcaactgaatggtatttttgaactccttttttggtttttggtttttgtttctgagacggagtctcactcgtgtcatccaggctggagtgcagtggcacaatctcagctcactgcaacctctg

SEQ ID NO: 724833 - DNA, 140 bp, Homo sapiens
ttcttccaggattgctcttataaggggaccagagtgcacatactgatgcctacagaggcatctagagatgcacaggtgtagagatggtaagcctacaatgccagcctactggtatgtactaaggggggatccatctagta

SEQ ID NO: 724834 - DNA, 185 bp, Homo sapiens
ggtattgaaactgcgggaggggtcatgaccaaactgattccaatggaacagcggtggtgcctaccaagaagtctcagatctttcctacagcttctgatactcaaccaactgttacaatcaaggtctatgaaggtgaaagagccctgacaaaagacaatcatcttctgggtacatgggctctgact

SEQ ID NO: 724835 - DNA, 832 bp, Homo sapiens
  misc_feature (561)..(561): n is a, c, g, or t
  misc_feature (587)..(587): n is a, c, g, or t
ctagtattcacaaacacttctactaaacataaatctgtgattgtgatctctgaaagtcagtccttttatctactcaaaagaagacactaaggttttcagaaattaaattgctttttggaaaaggtgggagattctgggaacatagaaacttgaatccagttttcttcaactccacgtcaagacagttgcattgtgtgagaaaatagctacggccatttgtggtaaaatcacatatatgcaattatgtgaaactaattgtgtatatgtatctgtgtatgtgtgcgtgtacaatatataaactatcaatatttatcaaagtccgtatagctgctagcaatgagggggatctaggattctatcacatgatacctttttatgaggcctttgttctttccagtacatttgtcagctcgttcatgaaagagattcttaattatttactgaaatatcacaaaagtgatggtgagctaggttgccacattgatcctgataggtccttgacaaattcatattgactctccacaaataaaactataaggcagtttttcccattgtgatgcntttgtctacaatcttaatttgtaacntcttccaagaataaacacaccatatatcaattttttaacccatttaggtagaaatatgggtatatagaaaggaggaagcaagggtaacggtgagcagtggctaaatgaacaagaaacattcagtaagtatctcatcttccaaatgtataaactggggcagaaagtactttgttgaatcaatagttcgaaacagacatccagtagggccatcgaagggtccaaataaagcactgatggaagattgg

SEQ ID NO: 724836 - DNA, 536 bp, Homo sapiens
  misc_feature (21)..(21): n is a, c, g, or t
  misc_feature (28)..(28): n is a, c, g, or t
  misc_feature (48)..(48): n is a, c, g, or t
  misc_feature (65)..(65): n is a, c, g, or t
aaaaggtgcatttaaaaaacnagatgcngcttctgctaaaacactccnaaagtgcaaaggctgcnaacacggtacaagtgaaagtttaggactcttcctgtgtcactgtaaggcccaagaggacagagctacctgctgtcctggcccttgggcttctgaggaagagccaagcagacaagcaccagtctgattgtccccctcctctgaccctggcagctcaggccatcttggcagcaggagagttgtatcactgaggacaggcactgccaccctcatactcaaaaacagccttgaccatgcctggtcgtggaattaaaaatgggtatgtgttggtggggagggatagagggaagcctcgtttatacagtatatgttataagccatatatattaaaaccattaacagtgtatagtcccacggtggctcttagcccctcatgctcaggtggtgtggccagccatgtgctgaggtccagcctcacccttgagggcaaggagggatagcttgctctcctctggctcttggccaccagctcc

SEQ ID NO: 724837 - DNA, 298 bp, Homo sapiens
gggtctcaggaaaggagaagaggtgcggtggatctggaggtatataatcggtaacatgtcgagaggtgagaatagttatcggcatgtcttcctgggacaagagccaaaaaccttttccagccactgatactggttgatcttctagcaacataagcaactggcactggacagaagaaaaagcgagggactgggattttagcatgataaaacacacaaagaggcctctggtggaggcacagcatgtgtcagggtctggtggtcctcacaccattcattcccagagtttagcacacaccaa

SEQ ID NO: 724838 - DNA, 539 bp, Homo sapiens
taagttcacgtttgtgattattagtacattgttacatatacttggtgagctcatctgcctcagcatttaatcgataatacatgaattaaattaatgcaagttaaggaagcagtaattgagaaaggaatagactctttaaagaatcagaattctcaattcaggcagtctgtctctatcattgggtattctactccttcacaaattgcagtattgtcccaatagacagtggttgtttccactggtctcttggagatgacctgtacacagatagaaggcatccagatgccctctcatcaccctggtattctcgcgctaatgatctattaatcataacgctttgcttatattttttacttagtatggggcataatcgtatcattcataggattaagtctgggttatttctttgataagaactgaatgtggccgggcgcagtggctcacgcctgtaatcccagcactttgggaggccgaggtgggtggatcacaaggtcaggagatcgagaccatcctggctaacacggtgaaaccctgtctct

SEQ ID NO: 724839 - DNA, 686 bp, Homo sapiens
  misc_feature (329)..(329): n is a, c, g, or t
tggggtaagtcaactaggtttacagtcccttattttaaatggcctaagtttggacagcaggaagaaaacaatttttaaaaaattctcattacattagacgcacaagaatagtgtcacataaagaaaagtggtgtttagaaatacgtggttttcatatttacgcatgtgatattttcctaagtaaaatgtgccaaggtggactgtggaagttccagaaagagggaaaataatttaaattaagtgcgtgggtgactctataacacatatttgggtaaaagtgagtgcttccccctttctccagtggtcatagctcacatttgtggtccaantatgaggatattcgtgacttttacaagtcttgggttactcctttctctaatttttatacgtgaaactgtgaagagccacaagagaaagaacttacaccgagaaacatcgtgggaaaacagctgtgcaaggtgtgttgtcggagaggaaagcagttgaaattcgaagccgtggatctttataaccttgtgcggtagtggtcgtttatactcaagaatttgggctggcacctagtggccggtgggcaagggacacttgggttctaacgaatccaaactggtgcactagtggtctggccagggtctggtcgcagtaactgcgtcaaaggccaaagtcccaaaaaacacacacaacacacg

SEQ ID NO: 724840 - DNA, 175 bp, Homo sapiens
gagactgtcatctgggaacttaatgcataaacaaatctgtttaaaaaaaaaaaaaagtaactctttgacttcacttgcagtggtgtgtttgattctattttagactggccacaccattgtgcagtttaaaaatacgtagggaacttacataaatcttcaattgtatgaattatga

SEQ ID NO: 724841 - DNA, 489 bp, Homo sapiens
aaaattcagcccgccctaccagtgccccttccccggccagaggccctggtgaagaaagggagaatctgtccctttgtcctcccccagccccaaagggggtttaataaaaaggtggccggggtccggaacttggaggcctatggtttggacccctactcagggggtgccctccttcagcagggaagccagggtagcccccccgtccatcctgcccctggggccaagggcagccttcaggggcagatcccgggaaacccgggccccccccccgggggggttttggttgaaagggatccgccccccccaaaaccccccccagggttaaaaaaggcccccccccccggccaaaaaaagggcccgcctcttttgtcccccggggggggtccgggggaaatcccagccctggggggggaatttttttgggccttttccgcttttgccaaacccaaaaataattttttcccaaaataaatttttttttttttttta

SEQ ID NO: 724842 - DNA, 403 bp, Homo sapiens
  misc_feature (403)..(403): n is a, c, g, or t
ggcacgagctgacctgagacagagagtctatattgcctgtcttctgtctcgtgctccatcctactgttggcacgcctgtgctgcctggtccctgtctacctggctgaggatccacagcgagatgctgcctagaccacagacacattgcaccatgatcaggagcactcatcctgcaacaagatcaccaccaactctggttcagtccgactttaacctgatcacggagctgtatacacgactacgacagcatcattatcatcatctaatcactgagcatagctactgcctttgcgatgctctccatgtagaccaaggctgacactcacgatgagattatgtagagatcgaatatccctcacggcgatgacggaggctcagatccatgcaggctacaggagcatcn

SEQ ID NO: 724843 - DNA, 467 bp, Homo sapiens
gtcaggctcggaccttacttccacgatcacattaaaagctactcacccttacccggctcagtgccaacatcccatcccacagcatgctttgaaaggattaaagcctgttatcactcgcctgctacagcatggccttttaaagcctataaactctccttacaattcccccattttacctgtccaaaaactggaaaagccttacaggttagttcaggatctatgccttattaaccaaattgttttgcctatccaccccatggtgccaaacccatatactctcctatcctcaatacctccctccacaatccattattctgttctggatctcaaacatgctttctttcctattcctttgcacccgtcatcccagcctctcttccctttcacttggactgaccctgacacccatcaggctcagcaaattacctgggctgtactgccgcaaggcttcacagacagaccccatt

SEQ ID NO: 724844 - DNA, 250 bp, Homo sapiens
ggatagttctctgtgcagagcaggctgaagctatcaccatttgtatgtccggtatccttcgtatgttctgggactccatgctgagccgtcctggcaatctgagaccagagatagtcagatcagacccactaagcctgaccttactcattattgagaactgatagatgaggtcgacaacgctaggaagtgttggcacttttttgcacccaagacagtctgattccaggatccccaaccgcttacctgggag

SEQ ID NO: 724845 - DNA, 176 bp, Homo sapiens
aaaaaattttttgggcccaaaatgcccaacgaaattgttccaatagaatttatccaattttgatctttttatatttttctccccccccgggaaacagaccaaaaaacattttggggttttaaaaaaggaatttgtataaagcattactctttttcaataaattgttttttaattta

SEQ ID NO: 724846 - DNA, 590 bp, Homo sapiens
  misc_feature (564)..(564): n is a, c, g, or t
tgggagaaggaaatgaccacccataccttataatgggatttaaacggcactaggagttcgaacatggcttttcgtggtgaccatacggacctgacacatggacgaccatagtacaaaaccagaacgataggtctcatgtggtaggatgatgggccagaaactagccagaacgactgtcaaacgtccagtcaagaatctccagagctgcatgcttcactgcggagggacagggtgtgctctgcacttcaggaaagatgcctaacatgtgcctagaaatgtgggtgtcatgataggagatgatcgggtggtacatgaggggctgagcttgccaggcatatgaccatttacagagccctcttaggcacatgcgcaaacgggtgtatgaagatgatcgcaaaagtaccagatgcagttactcttacactacactgacacagtactgtgatcccacttatgcaacataccatcatggtcgttgttccacatccatgactgatgcgagctgggcaggagacaaactggccagtagcatcatgcacaaggaccacagtcacaagagggtgntatactcttcctacacaaacaagtta

SEQ ID NO: 724847 - DNA, 446 bp, Homo sapiens
agatataccagaatgtgcctctatgatcagtctgaaagagtgaaggctggaacaccatacccacatgggcctggaccggagtgagaagtgatagaaaagagcttaaggacagcttagatacccagtgagtagaatgccagaccatggatacccagagctacctgccatcaagttgttgggttcccaggatgtgggtgtgagagaaagaaagagagcatgtgtgtattgtagatgaactgtggccccaagatatatagtgttacagtaaggggagaagctgaagaacaacgactcttcccaagctcagcttgtctcctctcctgtcaccctatgagcccctgcgctccatcgggatgccgcgtcttgacggctccattgcaaccctggtctttctccagtgctaccaggcctctgccaaagcgcccggcacggtcgtctctgggtgt

SEQ ID NO: 724848 - DNA, 305 bp, Homo sapiens
  misc_feature (65)..(65): n is a, c, g, or t
  misc_feature (73)..(73): n is a, c, g, or t
  misc_feature (92)..(92): n is a, c, g, or t
  misc_feature (200)..(200): n is a, c, g, or t
aatagattcacattgttttgttaaataaatgtaccttcatctaaacaatagtactgatgaaattntgggtttnatgtgatatcttgtttttnaaatattcgtgaaaataaatgtgtaacaattatgagacttttttaaagtttgcccacataccaccttatacctcatgctgggaaattttggggttttttccttttttnagagacacgatctcgctttgtcacccaggctggagtgcagtggcacgtggattgtagctcactgcagccttgaactcttgggctcaagtgatcctccttcctcgg

SEQ ID NO: 724849 - DNA, 1094 bp, Homo sapiens
  misc_feature (662)..(662): n is a, c, g, or t
aaattagcccccgtaatagaaattaacttgaaccagcgtcgattcatgcgagctctcgcccacctccatcgcaacatctccgcatgatgaaacttgcggctcactccgttggcgcctgcctgattcctccaaagtcagccatcaggacgtagttcctatgccagtgcaactacgtcacgcagagcgcctcaaccgcgctttgtcatcaaatcgcgccatcgatcacgtgcgagacggtaaagttatggctgaatcatccgcgtaccttcacgccaatggcgcctcaagtattctttatctgcctcttcctacacatcagggctgaggcctatattacgcgatcattatcatctacatcagaaacctgaaacatcggcgattgatcctcctgcttgcaatccatagcgaacagcgcttcagtaggctatgtcctcccggtgaggccaaatatcattctgaggggccacagtaattacaaacttactatccgccatcccatacattgggacagacctaggttcaatgaatctgaggaggctactcagtagacagtcccagccctcagcacgagttctttacctttcacttcatctggcccttcattattggcagccctagcagcactccaactcctattcttgcacgaaacgggatcaaagaancccctaggaatcacctcccattccgtataaaatcaccttccgaccttactacacaatcaaagacgccctcggcttacttctcttccttctctccttaatgacattaacactattctcacagactcctagggacccagacaattttaccttagcaaacccttaaaaaccgtccaaataagcccgatggagattccaattggcttaaaatttccgaaatccggccctataaaacatgaaggaggcattggccccaaataaaatcaacccaatctataagaaatatcccactctcctgttttcaccgacacaggaaatatttcgccaaagcaacgttgtagcaaccaagagccattacatgaaagagcaggaagaacttacccgaagaggaagcatcaacacacagacacactcaatcacgcgctacaacaaacg

SEQ ID NO: 724850 - DNA, 191 bp, Homo sapiens
atctaaggatccccgacgaacggcgaatccctagcagcgagttagaactcggtgcggaccaggaatcgactgtcttattttaacaaagcatcgcgaaggtccgctcgcggttgttagacgccatgtgatttctggccagtgctcttaatttcaacgtgtcagaaatcccatgaaccgcgcgtaaactgcgt

SEQ ID NO: 724851 - DNA, 303 bp, Homo sapiens
  misc_feature (22)..(22): n is a, c, g, or t
  misc_feature (242)..(242): n is a, c, g, or t
gagagaactagtggtccttggntcagcagcaaaagcaccacctgggcactcattagacatggaaattctgggcctcaacccggacctcagcatgggaatccctgggggtggagcccggcggtttgtgtttgggcagccccagctgactctgaggcaccatcaggttggaggccacagtgggtgatagtccctgccctgtggtagcagccggcctccctccttcatttctgttattccatctncttcttaaaacaaccctgtgaggctggcagggcagatgtcgattttatttaacagatgaag

SEQ ID NO: 724852 - DNA, 123 bp, Homo sapiens
gcggtctttcagcagggaaaattgcgctggccatagctggtcttagtggtttcgccgtcgtctcggccggggagttcttcgaaactactggagcgactctacggaagcttccagaacagccgg

SEQ ID NO: 724853 - DNA, 174 bp, Homo sapiens
tgtgcccttcgatcgaagcgatcaggcgcatgatggcaatgccgaccatcgcgcagcagcagccgagcaggccgtagatggcgtagtcggcggcgcgcacgtcgatggtcgaggcagcgggcagcagataggcctcgatcccggcctggtcggccacgaacgcgccggccagtg

SEQ ID NO: 724854 - DNA, 403 bp, Homo sapiens
agtatcttctattctcatttataaataatagagtaaccctttaacacacataactataatatccaggcctggagatcaggtgatacaaattcaaggacgcaggcactgataactataagaaagggcattcaaaggttaacatgattcattctactctactttaagataattcagcataaactgtgctcctctatacttgacataggggaaatcaagcagcactaattattctgtaggtgggtttcttaggaaatttttctcccatacttggccagcactggtttctgaccttcaaaatgaagtctaacacttacctgctaagtcgtacattcctttatagctactcttctgtctttttcatctggtgatataaatgtcaatagtcgtgtttgtatcagttgtc

SEQ ID NO: 724855 - DNA, 625 bp, Homo sapiens
acattcgcccattatggccgtgggagcctgaagcgaacaatgtcggaagtctgaaacccacttatgcggagactcagcgcctgatggccgacgagcagcacaaggcgcattttactgcgcaggtgcataacttcatggagttatgttggaatgaatgtttggagaatccagggaatcgcctaaactctaccactgaaaattgtctcttccgctgggccgaccccttaattgacaccactcttgacattaccaaaactgttgcccagattgcacagataggagggctgtactccattccccaggagaatgacagaagcaaaggacttgttactaagcagaactaagggtcagtgtgggaaggctatcaacccattgtcagatcactatcaagctgtcatcaagtctgctgggctaaaatttaaagatgcaaaatactatactgttccttatgaccgatgtgggccactctagtcataccactttagaattgacgaagctatttttgcgccccaataaaaggttctggccaaattcgcccttaaggagtcaaatacaaaatacttggccgatttttaaaacgggttcactggaaaaccttcgcgtaaccaacttaatcaccttgttg

SEQ ID NO: 724856 - DNA, 348 bp, Homo sapiens
  misc_feature (50)..(50): n is a, c, g, or t
  misc_feature (69)..(69): n is a, c, g, or t
  misc_feature (269)..(269): n is a, c, g, or t
  misc_feature (303)..(303): n is a, c, g, or t
  misc_feature (309)..(309): n is a, c, g, or t
  misc_feature (333)..(333): n is a, c, g, or t
caaataaataaataaataaataaataaaaactttctttgtagagactggntcttactttattgcctgtnttgcccaggctgctcttgaactcagcttcaagagatcctcctgcctcagcctttcaaagtgctgggactacaggcatgagccactgggcctggtcaatctgtgtatttctgtgtcatgtttgcgtgtgtgaacagtcatgtttgtgtgtgtgaataaagatagaggggaagagatggctgtctctaagctatactgcctnagaatggggcttgctggggttttttttttaacantttcgnccaagatccacctcaaaagttaantttttgcctggccct

SEQ ID NO: 724857 - DNA, 208 bp, Homo sapiens
agccggtaccctctatgcaatctagagacagtatatgaatcatttaatactacagcatgaaaattgtattaggcgacatgaatgcgaaggtgggaaaagagaggatgtatagaccaaatctaggaattcatagtctacaccaagtgtcaaatgataatggaatacgcctcatcgaatttgccctagctaaaaatctttacatcaaaag

SEQ ID NO: 724858 - DNA, 139 bp, Homo sapiens
gctgctgggtgccgccgccgtacctgtccttcgtggtggtctctcgaggcgcccggtgtgcaggccggccggtggagggccgcccttggtccggcctggggtcgctgggggtgcgctgctctggtgccccggcccttct

SEQ ID NO: 724859 - DNA, 105 bp, Homo sapiens
gccttatgtgtgccactataaactctagaaactgattactacaggagatatcagagatcgaaaaaaaggtatgacatttgcagcacaggtttctagagaaaggtc

SEQ ID NO: 724860 - DNA, 839 bp, Homo sapiens
ttaagattacacactgcaagcatccccgtgccagtgagttcaccctctaagatcacctacgatcaaggagggacaagcatcaagcacgcagcaatgcgagctcaaaacgcttaggcctagccacacccccacgggtaaacagcagtgattaaccctttagcagatacaacgaacagtttaactaacgctatactaaccccaagggttggtcgactattcagtagccagccgaccgcgcgtcgcacggacttgacccaaggtcgaagtaagaaagcctgcgcgtaaaggacgtgttgttaggagtcacctccactcgcccatagtaacagctaagaactcagcctgagattgtgaataaaagctccagctatgatgatcaaagaaatagactaacgaaaggtggctttaacgagtaatctgaagcagcagcaactacgctacacgaacccaagactgggcacttacgtagtatcctcgcaccctaggtgctgtacgtcccctacaaatcctcagacagtgtaatatcgtctaaaggcgtgctcgccatagacactacgagccacagcttaaaactcaaatggacctggcggtgcttcatatccctctagacggagcctgtctctgtaagtcgataaaccccgatcaactcagcacctcttgctcagcctatataccgtctatcttcagcaaaacgctgatgaaggctacaaaagtaagcgcaagtaccccacgtaaagacgtgaccgtcagtgtagcccatgaagtggcagaaatgggctacgttttctacccagaaactagatagcctttgaactaaggtcgagtgttagcgaccctag

SEQ ID NO: 724861 - DNA, 116 bp, Homo sapiens
aaaaagttagaattgtttttccccagggtttatgggggggttgattcccccttcatccattgggtggaacatggattgggggtttgatagaaaaataaaccccgctttttattcca

SEQ ID NO: 724862 - DNA, 531 bp, Homo sapiens
tgcctcgcgagcgtgtatctttcacagtgtcgttggtctgtctgcagtgtgttttgtagtgttaggtaacggttcttcccttccatgtttagtgcttccttcaggagttcttgcaaggcaagcctggttgtgacagattacctcagcatctgcttgtctgtaaaggattttattgtctcctttgcttatgaagcttaagtttggtctagaagaggagaagaggaaggagactcgctcggaaccatgcaactacatggaaattgaacaactaacttgctcctggatgactcctgggtaagtgatgaggttgaggcggaaatcgggaggttctttgaaatcggtaggagcagagaggtggtgtgctggagtcttgaacacagctggggcggtgttgggagggaagtttatagcactgagtgctcacattgggctggagggatctcagattgacatcctaacatcacaactggaggaactggagaaccaggagcaaacaggctccagggctggcggaggacaggaggtggccgg

SEQ ID NO: 724863 - DNA, 725 bp, Homo sapiens
ctaaggcagccaggggtcgtggtcccaagaaagcatctgaagcgggtggcagtgccaaagcatggatgctggataaattgagcggctgtgtggtgtcctcgtcgcatccaccggtccccgacgagattgtagagagtgtctcgcccctcatcattttccgtgaggaacggacttaggttatgccctgacaggtagatgaaggtgaagaagattggcactgcagcggttcatgtacaagatcgatggcaaggtccgaacgtgagtataatgctatcgcctggcgtgggattccatggagtgtcatcagcgattgacaagacgggtagagcaatttccgtgctgatctatgacatccaagggtcgcttgctgtacatcgtagttacacctgaggagggcaagtacaagttgtgcaaagtgaggaaagatcttgtgggcgcaaaaggaatccctcatctggtgactcatgatgcccgacccatccgctactcccgatcccctcatcaaggtgtaactgataccatctcgagatggattgtagagacctggcgaagattactgatctccatcaagttcgacgcctggtaaccgtgtgtatggtgactggaggtgctaactaggaagaatgtgtgtgatcaccaacgggacgagaggcatcctggatcttttgagcgtggttcacgtgacgagatgccaatggcaacagtttgacagtcgagttccaaca

SEQ ID NO: 724864 - DNA, 348 bp, Homo sapiens
  misc_feature (11)..(11): n is a, c, g, or t
  misc_feature (58)..(58): n is a, c, g, or t
  misc_feature (134)..(134): n is a, c, g, or t
  misc_feature (192)..(192): n is a, c, g, or t
  misc_feature (211)..(211): n is a, c, g, or t
  misc_feature (341)..(341): n is a, c, g, or t
ccaacaaattntgacctaaccatattaaacctagtcaacctattattctagtacaaanccagcacatgggtattttccaacataaaagagttctaccaatacaggacccatgaaccattcttgaagaaaagttnctcagtaaggaaatctagccaagcaagcaacatgtacccataaaagattattataatncggaccaaagttaagtttncatccattcacatgtataccattaagatatataggaattataattacagaaaagaatgttacaaaccttcacaaagtcaaaaatatttttatatcagctagattcttctgtttcaatccataaaaccagngttttgg

SEQ ID NO: 724865 - DNA, 179 bp, Homo sapiens
gggggcccagtttgggggcccaaaagttgcaaaattcgttgaaattccccccaagtaaacccttagccgggaggcccccccctggtgccgccatggggtgggcctcccccccccccggggggtttttttgaaacatttatttttggtttttttcaaaaaaagttcaaagccccccccca

SEQ ID NO: 724866 - DNA, 173 bp, Homo sapiens
aggtgatcgttagagcatagcggcatcacgtgcggtttcttaatgtccctggtggcggataccgaggtcctcggaaggacatctggacaccactttctccgactcgacccctccaacaagcatcgcaggcactgtcctcgggggtacagaccgtggtccacagtcgctaccac

SEQ ID NO: 724867 - DNA, 537 bp, Homo sapiens
atgtactccgtctgagaccccaacattaacatatcgctgccatactggttacattgttcttaccatattcgtatataaatatcattgctgatggacttcaaggctcggattgccttctgtcctggatgcatatgcctaggtgacgtgtccactagctatggtaccttaagttctacacctgtgtcatcgagcgctgcctcttaactctgctcttgtacagtgggagtctgtgtgttttcttgaatgttggagagagcttgaccttgaagttatgaatttctcagcagctgctagtcgtgcttgctgggataagtcttcgatcttggattccccaaaaactatgtacgtatctgaagcagggcgcttgtagacatctggttttgtgatgcccaagaggatattcttagatttccgggtagggactctagtaactcctgtaaccggccgaaaagccagtttggacatagccttccgtgccttcttttcactccgactctgttttgctttactgactggttcttcatcgatttcagctgc

SEQ ID NO: 724868 - DNA, 783 bp, Homo sapiens
gggcgcaaacagaagtgcagcggtggcggcggtggttgcggccggcgggggctgcggagatggaggatcttgtcaagatggggtgcttcaccagctacccctgggaccgggaaatctaagctggaaacattgcccaaagaagacctcatcaagttgtgccaagaaacagatgatgctaatacagaaagctaaatcaggtgtacagaattggcagaaacgaacattgaagacctcagatcaaaacctgttactgaaggacactggtgatattattaaggcattaactgaacgtctggatgctcttcttctgaaaaagcaagagacttgagcaaccaggttgtctttctctgaaaaaaaaaaaaagcaacaaaacaaaaaaaaattttgcggggccgcgcctgcggcgctcaaggaaaagtgtttctagaacccacttcctcgtgttggggcgcgcgcggcggccccatgtgattggtcgtggaaccccttgggccaaagcggtggctcccagagggagaacgcccgggggccataagcgaccaactgcgcggttgggaggttctcccaccaaataaaaaaacgcgcgcgggcgacacacccggggctgtttcggaaacaatcccagagatgggctgtcgggcggccagacgggggtcctacacacaccggggtcccagcgaagcgcagagataatcgcgcgcaccagccaggaggggaacaagaaacaaacaacacagatcacagcacacacgaaagcagcacagacacgaaccgacacgcagt

SEQ ID NO: 724869 - DNA, 586 bp, Homo sapiens
  misc_feature (4)..(4): n is a, c, g, or t
  misc_feature (20)..(20): n is a, c, g, or t
  misc_feature (39)..(39): n is a, c, g, or t
  misc_feature (59)..(59): n is a, c, g, or t
  misc_feature (79)..(79): n is a, c, g, or t
  misc_feature (87)..(87): n is a, c, g, or t
  misc_feature (91)..(91): n is a, c, g, or t
  misc_feature (111)..(111): n is a, c, g, or t
  misc_feature (142)..(142): n is a, c, g, or t
  misc_feature (151)..(151): n is a, c, g, or t
  misc_feature (155)..(155): n is a, c, g, or t
  misc_feature (229)..(229): n is a, c, g, or t
  misc_feature (239)..(239): n is a, c, g, or t
  misc_feature (250)..(250): n is a, c, g, or t
  misc_feature (253)..(253): n is a, c, g, or t
  misc_feature (280)..(280): n is a, c, g, or t
  misc_feature (323)..(323): n is a, c, g, or t
  misc_feature (342)..(342): n is a, c, g, or t
  misc_feature (349)..(349): n is a, c, g, or t
  misc_feature (380)..(380): n is a, c, g, or t
  misc_feature (432)..(432): n is a, c, g, or t
  misc_feature (457)..(457): n is a, c, g, or t
  misc_feature (464)..(464): n is a, c, g, or t
  misc_feature (466)..(466): n is a, c, g, or t
  misc_feature (546)..(546): n is a, c, g, or t
tganttcaccatgcaggggngacttttatttgaaggcanaaaaaaccctatttgggggntcactcaaaaactgcaaaantttgtttntttntttttaaaaaaaaaaaaaancaaaagccaaagggcctgggaaggaaagganaagggtagngggnccatgtcaggctgaagtcaggccgcgtaggggaagcggacagccgcccttcgtgaggctccagtttcaggcgtnccagcccaanaggggagcccnccncacggcctggctgggtgctgagcaggnggtcagccttggctggcaggctggcgctggcaggcaggtcggnggcctgccgtccagccganaggcccncatccccaaagttaagccctaccaaaaaacnctcattctggtcccagtggcggatataggagaagagtccaggcccagcgganaacgcgtggaagtccccctgcagtngggagcncnccttactccgctggtcactcagccgccggaacaaggaaaggagggagccagggtcttcactctggcccttcacagtcatnttggcacttacagcccctgggatgtcagggaagctggact

SEQ ID NO: 724870 - DNA, 404 bp, Homo sapiens
ctcaacaatttaatgtaaaaagaaaactcaacatacacagggaacattagcaatatttatagtctggaataaggggggccttcgtaagaatggaaccaaattccacaaacaataagcataaaaagattcaggctgggcacaggtgactcatgccttgtaatccagcactttgggcaggctgaggcaggagaattgcttgaacccgggaggtggagtttgcggtgagccgagattgcgccactgcactccagcctgggcgacagagcaagactctgtctcaaatcaaaaaaaaaaaaaaaagggtccccctggggtttctatttaccttttttttaatcctttcacggggggagggccctttagttggctcccatatcttgcctatgcgaaccgcgcctgcgtta

SEQ ID NO: 724871 - DNA, 257 bp, Homo sapiens
  misc_feature (43)..(43): n is a, c, g, or t
  misc_feature (222)..(222): n is a, c, g, or t
accccctcctatctgaatccagatcctcctatctgaaccagancctcctatctgaatccagatcctcctatctgaatccagatcctcctatctgaatccagatcctcctatctgaatccagtgactgcgacgacaataaaagtacaaggccatccgtctcatttttgtcatcatggcggtctggattcagataggaggatctggattcagataggaggatcnggctcagataggaggatctggattcagataggagg

SEQ ID NO: 724872 - DNA, 297 bp, Homo sapiens
cacaagcttgggattacaattatccctagctttatcacttagtacgctatgaagattcacaggcaagttgcttccctgcgctgagccatacacttgagcgtctttggtactgatgaattaagagcatctagcttctaacagattgttgtaagaattaaataagataatccctataaagcacagtgcatggggcaagatgctcatctagacactatgctactaaaactcaccacggaaagtttctgaagcccatctagtccatgttctaccctatacaatgatctcatcttattcatt

SEQ ID NO: 724873 - DNA, 146 bp, Homo sapiens
  misc_feature (111)..(111): n is a, c, g, or t
ctccccctcctatctgaatccagattaaaagtacaaggccatccgtctcatttttgtcatcatggcggtctggattcagataggaggatctggattcagataggaggatcnggctcagataggaggatctggattcagataggagg

SEQ ID NO: 724874 - DNA, 251 bp, Homo sapiens
ttccttacacaacggttgacacggaaagcataaactgtatcaaactacattcacgcatcgggctcttcgtctaattctggtcggattcgcatggcaggtgttacttctgagcagtcttcaagagtttcttctgacgttgtttttggttcctctaataagtcttctggcttctcatcacaccgtatttctggctctttcacagaattttcatttggcatgctggcttcttcttcccagaactcatgaagacg

SEQ ID NO: 724875 - DNA, 125 bp, Homo sapiens
ccatgccaggtcgacccgagaggatcaccacacacaacaccacccatgccagatgcacgaccggggaccgacgtggcccgcatcttgggctggctatggcaccactagggccgcgctcttctggc

SEQ ID NO: 724876 - DNA, 627 bp, Homo sapiens
  misc_feature (476)..(476): n is a, c, g, or t
  misc_feature (593)..(593): n is a, c, g, or t
  misc_feature (615)..(615): n is a, c, g, or t
  misc_feature (624)..(624): n is a, c, g, or t
gcaggctgcttcatgatcaacaactgcaccaccctctccccagattcaggagatatcgccaatacgttgaaatcacgccatgcgatgcaagagcgcactttgcagcagtttttatgtcaacgacaagcgcgcggggaaatcccgccccactgtgacgtgacacatctggcagaattccttaattgtattattcaggggatgtcgatcagcgcacgcgaaggtgcatcgctggaaaaactgatgcagattgccggaacgactttgcgtttatggcccgaactggtgaaataagtcgcaaaaaaagcccctcagcctgagcgaatgaggggccaaattgcagagtacagccttgttatactttgttattcaaaatcagttgcccgttgctatctagcgggatctgcgtacccggatcgcggtccatgcggattttgccctgctgatcgccaatcttataggtcacatcataaccgagncattttttctgacttgtcatacaccgttttacaacgctgttgcgtagtcgtgtaagtatcgctttcctgggagagagccctgggatctggttaccggcatatccaccacccagcggnccccacaacagtgggcgacatntttaaccgngtt

SEQ ID NO: 724877 - DNA, 495 bp, Homo sapiens
atctccttccctgggcggccatggggggggcccccctcttttgtggaccgggggttttcttacacccggcccgggtgccctccggcgccggggcttgtttttttgaggcccttgtgtggggaggggtccccccccccttgagtggcacgcccttttttgttttctttgggcgggcccccgaagcgccaaatcccttttttccggggcctttcgacaagagagagtgtttccttgctcccccagcagggtctcgccagaacaaaaggggttttaattttttttcaactctttcacaagggtccgggaggggatgagtcttccccccccggggttccttctttcacatgccgggttttttgccggcccccccggcccgtctatccaacttttgcgtctttcccccccgggtaagggggttcccgcgcccccggggggggccccccccccccaaataccctgtttttttttggagttaaattttcgccgtgatatgcc

SEQ ID NO: 724878 - DNA, 216 bp, Homo sapiens
cctgatcagctcggtaccctctctccacactggtgacctcataagcaagagattttgggtacagaggaaagaccatgtgaagacgcaggcaaaggacagtcatctgcaaaccagggaaaggggactgagaaaaaaccaagctggccaatgtcttgatctcaaactcccagcctccagaactgtgagacaatcatttctgtgccagtgtggagagag

SEQ ID NO: 724879 - DNA, 170 bp, Homo sapiens
ctccagtgtcacggatttgattgtgcaggacggacaggaggcacccagcaacgtgtactcgtgcagcatggacggcatggtgctggtgtggaatgtgagcacactgcaggtgaccaagccgttccagcgtgacgaggtgcctgacgtccatcagactgcacggcggtcgc

SEQ ID NO: 724880 - DNA, 768 bp, Homo sapiens
  misc_feature (428)..(428): n is a, c, g, or t
  misc_feature (450)..(450): n is a, c, g, or t
gtggaaaaaaagcaggaatactgctactcaggtcgtacgagtccttactgtaggctcaacatgtccaggtcggtattcaacacgtgtaatgtccagtcaaccgttcagatttgcagcagaaagagaacagcccgcatgagtgatacgccctgtattccgtgaaatactgatggaaaatatttaatatagatagagtcagcgttgccagtataaagaatcgtatctctcatttataggcagagcgcatgtgtttggatattatcggaggaagtactgatagttagtattataatgcgtttaaaagacctaataaagcgttctaagtctactctttggtgagcctcctgcgtacaagtttcctgacggttcctacctctaataagtccacagtcaccctccatacctgctccctatgctgagccatgtangggatgcacaatcgaactctangacgaatgaagtcgctacttagcacgcatctaacagaaacttatctgttcaaaggactgaagacctgtatgctaaggacacaaagagatgacggcctccctaggttccgcattacttactccggttcctattcttgggttacggattgaacactgaccttttctgtcactcttcgtgcaagacaaccccataagaaagctgaaacctgcttcttgtgaaagcctatgattactataagacaggcacagagcaagaaaatgtattgaggcattgtgtctataaacaagacttggctggaatccccagacccacgacttt

SEQ ID NO: 724881 - DNA, 205 bp, Homo sapiens
tcatgaacgccatccgtgctggcacccgattcgagttttgctattcggagtcctcgacgatgcccacgactcttaccgagtcccatcacctgcctacccaccctttggaggacttcgccttcttaactcgcctgcgtcggcacggcattccggtgggtctgttctatcgggacgtctactggaagttcccgctctacggtgaggg

SEQ ID NO: 724882 - DNA, 254 bp, Homo sapiens
aggtacgtcaggaggcaggaacctgccagttttccttggtgcaaaaatttgaccctcggctgccctgcaaagggggagggcctgacccagaatgggggtcagcccacccccctgtttctgggggtcctgctcccccctccagctaaactcaactgatcatccctttgctggctgctccctgctgctgccccttccagggaaacccctagcagctgcccatgttttttgaaccaattaatttatgctatagctga

SEQ ID NO: 724883 - DNA, 525 bp, Homo sapiens
  misc_feature (509)..(509): n is a, c, g, or t
gaatagcggataggcggatcacttgagctcaggaggcgaggtgatagggagcaggatcgcgcactgtactcactcagccttggtgtcagaggaggctctgtctgggggagggatgggagggagaaaatcagaggatctctctctccagtctctcctctctgtggttccactcattttctgatacataagaatccctttttctctttgacttcttgtaagattatctgattgtggacctctgtgactaggtgccacccttggtgcaaggccgttagagaagtaggagcagtgaaagtgggggaaggaaattaaccctatcttaggttactttgccaacatttgactcctctctacaacctgcctaattttgttttgttttcctagttctcaggtagttgctgtttatattttgttgagaatttctagttgtgagcagaggaagaatggctgggcacttaccatgatagctccatgactttaaataccctattggcaactctcagatttanctgtgttggctggacg

SEQ ID NO: 724884 - DNA, 279 bp, Homo sapiens
cgatttattttacaatgatacttacaacccctggagctggggagacaagagggagagtttagagttaccagaatttagacttttagagaacggatttgtggacccagatttttcgacgagaaaagcagccagcatactagcatccaagtactacgagtacctctgaggggtcaattagctctgccaatatgtaaaaatgaatcaggaactagaagcaaaggccattacatgggatgaaaagttgttgccaggtaacactgtcacgaataagaaaacagg

SEQ ID NO: 724885 - DNA, 146 bp, Homo sapiens
gatgggtcagatggaccaaaagcagcaggatggtggcagatggctccattctagaagctgcatttgctccatctgtaaacgtaatcaattccagctgctgtcgcaccagtgcatgggttcacacagattgctctctggggatgcca

SEQ ID NO: 724886 - DNA, 176 bp, Homo sapiens
  misc_feature (68)..(68): n is a, c, g, or t
  misc_feature (70)..(70): n is a, c, g, or t
tgaggacccacgtatatgtaacttatttttaaggaaaaggggctggtattgtggttaaaatcattgtntngcagagtatcctttttgaaggaaatatacatccttataacacatcaggtagttttctcttttctgtatttaaattatatatttgaattaattgaatataatttgag

SEQ ID NO: 724887 - DNA, 412 bp, Homo sapiens
tttcttttttttttcagacagagcctcactctgttgcccaggccaggatgcagtagcacgatcttggctcactacaacctatgtcttccaggttcaagcgattctcctgcttcagcctcccaagcagcagggattacaagtgtgcaccaccacgcccagttaatttttgtatttttagaagagacggggtttcaccgcgttaaccaggatgctctctatctcctgactttgagatccgcccgccttggcctcccaaagtgctgggattacaggcttgagccactgcatccggccccttatctgtttctttgacagggacttgttctagcacccaggctgtagtgcagtggcgcaatcatgaagtctcactgcagcagtgacctctacagctcaatcagacctcccatgtcag

SEQ ID NO: 724888 - DNA, 665 bp, Homo sapiens
gggagaggcgataggggaactggcacactaagactgcgtaatagaacacaggtctatgcaagtccgtcagtcaccaggcaccgcccactgcgctcccgagcgcctcaggctgcagctctaatatccattgtcagcgccgttcccaccgcggctagcgtttccgaggtcagaggaaaaaggctctattcggccttcacggttgcatcaccctaatacagaccgtcctctcaagacccgccctcctgttacacagggacccatttcggagtcttggatcacagatgggcgggaactgccgtgacagaattccccccaaggtgttgagtatccatcccaacacagcatctggcttccctcccacctccaccgcagctcccacaggccccgtcgccccgttcatcggctgggcgctcgagacggcgccacccaagatcgtcccacccagggaccagtgtcccacagatgcagctgaggagagaagagccggcggcgcgggcaacgatcaggaataggatactgggacagccgcagctgccgaagcgcagcgcgcggtcccacgcacgacctgcctccgggacggccggacgggctggcccggagagagagaggaggatgcgcgccctcctcccagctccatctgcgggttaccgcctgggtaaagaccc

SEQ ID NO: 724889 - DNA, 158 bp, Homo sapiens
ccctgacttgtacatgggaaaatttaaaaaaaattataaaaaaaagaaaattatctgctaacttaatgatacactttatctttgaggagatatgtacaattggtgtatcctttttcacatgtaccggtacattttagcactaaaatttttttcctctc

SEQ ID NO: 724890 - DNA, 195 bp, Homo sapiens
gctaagtcacgtggtgctcatacttcatccccgccaccgtgcactccctcaggccctggacatcgagttgatgaaacgcctgagcaaggtggtcaacatcgtccctagtcatcgacaaaggcgagacacacttcaaccctgggaggcagagggtccaccttcaaacagggggatcaccgcagaaccttgttgtcc

SEQ ID NO: 724891 - DNA, 223 bp, Homo sapiens
gggcacacaggttagtgattcctcaaaacagttgaacacaggaagttaccatatgaggcggggtgcgtggtctcatgcgtgtaatcctatcactgtgggaggctgaggcgggcagactgcctgtagctcaggagttcaaaaccaggcggggcaacacagtgaaaccccgtctctactaaaaatcacacaaaaaattggccgggcgtggtgaatcgtggaaatg

SEQ ID NO: 724892 - DNA, 335 bp, Homo sapiens
aagtggtagatttagaagaagagacccaaaacttttgctagaaatcagcttttacgagagaaactcatggcctttagttgagaccacggagttaagacagcgctttggggatggatgccctcggtttctgaagaggaggcggacgaaggggaatgaagtaggccagtcgcgcgtctgctgagtcgcagcactcagactacgtgcacctctacagcaggtgcaggcccagttgtcaccctccagaacatctcccatggattctggcggtattactttcagttcagagtctgatatctgttggcattctgcaacttgcccagcatgtctcaatgcct

SEQ ID NO: 724893 - DNA, 902 bp, Homo sapiens
agcgggctgtcgggctcacagcgcatgttgttaccgaaccggatggcgcccgtgtcagcaggacgtatcgctacctgtttagcgaatagtctcacgatagctccacacgaacgatgatcacgcaaagtggcgatgcataaaccagtaactaagacaagctcactgttgggcacagtccctagaaggcctaacccttattggaggtgcttctcatgcgacacaggaatcgtgctgtgcaaaagagtagcgagttgaagccaatacaggccaaattctgccattacgcgaacgtgtgtaagggtccacgctgatcaagaatggcaagaagaatcacagcctatgtacccaatgacggttgcttgaactttatttgaggaaaatgatgaccgttctggcttgctggattgggtcgcaaaggtcatgcatgtaggtgatattacctggagtccgcgtttacggttgtcaaagtagccaactgtttctctacatggcacctatacaaaggcaacgaaggactagaccaagatcagtaacactacgttaactgcgctgcacataccagctggtacgctaactagcaacgtttcactaatggaccaacacagacgcaacacacaagattctcccgagacgcgtcggtgaactcggggcacataacgggtcgccctggataccgcattcacaaacgtgtcggcgcccccccagggactacccacgaaatgtctagtggttttcccccctcaatatatcataaaaagcggagtaacacactatacaccacacgtcttcaggggcgtaaaactacattatgctgcccatcattaagctagtgctgtacccccagggacgttggaaacaaatgggttatactaccgcgagcaatgacacagtgataaccacac

SEQ ID NO: 724894 - DNA, 897 bp, Homo sapiens
taaattagcatatcgggaattttctgttttgtctcctgctatgcttcagccttatataataaaaacacatacatataatgtaaatagaggcactttagatactttgatgactgaaatgaactttcttcacttgctttttagaatttcctaggtttagaaaacgaaaatgaatctatgctcatggtcgaagactgaaacaggacagatatgcattaaggtaaaaagcagaagtccccttctccatcctagcctccccactcccgtaggaaccatactccctcccgtccccacccagtgtcacaatagagcacacatgctcccgtcgtcataggtccctttgcttatggactttggaagatttctacattctgtctgacatacagccttaggagagaaacgtgaccccctcttaagatgatccttctcatcccagtccctagttcccctaactggcaatcctcattgttcttgtctcagtgatgtcttgatctgcataggcttgttccctctggaagttctagttgggtatcccatcattacatgtacggaatcatgcatccgttcacagtatcagtatcttccctatgagctcctgtgagtacaggtgcagatctgatcatccgtgatacgcccgcacctgtaggcatgaccacccgagtcggtgatgtcggacgaggcagaagggaaatgcccaagaaccggctgggaaaggcctccgaggtcaaaaagagacgggtccaggacccggcaccgtaagattacaacaaaggcgtaggagacacacagaagttgggagataaaatcccaagaagaaggtaaaaacctccggacaggggaggagggatagaaagaaagggagggaaaaacggccacaaaagaagacctaaaggaagataa

SEQ ID NO: 724895 - DNA, 971 bp, Homo sapiens
  misc_feature (36)..(36): n is a, c, g, or t
  misc_feature (273)..(273): n is a, c, g, or t
  misc_feature (303)..(303): n is a, c, g, or t
gcttctgggtatttctattgcgcgagtcattgatanagttgcgtgggcggcccggtctcgtcagaagaggggagatggtggcgggtcgctgaattaagcttccaagaatgatgctcgcgacaccagtttatctctattgtagacaggagtgggactgagtagctcaccaaggactatcccactcagtcattgctgacgtaaaccatcagatagtcgctgcccagggtgatatgcgtgaggctgtatagaagctaacccgtgcgggtctcccgntgtgcatagggacgagagtctgtgaattgntcacgatagggcgacgatgggctaacaaggcgcacagcaattgtcttcgtaatggatgggcgccacaaattctgagaagcttcttgagtgtctgtccatcctgcatgctagaagacatttggctcatacgattggctagatcccaagatgctgcaggtgggttgatggcatcgcacgcttcagttgacgcttgacgtggccgtgcaagtagtcttcgtggaaggcaggttgaagacctcgtaatgattggcagcgaaagggggtttacgagcgcccccagtactcgatcacttctgaggcgtatttcgcgcatcgagtcgcaatcccagacgtggcgagttgaacgaaggatctaaatgagattgctgtgaccgtgaagaaggcacgataacagtggaagcagaggaagctgctggagaaagtgtgccatgaacgctctgagctccaagctgatctcccagccgaaagctttctttgctaagatggtggtggatgcagtgatgatgcgtcgatgatttgcgtgagcttagacatgatttggactcaagaaggtacagggtggagcccctcgaggattctcagctggtagctggtgttgcattcaagaacgatttgctcttacgctggggtactgaaggtgcgatcccatgaaagtaccacaattccaa

SEQ ID NO: 724896 - DNA, 150 bp, Homo sapiens
gacttaacagttcgtcgctagtatgttaacctgttgtgatagagagcgtataatttaccaatagcgttacgctgtacgcctgagtacatttatgccattctcattcatcaggcacgacgaagaggagagctttgaactgttaacgtccgg

SEQ ID NO: 724897 - DNA, 893 bp, Homo sapiens
  misc_feature (515)..(515): n is a, c, g, or t
cgagctcccagtggattctattaatatagtccattgagacggaacttccagtgtgttcccgttgtatctcaaacgttttgttgtcagacactcactaaattatactgccgataataactcttagaccttacagtcgtagatctgttggaagtctatagtcttggtactactatgtgatatctgaactcacttccctcctgaggctttggatttgacccttgcattcgccctttcatgttagattagtttcgtacatgctcgtcactagaggtcaaatggaattgaatagacgtagattctatcccgccagtataccaatgcttatccatgaattcgaacttctatgcattgatcgcgatcattgcatgttcgataatgtgttaatgcctagttttgccctcactcttccttgcttctctcctgtccctccacctagctcgagatctattttagctaaacggattccatatagggtacaagttcgcagttgacacatcgagttataattgtgcaanaattgctgtattatatgatatattatgttgtataatagcagatctcacttatgatcgtccacagtgccaggatttgcacgtgggtgactgatcttcagatcatggtaccatattgcctcccgcggctcgcgccgattctcctgcctctgtctcctctaggtacgcgtgttgagttaccaggcacctgcctagtcgtgccctggggtattattacgtaccttcttacggagagaccagtggtctctccatgtagacccttggttgggtgcggactccctggtctcctggtggtccagccgcctcgggctcccccaaagttgttgcggtatcggcgtagaggtcgccggccccccttgtcatgcttttgtttctgcttta

SEQ ID NO: 724898 - DNA, 135 bp, Homo sapiens
  misc_feature (21)..(21): n is a, c, g, or t
  misc_feature (79)..(79): n is a, c, g, or t
  misc_feature (81)..(81): n is a, c, g, or t
gagccagagtaccttcctggncatcctgggcggagctaaagttgcagacaagatccagctcatcaataatatgctggananagtcaatgagatgattattggttgtgacatgggcgttaggatcctctaacgcag

SEQ ID NO: 724899 - DNA, 686 bp, Homo sapiens
  misc_feature (392)..(392): n is a, c, g, or t
  misc_feature (421)..(421): n is a, c, g, or t
  misc_feature (429)..(429): n is a, c, g, or t
  misc_feature (461)..(461): n is a, c, g, or t
  misc_feature (546)..(546): n is a, c, g, or t
  misc_feature (578)..(578): n is a, c, g, or t
  misc_feature (582)..(582): n is a, c, g, or t
  misc_feature (588)..(588): n is a, c, g, or t
tctctgctaggaccgaagggacgacccttctcccaaacgtcagaaacgaaccccagctggctggcctctccctgcatgggcccgcaggagagagggagggaaggtctgtccatcctgtggctagaaccggcggggaaggggcgcttctgagtgcccgggaggtcatcatgaagagcggctggagtgactgccctacccccgggatgcctatccatgcccgtggcctggggcagcttctctctgagctcctgaagggcgccagctttagcctcagagcctgtcgtgttctctgctgctcagccctactggggagcatgtctgtctccgcagagacactgccaggagctacggcttcgttcttcaccatgtttgtcaccagcagggcctgcatngggggtgtggaggccgagccggggcccgnagaaagcnaatatttcagatgatgggcctgccaagcaggngcgcacgttggagccaaagccttctgtgccagtcctgtgctagtctagggcacatatgcccttcggggaggcaacaggccatggntgtcctgtgggaggtgtgtgacctggggatgntggngggtcnccatcttactaagggcctcctggtcggtgcctaaaggtgcccctgttcgggccctgggggctttccgggagcccaaactgtttctaggggccccgttc

SEQ ID NO: 724900 - DNA, 336 bp, Homo sapiens
caacagattcgcactgctagttgtttgtaagctatgatatttctttcccactcttgatctgaaagttcccaaatgcactgcataaaaaatagatattccacggccggacgtggtggctcatgcctgttatcctaccactttgggaggccatgacgggtggatcacttgtgctctggagtttgagatcagctctgggcaacatggtgtaacggtgtctgtacgatgatatactaacagtcgtcaggcatggtatcgtgtgcctgttgtccgagtttctcaggcggctgatttgggaggattgctttaacccaggaggtcaaggcttcagtgcgtcga

SEQ ID NO: 724901 - DNA, 285 bp, Homo sapiens
ctttttccctttccccttccttccctccttttttcctcctccttccctcccttccttttttccttccatctggccttggtttcctcccttcccttcctcccggcctttttccttccctcctttttttccttccttccgggggtccgtggtttcctcccggcctttttccttccctcctttttttccttccttccttccgtttggccttgttttcctcccttcccttcctccctgcctccttccttgttttaagaatttgaaaaaaaagtttcccaggggttttga

SEQ ID NO: 724902 - DNA, 432 bp, Homo sapiens
ggtgagaccaggacccagagcaggggaggcaccgctgtctgcaaggtacagaaatgccagggctattgctcacttgaggctatctgcaaatgaagaggtgcccacactgccaattattggggcacctttacatttacattgaacagatgcttacctttaaacaaaagggaaaaaaaggagaagggttgtaagatatttatgagttaggaaaaatatcaatttatagtactttgcaggtaggtacagtaatagagcaaagtttaaagtggtatttttacttttaatcctttatatcttcaaatctcgggagaagaactctaacctcacttggagatagcatcaagtgaatgaagccaggcaatgacccacacactgcccttactgtcccccaccccacaccaaagacatgggcatgctttcatacacacaaac

SEQ ID NO: 724903 - DNA, 982 bp, Homo sapiens
gcttctttggtgggctagcatcttcctccgttctgcctgggcccgcctgctgggcctggaggaggcctcgctgttcagcctcgggggcagtatcgcgcatgtgacccgagggtgtcctggccgccgtggttgggcctgctgctgtcctgcttcggtggggcggtgcgtctatgtcttgagcccgtatcgatggaaggcgggcttcccagcgcggaagagcctggcctctccatggtagcttcaagatcgctgacgtggagcggaagaataaggcccggctcccagatggatgcgctcgtgccggccgtgggtggttcgcgcggtggtgtcttcttgtctggcgctggtgaagcgtcttccaggactgcaggctccggagcagtgcgttctggctacgatggcgtcggtcgcgtgggttgcagttgcatctgtgttagacgtgctgcgttctggggtcaggtctgccgcctccatctgcttctcggctttcgtccgtctgtctattgaccagtcattgtgtgtggtcccgtgtctctgtggacccgcttcactgtagaaggcttcgggtaggactccgggtgttcggtcctgtcgcatgagcacagatctttacgaagcgagagacggaggcgccacctctgtggcagcagatgccttgaggcaaggcccaggggaagatcgagggggggccccaagggacctagggctgtgatgtccagtgatggtgttgacactataacaatggagtccgtcacgactgaacaccctgtggcaatgattggccgtcgttaggcgcaagacccggtgaataatggcaacgacaatagaggtagaaagaactccgaaaggtgacacaggtctgaaaacacgaataaacgatccaaaaataaacaaatacataaaccaagtactaaacgtatcatgcaggaaaccctcacacaccatctaaaagacacacataaagacgaaaaagtcaaacaaa

SEQ ID NO: 724904 - DNA, 195 bp, Homo sapiens
tcagctcgaccgttctgcttctgctggggctggtgggttttgatctttccccttcttttcttccccttcttctttccttctttgatcttctgcttcctgcttctgcctgcttcctgcttctgccaagaatcttgcgctgatgtggtggatcctgctcagagtctagcgtggcagggcgtgctccgtcttaggaat

SEQ ID NO: 724905 - DNA, 379 bp, Homo sapiens
ctgacaatcctgggaacaatttttcagttaaatctcgcttccttgccactgtcaacgaattctctactggtaaatcttcacaggtgtcaactttcattatcatggcatctattggccatctattaaaggcctttacctgttttttctgtcatccagctaaatcttacactatttactttgtgctcaacattatatagcaaagaaactatggacaaaaatctctaggttcaatttatacttgatacctcagagcactggctggtgggaaggcattccatctaattcagactcagataagggaaaacgatcacacttcattacagacttgtctatggcccattcaagtacctttgaatcttgagcaatacacattgccagt

SEQ ID NO: 724906 - DNA, 266 bp, Homo sapiens
ccccctccccgggtatggggtttcgcgcctgtgttcccagctactcgggaggctgagatgggagaaacgcttgagtccgggaggtcaaggttgcagggagccatgttcacaccactataccccagcctgggtgacaaagcgagaccgtctccaaaaaaaaaagagggaaaatcgacggggcccaggggctcatgcctgaaatcccaaaatttggggagtctgaggggggaggatcatttgagcccaggatttcaacatcagcctga

SEQ ID NO: 724907 - DNA, 881 bp, Homo sapiens
tcagctaggatagagaccggagttcatcgaacgaggcattgcccagttgtcagaagaggaggcacagttccacagaatacgatcactgtagtgggtgtggacaacgttggtatggcgtgtgctatcagcattctgggaaagtctctggctgatgaactatgctcttgtggatgtttggaagataagcttaaaggagaaatgatggatctgcagcatgggagcttatttcttcagacacctaaaattgtggcagataaagattcattctgtgaccgccaattctcaagatatgtcagatggtaactgcaaggagtccgtcagaaaagaaggggagagtcgggtcaatctggtgccagagaacaatgtaaatgtcttacaaattccattataacctcagatcgtccaagtacagtcctgatagcatcatcaattgtggtttccaaatccagtggacattcttacgtatgttacctggacactaagtggattacccaaaacaccgcagtgattggacgtggatgtaatctagatactgcatagataatcgctaccttatggctgacaaaacttggaaattcaatccacagcagattgccatggatggataaggaaggaacatgggcagatcaagtgtggctgtgtggagtgatgtgaactgtggaaggtatgtttcctcttccaaggaattgaaatccagaacattgggatctgacatgatccgtgacaatttgggaaggaaagtgcataaagaaggatggattgaaagttggctattgaagatacataaggataaaaggatattacaaaatgggctattggattaaagatgatgaatgaatttaattgatacatgttgaaaaaattaagaaaggataatccgg

SEQ ID NO: 724908 - DNA, 707 bp, Homo sapiens
agccccaaagccagctccagcttactaccagacaagccggttagccaagaccaatttacccgaagataaagtataggcagatagaaatggaaaccgggcgcaagtagatatagtaccggcgaaggggaaagatgaagaaattataaccaagcgataagtatagcaaggaactaacccctataccttctgcataatgaaggtataacctatgaaataacctatctgcaagggaggacgaccagacaggctaaggaccgcgccgaaagatcgcacggagcgatgcgtatcacttaaacgcaaaagcagcctaaagacaagcaggtccagcaagcacccgggtccctaatggaatacgggcacaaaaagtaacggtcggggaaaacggacgtgtctaatgcaaggggtacaggcaaagaggcggcagacaacatacactccgtaaacccaggcatgcgcgcttggaggtacgaaacttcaaggccctccagggcctatgaggttccgcgagaacaaaggacactcatacgggaacaattacctttggtttcaaggttttcgcgagaagaacgggttatagattcaacaaaagttcaaccatgaggcggccccacaaaaccaaatggggaaaagaaccgcaccggtttccattccaaaaagaaattcccactcccaccttttgttgggttccaacagagaagtgttctgga

SEQ ID NO: 724909 - DNA, 929 bp, Homo sapiens
gaggcaggacctagggcttaaaggggacttctccttgctccattactaagaactgggactctccgatgagaagctggttgtctgaagtaaccctgcggttgttggcttaggggacataggtctgttattcgtcggattgagtggctctaatcttaggcatatcgagagctctgtctcaaccagttatatagccccatggatgatagaatacttttatagaaggagtagaggagcttaggtagtaggaagtgcctttcattgtaactacatttatgcaggagcctgtcagtatttgatatacacatgccatcgcgtagtgtgatactgctggtttagcttgacaagtcgtgcctatgcttcattgtctcctgttgtctttcaccaggaaggcgggacgacgcgtttagtaacggaggatctgggtgataagaagtcgcttgggcaagaccagctcgatgtggagctcttactcatgtcttggaggtgagctgaggaaaagtggttaccttgcatgtgtcttaaggatcttctgaagggtagactgatggaataacagtgatcatttgggaagtgctagtccctgttgtgctgtttagccgtgggtgatgtgtcccggttcgatcgtttggttgagctggccggattcaaatgtgggcgattgcataattgattgtcttcaaagtgcgaaggaccttattagggtgccgggggaatgttcgctagatatgcaaagagtggatggaatttgcactctttttggggccggcagtcaatgggcggaaccaaggtaagggaatacctttccagtaggacgggcctaatgaaaaggttgtggcgcccccggtggtggggcagagttccggaagggaaagaggggaaaaaaagccggggaagggacacaggctggcccaaaaaaggacccgtgcacc

SEQ ID NO: 724910 - DNA, 164 bp, Homo sapiens
aactgatacaatcagctcggtacctagaaatcgctgtcgccttaatccacagccgttttcacacttctagttaggtctacctggacgacaactcactacacgaagttaggtctacctgggttaggtctacctgggttaggtctacctgggttaggtctacctgg

SEQ ID NO: 724911 - DNA, 120 bp, Homo sapiens
cctcttctgcgctccctatagaacaccacagctgcccaggagcgtgaagggtttatttcctccatgagcacagcatgtgtgctcgtagagggcagagcatgggatgctccaaatccaggc

SEQ ID NO: 724912 - DNA, 373 bp, Homo sapiens
gtcagcacctgtgggtgctcttgagaacctctagtcgcctcttctaggaattttttcatctcatcctcagagaatcccacattcatagcagacccactcaaaccataggaaggcctcaccaagcaggggtagtccacagcctttgcaaattccagtgcttcattcaaagtattcacagctttccaaggtgcttaagccactttcagttcatccaagccatctgagaagatggacgcgatcctcagccctgtcgttctgcagggggcttgtgcccatgatcttgacaccactcttgtatagaggacctgacagggtgtgtggtatgtggcctacatctgatatgacacagccaccacatgcctcctgatgatag

SEQ ID NO: 724913 - DNA, 583 bp, Homo sapiens
aggccttttagcaatgaagatatgtttagagaagtggatgaaatagatgagataaggagagtcagaaaccaacttatagtgatgcgttggaaggttaatcgaaacctccttacccctatttaatggaggttaccttgatttttatttgatattaacaataccatatagcctgctttttattagcatttcctgatattcctttggccatatttctacttataacctggtgctattaatgggtttagatggatctcttggtatctgcatctcattggttattggattttgaacccatctacaagtctctgtcttttaataaaagaactttacccctttggaaaaaaaagggttttggtaagatataaaatgggaaaagggtaagtaatatgtgaatatcatatttttgaaagggaaaaaggccctttggtttttacaatatggggcataacttgggaaggatgaaaaaaaggccagcctctcggggggggggttatgaatggtttttttccttttggttggttggattttttatattcctaaaattaaccccccttttttttggtagaataataaaagtttttta

SEQ ID NO: 724914 - DNA, 143 bp, Homo sapiens
acggaacgacaaagaacgaaggtgccacgagagacaaggagaagcgtcatcctctgatgagggcagctgattccagcagtagctcatcagagtcctgagatgacatctggagtccgacggaggagcagtttaagaaccctgcc

SEQ ID NO: 724915 - DNA, 262 bp, Homo sapiens
agtgggagggggtgagagaggggggggggggggggggggggctggagcttgcggattggaacattttagcttattgaggagctcttcaaattagaaggcagcatgttccactgatgaaaaaacggggagggggggggtaggcaaaataaaaaagagatgagacaacggactgtgccaacaaactaaaattttacctgctgctatggataaaatagctttctttttagaaatactcatgttaataaactcctacatgcgacat

SEQ ID NO: 724916 - DNA, 1138 bp, Homo sapiens
  misc_feature (1138)..(1138): n is a, c, g, or t
ctggagcagaggcagcagccggacgagcatgcggaggcggtcgggagcgatggtgaagatggcggctggcgggcggcggaggcggcgtgtgtgcctgctactacggcggcggcagtgagggcgtgcctgggcccctaagcggctcaagacatgacaacgcctggctgaccagcacggaggctggcggcggtggcgggtggaggagccggtggctggcgggcggcggcggcggtggggagaactacgatgacccgcacaaaacccctggcctccccagttgtccacatcagggtgcctgattgagcggtgatggatggaaggcaagacgcttgtgggaggcccttgacaggggaggttatggaacccagtcagcataatgtggtgggtaatgccgtaagagaggaggacaagcacgtggtggaagtttgaaaggtgtgttggagggcttgcaaacgcagttgaactacgtcaggccgaacaaccaaagatatacagttgctgggtcccccagccgttgtaggtccaactacgtcataccagccacagacagatatcccagcctgggcgactcggattgagctccccggagccgttgaacaagtgatgctttcatcgtttacgcagtcctgaaaccccgagttcagttcagattcacgcactggatgttcctcgtgacactaatcttgttatccctttgctgggccctggtgccaggagcaacttggtcacttctgtccagccgtaaggaacgctgggacagttccagggacgcatgggtgggaaagttttggaccgtcagagtttcacaaggctgcacccaagctggtgcccgcgaaggtcccctccttctacacacttgcgagcgctagtcgaaccgatcgttcattgtccgttggggcgaggtggctggccgacggtcccatgggaaacggaacttacggacaacattaacatcgccagaggcgtgccccttacgcagaccggtccatatgtgcgaatcgtgttgttctccactgacacagctgcgcagccggggcgtgcagtacgctgatgcggcgacacgtcagcaagagggtaggtgcccagcgcgtggaggtccgtacccaggagtggtgacccacagggcgtttgtacaccn

SEQ ID NO: 724917 - DNA, 108 bp, Homo sapiens
aggtgggaaacgctattgtggatatggactctagaataggatggcgcggttatccctagggtaacttgttcagttggtcaagttattggatcaattgagtatagtagt

SEQ ID NO: 724918 - DNA, 120 bp, Homo sapiens
ccaccagttctcatgggctggcacctcagatctctcttctctccagctgactaaactttttttctgtaccagttaatttttccaactactaaccagcaactaaaggcagcttttctaaac

SEQ ID NO: 724919 - DNA, 517 bp, Homo sapiens
ctaggatagcctacgaacttccctttaaagaaagctacgtagatgcaggatgagtaaaaatttacaaactgaaacaggaacatggtcaaggtggagcacagtggcgtgatctcagcacactggaacctccgcctcccaggttcaaacaattctcctgcgccatcctctcgagtagctgggactacagatgtgcaccaccacacctggctaatttttttgtattcctagtagagacagggtttcaccatgttggccaggctggtctcaaactcctgacctcgtgacccacctgcctctgtctcctaaagtgctgggattacaggcatgagccaccatgcctcgccaattgagagctaatggttttaaagtgtggcacttccccatgcactctctctctcctgctgccttatgaaaaacgtgtttgtttcccctttaccttctaccatgattgttaagtttcctgaggcctccccagccatgtgaactgagtcaattaaacctctttcctttaccaact

SEQ ID NO: 724920 - DNA, 234 bp, Homo sapiens
ttgagcaaaggaattacaacgctttaattaaaaaatcacgagtggatgataaagctgtgtagaaactgaaactctttacaaactatttaataaccttggaatcgctgactgttcagaaactacacagtattggatcatgtggtggtggtgaacatgcatgaaagggattatggatgaatcttgcattgttctaggctgctccccagtgccacccagtctccgatggcaaagcct

SEQ ID NO: 724921 - DNA, 159 bp, Homo sapiens
gtaacgtcaagctcgaagtcacgcgcagatcacgccggagggcatatcatcctcgacgtggacatcaacaaggacagccgggggagacaggcttgctggatcgggatcaacaccaagcacgtgaagacccaggtactgttcgagaacggcggcagggtg

SEQ ID NO: 724922 - DNA, 113 bp, Homo sapiens
atggctttgttaatggcagacctctcggaagtggtccgcagcgcatcgtagacctggccaccaggtgtaatggccctgcgacatctctcgccagctccgctgtcagcaatggt

SEQ ID NO: 724923 - DNA, 144 bp, Homo sapiens
agaaaggtgaggtcttcatctccttcaggttaggattgatcaaaataaaaggtttaaacttgctctcagatgtcttacatataaatttcttatattggaggcatacacattcaagagagcaagagtgcacgagatctataagta

SEQ ID NO: 724924 - DNA, 214 bp, Homo sapiens
cttttggggtctttgctctatatcgtgaggctcggatatgtcgacttctgaagacatccaaacatcgggcgcctccatgacagtatttctgaagaagggtttcactacctcgcgttagaccttgttaccggcggggagcttgttgaagacattgcggccagagagtactacagcgaagcagataccagccactgtatacatcagattctggaga

SEQ ID NO: 724925 - DNA, 214 bp, Homo sapiens
agttaatttttgtatttttagtaagagacaggtttcgtcacgttggccaggctggtctcaaactcctgacctcaggtaatccgcctgcctcggcctcccaaagtgctggggttacaggagtgagccactgctcccggcctgatcttagacttaacgaccttgagtctgtgctttagcctctctcagcctcagaaactaaaactgtgcatggcga

SEQ ID NO: 724926 - DNA, 304 bp, Homo sapiens
atgcgggaaggcaagtgtgcgcgcagcttttccttagacaaaccattcgcgcaccatctcaggcggcattggatataacgtggatagacgataaccgtgcacgggacataaaacgatgccgttttgttcacccagccaaagacatcgcgcgcttccaagcgaacagcttccaattgatgacggccgcgcggcaaggaaagcgtccatgtacaagagaggtggcggcgaaacggccaagcaatcgcaatcatctctcctccgtgcttccgcccttcctcagcaacagcaagcgccgccagcggaa

SEQ ID NO: 724927 - DNA, 161 bp, Homo sapiens
gcgacaagcttttaagcattgattcacaccttgcaaaacatactagaattcacaggggagacaaacattacacatggtatggatgtggcaagggttttgatcaaaagcaacccttgcatgcatcatagaggcatacttgagaaaaccttataggtaattag

SEQ ID NO: 724928 - DNA, 172 bp, Homo sapiens
tcaacgctttatacttcacctattcagtcagcttaatgcatactaaaataaacgtgagacaaatatctagaaatgataggtgaagtattttctacgctgttttttaaaaatgcatagcagatgttccatgacagactaaagagaaaggacactaaaggattctactgcagat

SEQ ID NO: 724929 - DNA, 642 bp, Homo sapiens
gcattggttgatttataattttggtaaaggatcctaaaaccctgtattctttttctgtgccccataatgaccaaaaaagataaagaaaatgagagtaagatcaaaagatcaaactaaaacataaacagtctccttcctgtctgctttcttacctatctgttcacactttatctctttccctttctctctctctctcacatgcgcgcgcgcgcgcgcgcgcacacacacacacacacacacacgcacacacacacacacacacttgccccaacactgagaaataatcttgccagaattctggtttttatagttgttgtagtccgtttctctaaaaatagtcctgttttcatatgaatctaagagaacattaccggagaaaataaagttactcatttatagttactaataataagttagtgattaacttaccacaattggataaaatataaaactattcttcagcacatttatacctaaattagtgaagtccatttgtgaagttcatttggcatctgcagttaagagttaaccatgtataaaatccttcccaaagaacataacatcatttgttgtaagaccaaatccctttttaaggaacaatttaaaaaattttctgggtgaaactttttatagattgattcc

SEQ ID NO: 724930 - DNA, 193 bp, Homo sapiens
atcacttgttcctaaggtaagggacctcgtatggataggctccacgaggttcagctgtctctaacttttaaccagtaacattgacctgcccctgaagagcggcataacacagcaagacgggaggaccctatggagccttaaatatattaatgtcaacagtaccttaacaaaccagagtcctaaacctaccaaa

SEQ ID NO: 724931 - DNA, 285 bp, Homo sapiens
ctcgcttacgacagttgcgggagactatgggtatgaccacagtattcaaacctcctgtgcaggagaagtgatggagggtgtgtaaccagggtgcaggagacaaggtagacagtgaggcagaatatgtatcggggcatatagaccacgactccgcagtgggcctccctcgccaaagacagcctggggaggacggcaatgaagaagataaagaaaatcaaggagatgaagacccaaggtcagcagccacctcaacgtcggtatttttcgcaaactggtacggcgggg

SEQ ID NO: 724932 - DNA, 280 bp, Homo sapiens
  misc_feature (8)..(8): n is a, c, g, or t
  misc_feature (12)..(13): n is a, c, g, or t
  misc_feature (16)..(16): n is a, c, g, or t
  misc_feature (22)..(22): n is a, c, g, or t
  misc_feature (119)..(119): n is a, c, g, or t
  misc_feature (121)..(121): n is a, c, g, or t
  misc_feature (135)..(135): n is a, c, g, or t
  misc_feature (147)..(147): n is a, c, g, or t
caagccanatcnncgncgtcancaatgtggaagccgatcacctagacaattggggtaccccgcaggcgtacttcgacggcttcgtgtcgatggcaacccgtcccgaggtgcgctacgtngngactaatgccgacnatccgggggcanccgaattggcctgccgactggaaagcaccggcacagtgcgagtcgttacttacggagaatctgagcaagctgaggtcaggctcgttgaccttgacttaaatgggacgacggcttcggcgactctcgttcatgg

SEQ ID NO: 724933 - DNA, 330 bp, Homo sapiens
tctgtactgtgactacatgaatcacttgacatcggtagcctggaggttgcagtgagctgagattctgccactgtactccagcctggtgcatcagagggaggctgtctaagaaaaaaacaaaataaggccgatcaccttgtggctgtgcccgcccaggctgttttatgtggtaaaatcttgtaaagcgtagatttctcctggggttggagggagtcggactgttcttcactcattgtccaccccgtaatccgtgcctagccctctgaatcgatcgtgatttttcgccaagtttatgccctaattgcctcttttgccttgccttctggtgcc

SEQ ID NO: 724934 - DNA, 129 bp, Homo sapiens
agcacgataagaaatatgctaatgtattgtgtagctctcaggatggaaagataatggacatatgccttaatctgttattccatatagtcatcttatattccattggtataagcagcaagcagtgtatgt

SEQ ID NO: 724935 - DNA, 439 bp, Homo sapiens
ggaccattgtcgtacatagtcatcttatttatttatttatttattcattcattcatttattttttgagatggagtctcgctctgtcgcccgggctggagtgtagtggcgcggtctcggctcattgcggcctctgcctcccgggttcaggtgattctcctgcctcagcctcctgagtaatccccacaatctcagctcactgcaacctctgcctccctggttcaggcgattctcctgccttagcttcccaagtacctgggattacagatgcatgccaccacggctggttaatttttgtatcttttttttggtggagatggggttttaccatgttggccaggcttgtctcgaactcctggcctcaagtgatctgcctgccttggccttccaaagtgctggaattactggcaggcccatagtccatcactgatggaaacactg

SEQ ID NO: 724936 - DNA, 480 bp, Homo sapiens
  misc_feature (24)..(24): n is a, c, g, or t
  misc_feature (65)..(65): n is a, c, g, or t
  misc_feature (219)..(219): n is a, c, g, or t
aacccctaaagtcccgggtaaaanttttaaagtcccggatgtgaagttttaaatttttgccctgnccgtagtttggtgaaatccactagtgaaatttaaggaaaagtttggcctcccttataaaacaaaataatccctgtccatacatacccttgtataaaatgttttaaagaggtgtttatcctatattaagaaatcaggctgggcgcagtggttcanacctgtaatcccagcactttgggaggctgaggcaggcggattacttgaggtcaggagttcgagaccagcctggccaacatggcaaaccctgtctctgctaaaaatacaaaaattagccaggcatggtggcaggcgcctgtaatccccgctattcaggaggctgaggcatgagaatgccttgaacccaggaggtggaggttgcagtgaaccaagatggccaccactgcgctccagcctggctgacagcaagactctgtctca

SEQ ID NO: 724937 - DNA, 234 bp, Homo sapiens
  misc_feature (190)..(190): n is a, c, g, or t
aggtgtactgttccatgggtgaaggctctaacacggcctgtaaaaactgggtaaggagatgtaagagacatgggccaagtgctaaatggaggaagagggtaatggcagggcctaggaagggcagtagccagtgtgcccatggacgttacgaaatcacctggtgccgtggaatcttgaaaggcgctgcctngatttgcatgcaggctttttgttttttctttgggagaatgggag

SEQ ID NO: 724938 - DNA, 147 bp, Homo sapiens
  misc_feature (59)..(59): n is a, c, g, or t
gactacgggcgatgagtgtggagaggaatggcgtgctatatgtatgttcaaactgacanattagttttacgttgatagatatgctgagtagtgtgattgaggtggagtagattaggcgtaggtagaactagatgttaaggagggcgc

SEQ ID NO: 724939 - DNA, 115 bp, Homo sapiens
  misc_feature (105)..(105): n is a, c, g, or t
acgcctccacaatgcccttactctgtgcattcgtggagaggcccttcaccacctcaaggcccacggtcctaaacctaccttcccaaatgcatccgggtcagtgtnagtggagctt

SEQ ID NO: 724940 - DNA, 124 bp, Homo sapiens
agggttatccgctgtacatgttgcggacattggatattcgcgggcagcatcgggtcggggctgtaggcggtgcgtggatagctgcagttcctccccggtacgggaaggagctgttacgccgcct

SEQ ID NO: 724941 - DNA, 302 bp, Homo sapiens
  misc_feature (3)..(3): n is a, c, g, or t
gcnccgcctctcctgcccccgggttgcgccctcctgttgttccctgggggccgccccgtggtgcccttgggggggggttctgcccggctggccgcgggagcgtccgttgtcttcggctgcctggcggctggctgggatccgccgccggtcccccgttttttggcgaggagcgcgtcggccctcttgctgtgggtgagggggcccctgaagagttttgttatctatgtgtcacaagaatggacgataatgattcctccgacataaatctgactcccctcatagaaattcctttcatgaaagaa

SEQ ID NO: 724942 - DNA, 163 bp, Homo sapiens
gtgatgacagtgatgatggtgatgatggtgatgataatgatggtcatgattgtttggtgatggtgatggtgacagtgatgatggtgatgatgttgaaggtggtgatgatgttgatggtgagtgatggtcatggtgatggtggtgatgaccctgatgatggtga

SEQ ID NO: 724943 - DNA, 162 bp, Homo sapiens
ctatctgtatctacacttggaggcagcagtgatcactgaggtcggatttgagacagctgacacatatgaacccccgtctctataaaatacaaattagcgggcgtgtgcgcatgctgtatccagctgctggaggctgaggaggagaatgcttgacccggatgt

SEQ ID NO: 724944 - DNA, 916 bp, Homo sapiens
gccagctgtaatatctgcaggttgcggcgggtcggggcgagaaggctgaggggatctggcgtgtggagcgctaggatcagacgcccccgcaatgaccagctcccccgtctccagagtcgtgtacaacggcaagaggaccagcagcccccgatccccacccagcagcagcgagatcttcaccgccaggccacgaggagaacgtccgcttcatttacgaagcctggcagggtgtggagcgagactgcgaggcaggtgccgggtggcgagcggggctggctggatggagtatgtggatgaaggtccctaggccccgagcctgaaacgacgttcaagcccatcgacctgagtgagctgaagcgccggaagccacgccaggatgccaaagaagtcctagagcgcacccggtgcaccctcgcacggaactccggaagataagggatcacgaggggagaacgaaggagcctctgactgacgtccagagctgctgggactggcctggatatgggatcattgaagtggtcaggactacaggacaacgggcagcgccaacacctatccagcacttggcagcttcacaccagagcaggaaccacttttgcctggcatcgccggtgggcacttgggacaaacagcctggaggagcatcacgtcaaagaacagtaccgccttacacgaacccaggcccctgggccatcaatccgcactcgcgaaatcaaagcgttaagagaactggacaccatcacagtcatagtgggggcccgagggcgaatacatggacgcgagggacccaccccaacatggggatacacgaagggaagcccaaaggcaattgggcatcccatgggctggtagaccggaggactaagaacggtggaccacattgtgcacgagcagccacacaaaggaatcgacgaag

SEQ ID NO: 724945 - DNA, 1032 bp, Homo sapiens
tgatacctctctctcccgagggtaaggcctctggagccattacttccctgggtcgtgggctgtctccgaggtgtagggaggggctatgtgttggccatgagaaagttctcttaaggggcgtctccactggggacttctctgggagcgggggactgtgtcccgaaccatggggttcgaggcgggtgtgtctgcccatggggacgttggagactgtgtctcctcgggttatctagtggggaggggggccgtgtcatctactacgtgtgtaggggggtaggggggtcgagggtgggggggtttatggcgccgcgttcgtggtgcccacattggcgagttcgtgttaacttctatggttcgtgccactttcccacatgacatcgcataaccctcccgtggaagggcacccaacggacaaagcacaaaaaacgaaaacaaaaaacaaaaaaacacggcaaagagaaagagaagcgggaaaaaagagaaaagagcgaaaaaagaacaataacagagaaggagcaaaaacgaagaggcagcaaaaacggcgaaacgagccaggacgaggaggcgggagcacgagacgaagcgactatagcgcgcgcgggggcgagcagcgagcaagaagcagaaaaagacacgaagaagaacagaaaaaaacgaagtaaagacaagcacaaacgaagagcgacacagagccagaacaaggtagcgaagagcaggagagaacgagcggggaggagcggacgaggcagggcaagatgggagggaggagcgaggaggggagcaggaggcagatcgagaagagacacaagagaaaaaggcagggacaagcaatgacgacaacaggaggggcggaagaggagaggagcgacgaccgacgaacaggataggcgaaggaagagcagggcgagcgacccggcaaacgagcgaaaggcgaaagcaggagaagggaggggacgaggacaggggacggaagaacgagagagggagaccggcagcgcgaggcaggcagcacgaagacgagacgaagaaggc

SEQ ID NO: 724946 - DNA, 690 bp, Homo sapiens
agcgggtggtgttcaaccagcgcgcttgcagataacagctcgttattatattcctcccttgcggcgatgcgaatccgaggatcggtgtctgactcccagagaggcccagaaagcttctgttgaattgtcctcgtcgccgccccttgtcatcacgcaagaccaacaaaccctttggtatcatctgtgtaggggatgacaaccgtgacctagaccccgcttaccctgtgctcctcacgttgaggaaggcagcattgcgaagtgtgtggactttgctggatgaaactggtccgcggatgtataattcctagtgtgataaacaagagctgggatgcctaagcctgctcagagttgttcagtcataatatcacagtacagaagaattatattcctacctagagaggaattcatcccacatactatatttcaggcatctattggtgaatcccagaggaccgccgagttgtgattatcgagtccgcgtcttatgtccttggctcggacttcacgagagacactcacgtcgtgttcttatcgaaatattgttgaggttccatcgtgtcttgcttggtccaagtcgatctaatgggtcttctgacgcttggacattcaattctgccatggtcctagatcgtcggcatcctaggggaaagcctggtgttaccccactatatgcacgggaatcccagttca

SEQ ID NO: 724947 - DNA, 899 bp, Homo sapiens
  misc_feature (352)..(352): n is a, c, g, or t
  misc_feature (366)..(366): n is a, c, g, or t
  misc_feature (373)..(373): n is a, c, g, or t
  misc_feature (378)..(378): n is a, c, g, or t
  misc_feature (408)..(408): n is a, c, g, or t
  misc_feature (475)..(475): n is a, c, g, or t
  misc_feature (478)..(478): n is a, c, g, or t
  misc_feature (522)..(522): n is a, c, g, or t
  misc_feature (539)..(539): n is a, c, g, or t
  misc_feature (597)..(597): n is a, c, g, or t
  misc_feature (601)..(601): n is a, c, g, or t
  misc_feature (608)..(608): n is a, c, g, or t
  misc_feature (620)..(620): n is a, c, g, or t
  misc_feature (646)..(646): n is a, c, g, or t
  misc_feature (655)..(655): n is a, c, g, or t
  misc_feature (667)..(667): n is a, c, g, or t
  misc_feature (679)..(679): n is a, c, g, or t
  misc_feature (720)..(720): n is a, c, g, or t
  misc_feature (727)..(727): n is a, c, g, or t
  misc_feature (739)..(739): n is a, c, g, or t
  misc_feature (754)..(754): n is a, c, g, or t
  misc_feature (776)..(776): n is a, c, g, or t
  misc_feature (804)..(804): n is a, c, g, or t
  misc_feature (822)..(822): n is a, c, g, or t
  misc_feature (870)..(870): n is a, c, g, or t
ggctgcacgccctacgaggttcgcttcaagaaggaccactcgctgctgggccgcgttttcgccttcgacgccgtctccaagcccggcatggactacgaattgaagctgttcattgagtaccccacgggctcgggcaacgtgtactccagtgcatctggtgtggccaagcagatgtatcaggactgcatgaaggacttcggccggggcctatcctcgggtttcaagtacctggagtacgaaaagaagcacggctccggggactggcgcctgcttggagacctgctccccgaagccgtgcgcctttttcaaggagggcgtgcccggcgccgaacattgcctgccccaagcccantccttggacgccangcctgtnccacntgcctgcccaacatgctcatgggtgagtcntgagcccgcgccccccaagcgcaaccccccgggggaaccggggccctttgcctgccccgcctgcgcncgntcggggcccgggggcgcaaccgcacaaggccttgcgcaaagaanaaaaggccctcttccgngaggcccccgggacttcagaccgtaggggcgcgtctgtaagcgtggggcgagggaacnagcnagaggcnagcaagttggantggcgaaccaaggagcagagggcgcntgaaagcanacccaatgtccngccgggggggcnttcgcgggcgccgggggcacgcgggcggggggggtccgccntccgccngcccccaccctnctgggaccccaattncaaccgggaccacccccacccntgagttagccccccccagaaacgggtcngtcccctaatggccgctnctcaatgtcggttggcagaatactctgggcacagcgcactcgcccaanggatggcagttccgtgcactctaccactg

SEQ ID NO: 724948 - DNA, 129 bp, Homo sapiens
tagtaactcatttattgaaaacatattatctcacctttctcaaattgaagacgcaaaaaataaaagcgagctttattgagttgctagtgacctcggggcgagcgacgacacgcctctccacgctccggg

SEQ ID NO: 724949 - DNA, 198 bp, Homo sapiens
catgcttcgcgcacacggtcccttcgcgcatacactcctatcgccggattccagagctgccatagcccccgatccctgtctgtactcatatcaaccagatcaccttttctgtggtctgatgagcgtcggcctcgggcgccttaacccggcgttcggttcatcccgaagcgcctagttctcgcttaccataagtggggg

SEQ ID NO: 724950 - DNA, 102 bp, Homo sapiens
ccgattggtcagtgtcttcagctgctcccaggacttagacagatatatgctgcttgaggactacacgtctgatgacaaccctccctctcactgcactgaccc

SEQ ID NO: 724951 - DNA, 173 bp, Homo sapiens
gctgcttattgtggtgcctttccacagcatgacgtaattgctatatggattacaataatctgtggaggacaatagataacatggggaaggagattccaactgatgcaccctgggaggctcaaccatgctgacaaatgaggacaacaatgaccatgaaccgagctcatatgaca

SEQ ID NO: 724952 - DNA, 396 bp, Homo sapiens
tttattttaaatttgtgataattctgtgagatagctggatcactccattttatggggtgatggggaaaaggttggaatcagtaacttgaaatttagtttgaaaaatgcagagccagccagacgtgtttgctcatgcctgtaatactagtgctttgggatcctgagggcaggaggattgcttgaagccaggagttggagaccaccctgggcaacatggtgagactcccatctctacaaaaaattaaaaattagccaggtgtggtgatgcatgccagtagtcccagctattcaggcagctgagctaagaaaattgctagaacccaggagttcaaggctgcagtgagctgtgatcatgccactatactccagcctaggcaatagaacgagactctttca

SEQ ID NO: 724953 - DNA, 178 bp, Homo sapiens
gtggggggagggaggggcccttccccccccttttaatccccggggccccccagcttccctgggccccagggtttgtccccggaaaaaaccaatggcccgtgggggtgatggggaggcccccccccccctgtttaaaacccggggtcttaaaaggggttttttggccttttttttttta

SEQ ID NO: 724954 - DNA, 297 bp, Homo sapiens
  misc_feature (74)..(74): n is a, c, g, or t
ttgacctttggtgcactgcccacttcccagctccactggcccaagtctgagccggaggcccttgttttgggggnctgtgctgtactttactggggaggccatagaagatgatgacaattttgaagaaggtgaagaaggagaaaaggaggaattataaggtgacgaggatggagaatactatggttatgcgtaaattaaccccatggtgtaatgtttgtctgtcaattactcatacgatgtatttaagtaagccacttttcattccgtatacatctacagttgtgtgtcaatgtatag

SEQ ID NO: 724955 - DNA, 723 bp, Homo sapiens
tgatcatgacgcttggagaggttagccaaactcggacaggtgtactgctcccatgtcatgtaaacattacgacttgcagatatgatctcacagcactgactttcaaagtgcatatctgtacatgcagccgtaagtgttggcacttgttcacttttcaccacatgatcactgtgtcatgtataagacgagacctgacaaatttacgctgcgctgtgtcacactcatatgagagttaccaacttgtgcattgaacgggactttaccctacttggcctgaatagcttaactggtggagacttcttgctgtaacgcacaccagaaaattgtctgcgtaacagaacacacgccccacgcatatggcggacaattattatactaatgccatacaccaaactgccgcaggaccacgcgcgttcccagctgtcgtggtcccgtcaaggtatacggatttattcccatattcccaaaatgttgtgacttggggccgtacataggatagtgccgtagggactttgaatctgacgtatcaggaactccagtaatgggcgggtgaacaaatactatgtgtagcgcaaacagtactagtgcgataaatctaggagcaacaataatgggccagacattcaggtattccccgcggatcaacacatctgtttggggcacctactagtgcgttacacacgcgtgagtcgatcgcagatatcatgcaacgtagtacatcaa

SEQ ID NO: 724956 - DNA, 182 bp, Homo sapiens
ttgggatatttataaaagtaatagtacatggtatttctggtggcctctgagagagagagagagagagagagagagagagagagagagagagagatatctctcattcagtctctggagtttttttttttttttttttttttgaaaaaactttctggggggccccccgggggggaggggggggg

SEQ ID NO: 724957 - DNA, 1310 bp, Homo sapiens
  misc_feature (1)..(1): n is a, c, g, or t
  misc_feature (69)..(69): n is a, c, g, or t
  misc_feature (197)..(197): n is a, c, g, or t
  misc_feature (204)..(205): n is a, c, g, or t
  misc_feature (212)..(212): n is a, c, g, or t
  misc_feature (242)..(242): n is a, c, g, or t
  misc_feature (250)..(250): n is a, c, g, or t
  misc_feature (284)..(284): n is a, c, g, or t
  misc_feature (293)..(293): n is a, c, g, or t
  misc_feature (295)..(295): n is a, c, g, or t
  misc_feature (305)..(305): n is a, c, g, or t
  misc_feature (344)..(344): n is a, c, g, or t
  misc_feature (346)..(346): n is a, c, g, or t
  misc_feature (365)..(365): n is a, c, g, or t
  misc_feature (398)..(398): n is a, c, g, or t
  misc_feature (408)..(408): n is a, c, g, or t
  misc_feature (535)..(535): n is a, c, g, or t
  misc_feature (748)..(748): n is a, c, g, or t
  misc_feature (794)..(794): n is a, c, g, or t
  misc_feature (823)..(823): n is a, c, g, or t
nactggtataggtctggttgggtctcagatcgtggtaagttgcatggacggttgtagactgcggtggtnggtcgaggtggtctgtctgtggtgtgtaccggatgcggtcgttgcttaggtgagtgttgctagtggttcagggtgctcgtcgacgttacgataggttagcttgatggttggtagcttgcggggtacgnaacgggnncaagtgngccccgggattagcccccgggcgtttgctnggtcggtnaacccgccggcttcccgcgccggtcatcgcccgnggtgtgacntnccgccgcgcnccggcagactggttgtgtggtatcacaagccgccccacncnatattgggcggcgtggttntgttcgcccccctctctctgtggagttgacgcntgcgtccgtncctgagaagacttctttgttggtctgaggttagctctgtccgcgctcagaaaaactcttctctgggttgttgcgcgagctcacactatagttactggagggttgttctccgttcgtgcgctggtctncctcgtgctcatatttatggtctcgctgcggggtgtttctgcggcgccctctcttctccggccgccgcggcgttatgtaatggggtcggctctcctcttggcccacccttctgggggtggttatatcctttctgcctcaaggaggacgcacccgccgccacaataaatgtggtggaccgaggagtttcgtgtgcaaaaggcttgttcgctccncggtccgtgggataactcctacaaaacaccacggtgggagagtccntcgtgttctgttatcacttagagacgacnaacatatcgggccttaataacgagagtgacaatgatgttcccactagagagaagatgctggcgcgaagaatttgtgtgatacacggccagctattagtgggtgccgcgcccgccaacactgccgttcatgtgcgcgcacgaatatagagagcaccgttgtcgtgccgccacaaatagggcacggaaacatggttcgtgagtgccgcgccagtaatacatcttgtggggtgtccacacacacagaggtgtgtagtatcaatatatgctgcttccttaccacgggcacatgtacagcaattagcgtcgtgtgttctactaggaatattagcaggcttgccacccgccctggtaggtaattcttgcaccacgaatagcccctgtgcgagaaaaccccggctgcaacacatttgtggggggcgtggtcgtcccgcagttagaaatcccccccccatttttttgtggggggtattttttgccccacaaaaaa

SEQ ID NO: 724958 - DNA, 388 bp, Homo sapiens
gtgaataaagtgtgtagttatatatttcactaaaagtgaaatacccttttaatgaccaacattctttgagtgcctggcattgttttgcctaaaaagacctgcacatggctgggtgcaatagcttacgcctgtagtccgggcactttgggaggccgaggcgggtacatcacaacgtcaggagttcgagaccagcctggccgatatggtgaaattccatctctactgaaaaaaaaaaagaaattggccgggcgtggtggcgggcgcttgtggtcccggctgctcgggagggtggggcaggggagtccctggacccgggaagtggaggttgcagttagcggagatcatgcaactgcattccagcctgagtgacagagcgagactctatctc

SEQ ID NO: 724959 - DNA, 209 bp, Homo sapiens
tatttatacaagaacgccagtcttaacatttctatctctgatgtaaatgaagtaactggtcttaaataaaagaaatgcacaaggtctgggtactggctgctatgtgacggtcttaattaagtaaactaaggagtttcttttataaaaaaaatgacatgttggaaggcttcattttatggcacaaaacgtccggggggatccgagcgtcg

SEQ ID NO: 724960 - DNA, 172 bp, Homo sapiens
gaatggactgcagtaacgttagcgtttaggcgtacggccagggctattggttgaatgagtaggctgatggtttcgataataactagtatggggataagggatgtcagtgtagcctctgctggtaagaacgctgcggctaggccatctgtaagtcttgagaggcgaagagcct

SEQ ID NO: 724961 - DNA, 132 bp, Homo sapiens
tgagctcggtcccccatattctgattatctttcatttctgacaaccacttcctcaacctccccaccctacagagctgagcaaagaattcagttagactttctgcaatgtcagggcctctcctgtgaaattgt

SEQ ID NO: 724962 - DNA, 252 bp, Homo sapiens
tgacaagtctttgtggtttatactttggttatgatgggctacttttattgccttatggtcaccaactgtggcctgcattatttttttgaattttccatttatgaagttttctttttcacttactatatacttgacttttgtacatgctacctgatggcttaaaaagtggcatattatctgcttttggttaatgtatctttgtatgttcgtgtggaataccgtgtgtctaattctaggcagcacacctatatg

SEQ ID NO: 724963 - DNA, 709 bp, Homo sapiens
agctgagtggttgtgtggtcgcgtctcggaaaccggtagacgctggcagcatggactgaccagctgagtgaagagcagatggcagaattcaatagaagctttttcactatttgacatagatggtgatggagctataacaacaaaggaatgggaagtgtaatgagatctcttgggcagaatccgacaagaagcagagttacaggacatgattaagtgaagtagatgctgatggtaatggcacaatgtgacttccctgagatttctgacaatgatggaagagaccatgacatgacacagactgtgacgaagacaattagagaagcattccgggtgtttgataaggatggcaatggtatattgagtgctgcagaacttcgccagtgtgatgacaaacgttggagagaagttaacagatgaccgaagttgcatgaaagtgatcaggtaagcagatattgatggtgatggtcaagttaagtatgaaagagtttgtacaaatgatgacatgcaacagtgaaagagccttggtgcagaatgtgtcaactctctctgtaccaacactcggtgttatattgacctggacctctgttagtgagcttaatcttgtacaaggttcctccccttagtgtccacacaatttgcctgtcctcagtaaactaacggaacttcaatttcttcccatggtgttcctggcccttatcactaacgggct

SEQ ID NO: 724964 - DNA, 763 bp, Homo sapiens
cgaggatggccgtcatggcgccccgaaacctcgtcctgctactctcgggggctctggccctgacccagacctgggcgggctctcactccatgaggtatttcttcacatccgtgtcccggcccggcgcgggagccccgcttcatcgcagtgggctacgtggacgacacgcagttcgtgcggttcgacagcgacgccggagccagaggatggagccgcgggcgccgtggatagagcagggaggggtccggagtattgggacgggagacacggaaagtgaaggcccactcacagactcaccgagtggacctggggaccctgcgcggtactacaaccagagcgagggccggttctcacaccgtccagagggatgtatggctgcgacgtggggtcggaactgcgcttcctccgcggggttaccaccagtacgcccttacgacggcaagggattaccatcgccctgaaagaggacctgcgctcttggaccgcggtggacatggcaaggctcagaccacccaagcacaatgtgggaggcggcccatgtggcggaggcagttgagagcctaccttggagggcacacgttgcgtgcatgtggctccgcaagattacctgggagaaacgggggaaggagacgctgcagcgcaacggacgccccccaaaaggcatattgactcaccaccgcttgttctcttgacccaatgaaaggccaacccctgagggtgcttgggcccccctgaggcttttaccctgcggaagattcaacat

SEQ ID NO: 724965 - DNA, 746 bp, Homo sapiens
ctcccatgttagttctgaaggagtgttcaggacacaaatgggggagccctcctgcccaggcaattcccttagatgggtaacatgatcccggatagtaagggaaatccccagtcccatggagaggatgccttgtctgggaccccgccagaccagtaggataaccatagcgttaatgtcctctggaaaggttgaaaattccctgagatcccgcccaccgcattgtagcccaaattgtttattgctagcccccgcccagaatgggtatttccaaggcccggggctttttttattttgttttggtttgttttgttttttttcttttttgctacccttttttgggggggaccctttaatttgggcagacaatgctgagtatacttttctttcaccacccttgccaaccccggtagccctggagttttctttttttctcatcatcattgttttgttttttttatggttccagacttttgccatacatgaattaaaaataagccgttctttaaagcatagcgctctaaaaactattcttagtttataccctccaaagttgggtctttcatgaaacaccgtggtttcgaatatgaacccccgtagcattctcgttcgttgttagggtaagagagttttgtagaatgatctcccacaagaacccgtcctccaaaggcctttacccgtgatatcttttaatactcatgtttttatttaatgatgtaagatagaattaataaactactaaggaaata

SEQ ID NO: 724966 - DNA, 145 bp, Homo sapiens
ccaggattccttctcaccgcatacactcttctgtgcccataaatactcatttcaattaataattgccagaggaagagaagaaatatttgagtcacgacatgtagttccccttttagagtcatttatataatccagcaaattgcaa

SEQ ID NO: 724967 - DNA, 772 bp, Homo sapiens
cagaagttacaggaagggtttccatcaccttgagtggccaagctatttttgagtcaagaaaatctgaacctgtgtccagaagcagagtcttggcagtcactttataaatcataccacctataggaaggattaggtgataccatctgtacggggttggatgatgtcccctcaaaattcatggccacctggaaccttagcatgtgaccttattggaagggatccttgcagatgtcatgagttaagatgaggtcatgctggatcaggataggccctaaatccaatgactgatgtccttagaagaaggccatgtgatgatggaggcagagatgcgcgagatagagctacccaccaaggaacaccaagggtttctggcaggagcaaggaaggattcttccctagagcctgcagagggagcatggccctgctgacaccttgatcttggactttttggcctccagaagtgtgagacaataaacctctgtgtcttaagtcctgagtttctgatcatttgtgacagcagcctaggaaggtagtataccaaaatagccatttccacaagtggggaacaacccaggcggtcttgtactgcccagacaatgatgctccctggagtcacgtaagtggccttctctggaattccccatatccggcccggggtcagactcaggggttgctgtttcttaacctcagaagcaagtacttcagggctcccttcagagggcaataagagtgggggcctcaactccctattggggcacatatgggcagatga

SEQ ID NO: 724968 - DNA, 207 bp, Homo sapiens
tggtaccgaatacgggaggacaactctaagaggcataatcgtatattgtcctgtgttcacgcgagaagaaaatgagcaaggcgcgaggttaggtaaatgtgctaggggtacatcattggatcatataacagcaataagaatttgtgtcgttgtgcatacggtgcttcctgtgtagttcaaatactattctttattatgggaaatggg

SEQ ID NO: 724969 - DNA, 253 bp, Homo sapiens
ttacttgtgtagtaataattgtgtccacctatgatcaccatatgagccacgactccctgctattgcaataatcagtctccggagccaccctgtgatcataagccatctgccattctgatgggcaccatgtatctagttgcagagtcccgaagtttcatcagacactgaaagcaatccatgaccgtcgtcaacggtctccatgtgtctcccatctttctgatcatagcgccatgagtgtctccccactactagg

SEQ ID NO: 724970 - DNA, 748 bp, Homo sapiens
  misc_feature (496)..(496): n is a, c, g, or t
  misc_feature (521)..(521): n is a, c, g, or t
ggcacacatctcccgcttcgttgtttagctccgccccccgcatccccccccgtccttcgtctcctcacgtgcgggcgtatttgggcccccccccccctctcctcaagccggtggttgtctcctttcaagtagcaacgcgtggcaccacagcagattgtatcccgctggtttgtcctccacacgacgggtttcccgacagcgctcgggtggcacacccactcgcagatatgcggggagactcttgctggaggtgcgcccttctccctctcgcgagagaaaacaatgtgggcagtgagcctcgccccccccagaccagggggtagccgccctcccgagtgcaatgcttttctgggaccccgtggctcctctccggcgtgaaagagagttgccccccctgctcgccacacgctgtttggcctccccccgtagacgagctgctctccaccacacgttcttggggtccaatatcgtacacaggtgcgcgcgccacatgccncgggggagcttatttgcttgccccnccgcaggagacatagtggtctccccccgcccccccgttcgcaaagagagaggagcgccgcaaagctactggccggcgccccaaccgagcccaggcgaggccgaagaagtggggcccgtggcgacacacgacatccaggatgcctttgttaggtgacctacgaaaaatatggtgggccggaggaagttcaaaccccaacaaccatcgaaccagaccaataagcccatc

SEQ ID NO: 724971 - DNA, 626 bp, Homo sapiens
tggcccaatggagtctttcgggggatcttacatgggaatctttcttaattcctcttaaaatccattaaatgttatctggacaatattcctgggatttgggaagaaatctgggatgtaggggccgtatgaaaaaatccattccgaatatcagattaagggggtataggggtcgggatagagaatggttttaggaaagaaagatatggtaagggcaagataacataatttggtcacattccaaaggtataaaaccggcgtacttttttccctaagaaaaggggaacgctcatttatagggcagcctaaaccaggtaaagattttcttcctcctcacaaggtgcaagattttggtaccttctcggttggtcaaaacatttcttgggccctatggcttggccaagagtggattataagaaagggaatgttaccaatattttttgtggaagaacaaatcacttcctggattaaaattttctttaagacaattggagtaactcattttataagagaagagaattttacatggtgatttaaggctcgtgggtctcggcccctttggggggtccactctttctaccttctttccattcacttattggctaacatttttaggaaggtaataatcg

SEQ ID NO: 724972 - DNA, 851 bp, Homo sapiens
tcccaaagtgctgggattacagatgtgaaccaccgagcccggcctactttttgtatttttagtagagatggggtttcgccgtgttggccaggctggtctcgaactcctgatctcaggtgatctgcccgcctcggcctcccaaagtgctgggattacaggcatgagccactgcacccatcccgattattggttttatgccacaaattatttctcatctcttaaacaaagaaaaaaactatttatttttaattttcaactcaaggggcacatatgcaggtttgttacatggatacattccatgatgctgagatttggacttcaattgaacctgtcacccaaatagtgaacatactgcccaatagatagtttttcaacccttgtcctcacttcttccctcctcccttttgtagtccccagtgtctttttgtcgttgttaagagacagggtcacactatgttgcccaggccaatcccgatctcttgggttcaagtgatctacctgcccttggccttccaaagtgctgggattataagtgtgagccaccacatgtggcctccagtgtcttttgttcccatctttatgtccatgtgtacccagtgtttaggttcagcttataacaggagaaccatgcattattgcggtccctgttctgcattttattcaccttaggataaatagcctccagctgcaaaccatgttgctgcaaagggatatgatcttttcctttttatgggctgcattactatccccatggttgtatattatgctcctctacaaattcttttatccaaatccaccgcttttgggccacttagcgttgatcccattttggctatttttgacaatgcttg

SEQ ID NO: 724973 - DNA, 148 bp, Homo sapiens
gcctgtgtgacggaccacacggagcgccgcggcgcatctacatccaggcccacatcgacagggacgtcctcattgtcctcgtaagagatgctaaaaaccttgtacctatggaccccaatggcctgtcagatccccacagagagagcgt

SEQ ID NO: 724974 - DNA, 1296 bp, Homo sapiens
cacgaagactccactaaccgccgccgcctgtctgagctagctgcgctatcatactctcccagtactggacgatgcagcatgacactctctgctcagagtatgtttctcgccatgcaaggagacacagaagtccatctattacatcactgcgctgacgagcaacagagcagcgtggccaactcagcttctcgtgcgacgccgcagctgcgcgcacacgcggcgccttccgcccgctgcgctcctactatcgacccgcacgcccgacctctgcacgagctactgctgctgtcagtcacgccctcaccggcaccctttgccctggcgcaccgcacgccctggctcctctaccctctaccccaatcgcccagcgctatcttgccagccctgccacctcaacacaactagaccgcatccgaacccaactataacacatcactgcccacatcacaagccctacgtcccccaccccctcacgccaaacaaccctcattccacacccctcaactctcacacttaaccacccatactaccacccacaaaaagactatcccctcaaccgctgcaccacactactccacaactttaccacctctgcctgctactcccacccctatgccctccccccctccctatactccccaccccccccctaaccaacacactcccacccccaacccccattaatacaacacacccgcgacactccatcgccaaacccctcccagcaccaccactcccgcctcccccactcccccctccccacccatccccccccccctccactcgcacccaccactcataccaccacccccacccacctcacccccctctgcctacacaacaataaaccaaagaacaaaaacccccctcactccaccataacagcctacaaatcgccctaccattaaactgcatccaaccgccaccaccctccccgtcccacacccatccacacaaccccatagtccaccgcccacccccaccccacaccatatcactacatcaaacttacccctatactttttcaccgacctccgaccgccttaccaattatccacccaccatcaccttcctcacccatttctctcacttctacacatcctaacccacaacaagcaaaacacgaacgtatcaacctcgatacccccaactagcaacgccctccactacacgcccgccccccccctatacaaaccccacccccgcaccacctcaaactaataatgcacaccccggcagcctaacctgtgtacacctctccaatcgccaatccgtctctcttctcctctcctctat

SEQ ID NO: 724975 - DNA, 390 bp, Homo sapiens
tatacgcgtcaggggctggacagagggcaggaggagcgagcgtgagggtgagggccccctcccagcgctggagatgggagggtggataggctgtgggtagcagctgtgagtctccaccccgacaagcagtgttcctcctgtgccaggccagcccatgctctgtggcatgccctagcaggcacctagcgggacagtggcgtctgctacagggacatgagcaccgagcgcaggtgtgacacatctatgcactgcttgatgctcttgggggttgaaggtcacatagctgggccaccttctcccactctgtgcctggggtctcctcctttggattccttcacgaaagcctcctcggatgcccggttgttgatcttgtccttctctacttgttca

SEQ ID NO: 724976 - DNA, 222 bp, Homo sapiens
cagctgtttgccatcaggcgcacaagcaataactccatgcgattctgccctaccatctgtgtgcgctggtttactgagtccattacagcatgccatgcccagactcctaaatcctatgggtacagacgcgtacccaacactaaacgggacgagctttgctatatactgagtatgggtattaaatacgacatgtatccgacagcctggccgctcacgctaccg

SEQ ID NO: 724977 - DNA, 365 bp, Homo sapiens
tgaggctcctcggttcgatggctctggggctgaggttcatgtgggagttcccagtcaagtgactgtttcctatagtcgggctggaggactgaatagcgatcgctggatgatttgcctggggccctgttgttcagaggggctgcacatgatcagggagctagtcctggaagatcagcgagattccattcccccgagttcagggataggaggattccaccttctcaattaggttgactagacactttttggctcctgtgaagttgctggccccaatgctgtctgatccatctagcaccaggtagatgttcatggagcctgaagggtccaggacgatcttccgcttctgttgttcccctgggtgccag

SEQ ID NO: 724978 - DNA, 366 bp, Homo sapiens
tgatgtggttgtactatgaggggaggagttcgagacacgactgaaggagaagaagcaggagatctgtctgatgagctaaggatttcttggggatgcagtaggaacaaatggccacaagtccctcccccatggcttgattggcatgcagcgatatggaccaaccccatcgtattccaaactgaaaattcctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttgggggga

SEQ ID NO: 724979 - DNA, 1889 bp, Homo sapiens
  misc_feature (410)..(410): n is a, c, g, or t
  misc_feature (631)..(631): n is a, c, g, or t
ccgtcgagtctagcgtccgtgttccatattgttggatcattgccctcttgggttggcatgtttgttggcgctctaagaggtagaccgctctctctatctgctcgtggtatggtttcgtcctgcggtctactacccgtggggggtgacccccggaatgcgtcccccgttggtggacccctttggtgtgtttggggggaccccgccccgtgttggtctttctctccctcggaagtgtttttgtcctgacactagttgtggcaacttttttcggggggcgccgctctgggggtgttgcttgactgcggtatcgccgttgtgtatacgcgggcgcgcacgcacagagggtggtcgctacaagatgaggcgccccgttccagcctaggtggctttgtctctcgcgtcgtaacgtnggtcacatatagtggctcctccatacggttgatatatattatcgtctcgacgttttgtagaaatttgtccccgcgtgtcttacaccacacaaagattgttttgggtgcccacgcctcactggtttgtggtgccacataagtggggaagccaagttctggttacgggatgtcctagaaaagggttcgcgctttgtggtgagagaggagagaaatatgttctntgagttcgcgttggttggtttcgttccgccccgactggcctccgccacacgattttaaaaggggagtaagtttcgtcagatgagtggaggttccttctactctggataggattgttccgtgttgccacccgttggggggggcgccccttctgttgtgttcctataagaggataatatggaggtagagtggtttgtgttaaaagagaagtgttagttagcctccccacagatggcctgcaacgtatgtatccttcgagagatacccctcgtgtgcctcccgtggtcgccacaaaagcggcgcgcaaccaccacaagaagttgttcgtaaagaacagctcaatattattcgggtgggggcgtactattcctcgtcgggggtaactgctcaccaacaaagtggtgggcgccaacacgtcggttcctgggtggttttttttgtgggtgtgttgttaataaatgtgtgcgttcctccacaaaaagagaagatgtggttgggtgctccaacctcccgtcagcgactagtgctcttgtgttggggggagcgctactattctaaaattctccttctgggccgccaacaacaggcggttctgctccgcaactattctgcgtgttcgtcttcccgcgggtgggccgcgccaacagaagagggtgtttaatctctgtggggtgtgatgacacaacatcagagtgtctcgcggcacaatagcgtcgcccacacacaacgtgtgtggtcgctcctcttgccacatcagtgttgacacacagaggccctctcttcccggtcgtctctcgtgtgtgtcttgtgtgatacactctctgtcattgtcccctcagcaaaacactcacaggggacacactgtgcacattgttgtgtctcgcacacactgtgtgtctcgtataaagagaacttgggctctacatgagatgtgcgtgtgtatatccgagatgaactgtgtaacacacacctcatagcaccgcgggcgtgcacactggccacaccctgggacaaactttcccaaaggccaccctcttgaagccacatgttttaaagaacctatcacggtatacctgagacccccgaaccttctggagaaggagagctgtaattcaccccaagtttccctattcaaggagttcacctgagccacacctcgtcaagacccacacccgagtttccctgcaacaggactcacggctcccactgtggcgtaccaaaatagggtttttaaacaagaaaaattaagtgaattaagcg

SEQ ID NO: 724980 - DNA, 934 bp, Homo sapiens
  misc_feature (344)..(344): n is a, c, g, or t
tcccaatatttcactaacaaaagggtactttaatcccctttagaataggacaacgcttacagttaaaaaattacgagctccagtaaaaatacagcaaggtggcctactatctattagtgaacccaacccaattattatccctattcccagagaggaggagggcgggaaagaagaaaaatataaagtacgaggttcagaaaatagtggtgtaactttttttatttttctcgtcgggcaagagccagataaccctattatctagagccatctttattttcgctaactatatatctgtttttctctacactgtgggtgtgtgtgaagggcaatatccccccctctgntttggatatcccgcccatatataaaccagatgtgtcttctattatagactattattcttgtgtgtggcatatactacagagaaaattccgagaaccacgcgcgaagggggggcgaggaacaaaacagatctgtttcctctaagaataatctcgcccgggatcttttcaccagtgcttacccgtgggtgcacccagagcggataccaatattctgtttttatgtagagacccccccaccttatattgaaatattttttccatcgtggcgacctctattcctcccagaggggaacacaacgacaaaagagagggggtatcattatatctgtatctccatcgtcgtggttctgtcgggggacaaaaagattagccccccgaagagggacataatttcaccaggcgcgaaatatttattgttgaacacactattcttggcggggtggccccccactattttctaacacacgacaaggattaatctattccaagagaaaacatattttctgccaaaataacatattcttctattcaccatcttaatctattcgtcttagaaacgagcgccgcccgccgtttaccacaccctaaaa

SEQ ID NO: 724981 - DNA, 840 bp, Homo sapiens
cagttgtccctccctgccgccggcttcccgcacaaaattttccccgccgcgattttttgcccccccttttccttccccgtggcgcccaaaaatagaaaaaagctgcctcctccacaacccacactccacactcaacgcaacgggttccttctatgataattcctcctatattcattcggtactcaactaaattagtaacgcgcctgcacaccgttctgggttgaacacatcccccccaacaacccgtgctctctatttaagagccgcttgatattctacaactatctccctaccttatatagagagcaagaatatctatcaattgttctcacaaaaatgcaactctctttcccacacacatatgtcttgcacacctcttccactccgttgcttaaatacacacccactttactgtgtgtgtctatacatacttccctcctcaataagtggccgccgctccctctagtgtcgcgatacaaacacacttttacatacaattaacagcatttatattacgtaaacaacctatctctataaataaggaatttaacataaagcatgttctcgcgcggcttttctttagtaaatattgtgccgtacacgacaccctttattgtctcttaatacttatttctcttcttactaatgtctataatctccgcccccccgctctccattgaaccaccccattttgtgggaaaaccacccacacttgtagcagcactcttatttgttcaatcatctactatttttattatatttagtgggtttcttcatcctgactcaataagatttggtgttgtcatcttcccccaaaaaaacaacaacccatcaaaataa

SEQ ID NO: 724982 - DNA, 732 bp, Homo sapiens
agcggagtgtgcggctgcggggccggcggcgaaggtccggggtggaatcgacgtcgctgcggctgccgacgacccacacccggacggccgctctccgcagatccacccttggccgctgctgtgcagggggcgcgcagagccccctgaggtgagtcgagttcccctgcgcgatggacagcttcggccggctttctcccgttcgggaggtccggctcccggctctccgtgatcccgcctggcgtcctcgccttgcggcggcggcggacgacagcgggcgcccaggaatggcttcggcgggcagcatggcatgcaggaggtgcgcgtgtcggtgctgacccccttgaagctggtcgggctgctgtgcatcttcctggcgctgtgtctggacctgtgggccggtgctgagcccggcctggggtcacatgctgaccaccagtactacctgtcgttcgtgggagtcctgccggatacccgcatagcttaggacatcttggcactgcaaattccacggatacagcaagcgatttggcagattgctactcttggcttttactccttgcgcgagcagctgccaatcattctcattgcattcactgagtccgtttagacatactaatcttgctcttggagatcttcgaaggaccctttcttatagaccctgttcgcggatcctgcattattgcagacaacatagtttttacaaggtttgacagccttgctccatttacccaa

SEQ ID NO: 724983 - DNA, 107 bp, Homo sapiens
  misc_feature (30)..(30): n is a, c, g, or t
ccacgggtccgcccaggagtccggggaagngtgcgccaaaagatcctcacttttcaatttgtcatgttactaaatggtgttacattaaagccctgtgttaagtgtca

SEQ ID NO: 724984 - DNA, 162 bp, Homo sapiens
  misc_feature (156)..(156): n is a, c, g, or t
ttttgaaataagcagggaagttgggtaagaaaataacatttgggccaggtgcagtggctcacacttgtaatctcagcattttgggaggccaagatgggaggttcagttgagctcaggagtttgagaccagcctgggcaacatggcaagaccttgtntctact

SEQ ID NO: 724985 - DNA, 291 bp, Homo sapiens
ggcattcagtttagttcatactaaaatataatacgctctacatagctcaaataatattcagcagtttacacggtaaacagcttgtttacctgtctcaagagaacactgcagtaatgtacctctgttagagagcaccttctcttctgtgcttatctcttcaagataaatacatggaaggatgtgaaaatcggaacaccaactatgtgtctcactgcatctaagtgaagcagccacagctgtgagagttttcaaagcagaaagatgctgatgtgacctctggaattcagacat

SEQ ID NO: 724986 - DNA, 2068 bp, Homo sapiens
ggcggtattccttccgtttcttagtcgcgcctatcggtctgtgatgccgcgcgatcgctcgaccagatgtggagtagatcgagggaccgtggcgtcttgactcgcgtgtcctgcaagctggtcgcaatgtgtgacggtctggcttggagatcaccacttcgttggctgcagcggtccacctgatcctgtactcagtgtcagcagagggcacaagtacgagggtgcacaagttagctcgtcgcagacgggatcgcaggtgcgcattagctcgtacgaacgtgtggtcgctcgcatcgtgggcgctgcgacgcctgtgggactgcctagtgtgtaagacagacctcgtggactgtctgagaggcctgtgtgatagagagtgaattgaacctacatagacaactgttgacaaggtagcgacctgatatgcacccccgcaggggttggcccagccatcggacttccaacacacctgcgcgcaccaccccttgaggacccactatgatcaaggacagcgttccgacttcactttgaggtgaccttatgagggtagtgtgacgatctctttatctaagaacggtagacgtgttcccttgggggacctgccataggttccagccaccttgcaaggcccgtacggctagctagctcgggttgagggaccaacagccacgtggggcaaaggtggcttgcctattcgggttagccacgagaagcccgttcaacaactctcggatcggcacatacggccgggaatgtcgcacccagggaggaccttatatagagtcacagcccacgcttccatcttagaagcccccggtactggacttcgacatagagttatcgaacctatcgagaggaatcccttttaggcccaacgttgttgacccgcgcatcccccgagtccaacgttactttcctttgagggcgtgaaccttccctttcgaaaatagcctattcttcagaacactaaccgaaatatccttaggggaaacacagccgccgtagtggacataccgactcatgtcaccgaccaaggaatttcggggcaacccccaccgcgtgttcgacgtccattgcccgaacagcacaccatatcctccttgggacattcttccaaacaccaaaacagaggcaaacgcactgataacccaacctccctctcggagcacatctatccctcaccaaacacacattatgacacgagtcacgccaacacttgcacattgcgtaggccccgttggttcttgttggcaccgcgacgaggataatgtgaccacgaaacaccactataccatcctctgcaacagaacaaagagacagtcgaacactcgcacagcggcgcgcgcatgacaacggggatatgaataacaccgatcgcgaaccacgaaccaacgcgcgcctaacaggacactaccaactagacccgctcgatagcaagcacatctgccaagagcaccgacaaccaaccgcgagtaagcgacaacagggctacacagattacagcggagcacttcaccggacagcaacgaacgcatcacatagtgaccacaccacacgcgacagcaagcgctgtacaagacacaaacactcacaccagcacagatgggagagtccgacgacagcaaaacacactacattcacaaatcaatgtgggcaacatgtcaccgcaagttcaactctcccggcccactcacccctgccggcctcgcaccacccagccgagccacacccagcgcaacacactaaacttagctatacaacttaatcatatgcaaatactaaaatatcatatcaaaacccgggtaagaacaccagacacagcactacagataaccactacacgagaacctcacctcctcacaccacacttcagcacacacccactacaaactaaccacaaccatacctgatcacaatcctacatataattagctgtacatccaactttatactatgcataacaccaacagaccttacaccaccactagtctaccaccccacttcacaccacgacatcaacagcaaaacacactcaatgcaatatactaacaaaactcatgtcattaat

SEQ ID NO: 724987 - DNA, 488 bp, Homo sapiens
acagctgaaggaatctgaggggaagactttagtgtcagataccaaatgaaggcctggaacttccagaggatgaagaagagaaaaagaagcacggaagagaacacaacacagtttgagaacctctgcaaactcatgaaagacatattggagaaacaagttgacacggtggttgtgtcaaaccgattggtgacatctccatgctgtattgtcacaagcacatatggctggacagcaaaacatggagagaatcatgaaagctcaagcccaaagagacaaacacaacaatgggttacaatggcagacaaagaaacacctggagataaaccctgaccataccattatagagaccttacggcaaaaggcagaggctgctaagaacgacaagtactgtgaaggatctggtcatcttgctttatgaaactgcgcttcctgtctaactggcttcagtctggaagatcaccagacacatgctaacaggatctacagga

SEQ ID NO: 724988 - DNA, 264 bp, Homo sapiens
tctctgtggcggccacgcatggtctgttcgcctttaggtcagaagttcaagatccagcctgtgtcacatggcatgacccccccctctactacaaatacaaaaagactagctgggcgtcatggcacatgcctgttttccccgtcttcttgcggaggctggggcaggatgcaggacaatcgcttgaacccgacaggcagaggttgcagtgagccgagatcgtgccactgcaactcttgactgggccatgagcgagactctgtctcc

SEQ ID NO: 724989 - DNA, 124 bp, Homo sapiens
gtaccagcggaacagcaaagaatgggacaataatatttgcaatgcacaaaaggttaatttccatgacactggcaggcatgggggctcatgcctgtagtcccagcatttggggaagcccaggtga

SEQ ID NO: 724990 - DNA, 299 bp, Homo sapiens
cccttcaacatctcatttctcgtccgggtgtctctgggtcctgctgcaggctgacttcatgtccaggcccctctctgttccagttctgtgggctgcccactgtgtctttgaccccaaagtgttttccaactttcttccatttccagatcttcatgtatttttttttttttggaaacgaattctcattcagtcgcccaggttggatttaaggggtgcactcttggtccatggcaagccccgctcctggggtccaccgcattctcctgcctcagcctcccgagtaactggacctagaggcg

SEQ ID NO: 724991 - DNA, 504 bp, Homo sapiens
ctttacacctactctgagaatcgtgtggaatttagacggcctgattcttaccagccgtgggcctgggaccagcttcgagttttgcgcttgctattgttaggaagccctgaatggcaaggaggtggcggctcaagtgaaggctccacttgtccttaatagactagagcagcgaactgcgactgatcacttagagaaccaggccgttaggaatccattctcactgtgtcgctctaaacaaaacagtggtaggttaagtgtgtccgaagtcggctgtccttactacttttgcggaacgtatggcaaagtcaccaactacccagaggatttctcaggcctacaaattgtgtctatacatttctaaagccttgtttgcagaattaaccagggcatttagccaaactaaaaactaaaaaccacacacacacgaatatcaaccccacacaactcacaaaaaagggggggccccgccaaaaaaacatcccccaagacgccccacctcattaa

SEQ ID NO: 724992 - DNA, 366 bp, Homo sapiens
  misc_feature (147)..(147): n is a, c, g, or t
actttcccgcccccctcccctgttcccacttcctcatctggcactatgcatgtctcactcaccctccacagcactcagtcccatcgacgttcactgaacattggctttctctttctgactcctgcctgttttagtccactatatatntgctgaattgcttaaatgctgaaagtaactgtaaaaatgtgaaatggtaattttaaaaagggctccattaaattttaagccatggcaattaacaaatttttggccctaagtgaatttttcaaggaaaaaccaattccttaactgaccaggaattggagggaaatggtagtaaccaagtaggtagcctcaattttacccattggtccaagggaaattgtg

SEQ ID NO: 724993 - DNA, 100 bp, Homo sapiens
aagatcacttgagagaggattatgatgcgactgtgagtgtattaaagggcagtaaccgaatgtttgactaagcgaatggtagaggtgatcttctgcacga

SEQ ID NO: 724994 - DNA, 327 bp, Homo sapiens
cctcagaagccatttctactaaaaacacaaaaattagccgggcatggtggcacacacctgtaatcccagctacttaggaggctgaggcaggagaatcgcttgaacccatgaggcagaggttgcagtgagcctagatcgtgccactgcactccagcttgacgacagagtgagactctgtctcaaaaaaaaaaaaaaaaattggcagtatagtttaatggtgtatggaatgggttaagaaatatttacatacgaaaatatggccctttacctggaaaaataccgggagaagacctggcctagggaagggggggtatcagaagaggggca

SEQ ID NO: 724995 - DNA, 690 bp, Homo sapiens
tttattccagggatgcaagggtgattcaacatacgcaaatcaatcattgcgacgcatcatataaacagatgaaaggacaaaatccatatgatcatttcaatggatgtcaaaatgatgttttcatcccttcatgataaaaatcctaaaaaaactgaggatagaaggatcttacctcaacatgatacaaaccatatatgactgaccccagctagtatcatactgaatgaggaaaaactgaaagcctttcctctgggacctggtacactacagggatgcccactatcaccactgttattcgacatagtactgaaagacttagatagagcaatcagacaagagagagaaataaagggcatccaaattggaagggaagaagtcagattatccttgtttgcagatgatattatcttttatttggaaaaacctgaagactcttagccaggcatagtgacatgtgcctgtagtcccagctacatgagagcctgagacagaaggatcatatgagcccaagaggtctaggctacagtgagctgagatcctgtcactgcattccatcctgggcaacagaatgagaccttatctcacaaaatataacccataggttcaaaaacgtccaaactccgaataacattaaaaaactcgagggggggccccggttccccaattgtccctttttgggaaccgttttac

SEQ ID NO: 724996 - DNA, 522 bp, Homo sapiens
  misc_feature (68)..(68): n is a, c, g, or t
ctttttgcctgttgtgtgaaggatagcccaccccaggtcctcctgcagtggggcatccccttggcagntgccgtcagccaggccagccccagggagtttaaaacaaacattccacagggcctgggcccctgggaggtgaggtgtggtgtgcggtttcccccagggcagaacaaggcagaattgcaggaaacccgcttccccttcctgacaggtcctgccaagccaaatgggtttcctgcgggtcacgccccccaggtattgaagggacccaaggccccccctgaagccagggataaagggtccctttttgctccccagcaggtcctgcccccaaggcctgactgtataaactgtcaaagaaactttgtttggggcaaggttcccttttttttcccccccagactttggcctttgagggaaatgtttttttttgccctgggggggttttttccttgagggttttttttttttttaaagacaccccgcccttcccccatgactcaataaacccttgtttttcca

SEQ ID NO: 724997 - DNA, 789 bp, Homo sapiens
atgaaaaaccctcgcaccccattggggccccctcccctctgcccacgcataattagttagtgcaacactcagtgagttggaacacccacacctcttcctgtctaacatgaaacattcaatctctcggtgttttttcgccccccacataagtttggtgtcatgtcatgacacacttcgccacaaaaatctctctcttaaacactctctctcttcatacaagtgtatacatagaaagccctcctcccccgcacacacactttactcccctctctaataatcagtataagaagaggtcctgattgtgacacttctaaacccgcacaatcataccaaaatatatcactctcataaataagaccatgatccaccttcagtgtgagccacacataatgaatatatttgtgtcaacatcccccctctccgagagataaatagaaaaaattatgtgtgtcagcactactctctttttattttgttgagataataacctatgtctatctatgatgtctatctaaatagaaacatatatctctaatacatattttgcccaactcccatcttctacagaacaagtgtaaatattttagtaggagttctcccgcctctctctccccacacagagagccttcaaaacaccattattgtctccccccccctctaatagaatagtagcacaaccctcggcgggagaggaatcaaatatattatgaacataacagaccgcccctcctaagaatataagaatatagataacgactatttattccctaaccacgacatgtaaaagaa

SEQ ID NO: 724998 - DNA, 109 bp, Homo sapiens
ggtactctagaggatcttaggcacggagagaactgggcacggagatgttactgtgtgcagcggtaggcaaggagagaactgaggcatcggaggaactgtggcagacgga

SEQ ID NO: 724999 - DNA, 1256 bp, Homo sapiens
  misc_feature (188)..(188): n is a, c, g, or t
  misc_feature (234)..(234): n is a, c, g, or t
gcgggatgcggtgcgcacgagctgtgaacctccttggctcgtgggtcgaagctgtgtggaccaagcaatgtcaggagtgtggccaatgtattcatggaggcatggctgacgcgcaggaggggctcgcacaagctgcatagcatgtctcgcacagccgagtactagaccgaaggaatgcgcgactcgtnttgactcgcgggatgccagttggacaaactacagcaactcgctcancaagccgcttgccggcctagcgcatgcagacggcagtgcatgtgtagcgcccgtgacaggattgtgacgcacagcaatgtatattgggcgcctgcacggcactgcaatgcacatgaggtgacggaaccgcatttcctgagagaaagccggggtccccagcagcacttggcggcacggtgagacgctgcggcagctgaacgacagcgtgttgtgaaactgcaggcctgacggacgacagctgcctgtggtgggtgggccacgtcatgattcacacggcccatgcccgcttgcaagcccttccatgtcctaggcgggcaggtcacgcgacggacgcacaagccatgcttcccccaggcctcctcgcgagtacaagtacgatacagcccagattgagcgatgctggtctctggaacgcatgacactggcagcgtactcaaacctaaagaggcacccattgaccgtgtcaaacgctggttaccggggacatgtccctggctgtgttatggctccgtgagacgacgacgggaagtttctggtggacggactatcgcttttgctgacctttgctccccagaagccagacccccactttgaccccagatacggttgggctactggtgttccgccctgggctgggtggccgtgtccgcgtctagctgttggggacccagtggctgtggctttggtgaccggctcaaattgtggcgcaacagcggacaccatgaattgccgcacaaggtctccacgaggtataccggcttgcaacccctcaactgccaaggagccccagaaagaaggggatctcctacaaacccgctgctctcgctgtcaaaaatctgccaaggggcaaccgcaggagtgcgtacaaaaactcgacagaagaaacccagtcagcaagccacaaatgccttccgaatactaacaggcatattcccaaaatactctctaaagaccacactactttagtcagacacagcacacaccattgtcaccaaccacgtgtatacgtataactaatagtg

SEQ ID NO: 725000 - DNA, 5678 bp, Homo sapiens
  misc_feature (29)..(29): n is a, c, g, or t
  misc_feature (60)..(60): n is a, c, g, or t
  misc_feature (127)..(127): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacacctcctcgccgcctcctgcccccatctacactcccccacctcctgcgccccactgccctcccccgccccccagcgcccctacccctcccatcccgtccccaccttccacccttccccctcctccccaggctccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaa

SEQ ID NO: 725001 - DNA, 2287 bp, Homo sapiens
  misc_feature (29)..(29): n is a, c, g, or t
  misc_feature (60)..(60): n is a, c, g, or t
  misc_feature (127)..(127): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgtagcctccacaaaattgcatcaggccccacaacagctgcttgcatggaatagcagagaataccgcctgctccctccggacagcacactcctgaaaacggggagagaggagccaaacatgctcggtttacactttccttatttactgaatgagtggagggcagagacaggcctggagttacgcacactgagtgccccaacatggaaagaaacatcaggagggacaggaaacgttccctccttaaccaacagttttcaagaccttactggaggcactttattggctacataatcactccatgcggtgggcatcaggcagaatcctggtgcagacccaactttgaggtggaggatttcacagtttctttattttgaacttcccccaggctcccactaattcctctccattctatcctcctccctttcccacaaaagaaaacagaaaggagcagcagtgtttgataccgtatcatccagaggcctggttctctcccattatagggcaaacaagccctggcaagatatttcactcccgccccatgccatgcattaaaaatccaaaattgcctatattccacctgccaagcaagagatgctttcattattgaagttccaaatgtatacctttgagaacagtgccttctcgtcttaaaagagaggtcctcattttgtgagttgggagcagagggaattaaagaaagccatgatgcagggatttggccattcaagccgggcagccttcagagaatgtcatccctaatgacacatgcccgaatgaaggagcggggctgagcttgtcctgccttcgtattgaatgttgcctgtctgcctccttaatagcgggcctctgtgtgagcatttgacaagacttaaaactattcattgaagaaaatggatgatcccccaacaggaagatgcaaccccatgggctgcctgcttgaccacagaagtgcttccagctccagttgctcatctgagaactccccccaccacttgctgttaaaattgttaaaattaaaggccatgttgattgatttttta

SEQ ID NO: 725002 - DNA, 1592 bp, Homo sapiens
  misc_feature (29)..(29): n is a, c, g, or t
  misc_feature (60)..(60): n is a, c, g, or t
  misc_feature (127)..(127): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcagtaagtccttgcagagtccatgggtttcttcgacaagtggcttcaaggaagggaattcccacccttgtcttccagcaaggccacacacatgaaaccagcagaaaagagtcttatttgctggaaagacccccagcaagggcatagtgagcccttacagtggttccagtcagaaaaggcaccacttgggtgggcacagccccatgggtgtccaacttggtaagcagagcaaggctggacttgagtccccgtcctccacaaaacacagagccacaagccccagccctgcagcagccctccggaagcagcggggcactggtttccttgtcccctgccatctaccgagtggctcactctcaggtgggagtgctggtgatggttaattaggactgcagaaacatgagcctccttaacaaagtattgggactcttaagggtaagtgtgaaaaaggaatggtctaaatgcattaatcttgaataaaccgaaaaccaaacc

SEQ ID NO: 725003 - DNA, 460 bp, Homo sapiens
  misc_feature (26)..(26): n is a, c, g, or t
  misc_feature (57)..(57): n is a, c, g, or t
ggtcgcttgtgtatgaacgcagtggnggacctgtgaggggatccgacttgccggcanaacttacgctgcgggaccccgggcactgttgctgctgcgggagactgtgggctgtttagtgccatgcaccctttacagatgtgttctccaagtgcaaaggtctctggggtgaggaccattggcctctgtgttcgttggctgtcgctgaggcatgtgcatgtggcagacatggatgtctctctagtatcactgtgtgccagtccagagagtgcagaaggatggagctcggaaggattacaggtccaggctggtgtgtgtggacccgaacgttgttctcatataattgttgtataacaaagtgcctcagctcctcaggagaagcctgatcttcagaagtggaagacccagcctccctatctcacgatggatgaagcttcttggaaggctacgagaaagagtctac

SEQ ID NO: 725004 - DNA, 364 bp, Homo sapiens
  misc_feature (103)..(104): n is a, c, g, or t
  misc_feature (106)..(106): n is a, c, g, or t
  misc_feature (129)..(133): n is a, c, g, or t
aaggcccactaaaatgtttttaatttcttttaaaatcagaagaaaatacataaacttttaggttgaagaaaatgctaatatattcaccgtttatcaatgcagnnanaaatatatatttctgtgtgtgtnnnnnatatatatatatatttgttactactattttgaatgtaggaaatggttcctcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaa

SEQ ID NO: 725005 - DNA, 356 bp, Homo sapiens
  misc_feature (26)..(26): n is a, c, g, or t
  misc_feature (57)..(57): n is a, c, g, or t
ggtcgcttgtgtatgaacgcagtggnggacctgtgaggggatccgacttgccggcanaacttacgctgcgggaccccgggcactgttgctgctgcgggagctcctcaggtgatccacccacctcaggctcgcaagcgctgggattacaggataggagacagcgtggtccaagagtgatcctgcgcgaaagcacttaggcgagggcttgcagagtggaggtggaataaccctgaaggtgaagggaggtatagaagaacaaggagatggaagaagaatggtgaaaaacgcaaggttgatgacgagaaaaagtatcagactaataaagaaacgggagatggtgagagagacaacggacg

SEQ ID NO: 725006 - DNA, 389 bp, Homo sapiens
aaaaggctcaagatccccgggagccttaccctggggccagtttttcttttcttttctatttcttttcttttttgagatggagtctcttgctctgtcacccaggctggagtgcagtggcacgatcttggctcactacaaactccgcctcccaggttcaagccgttctcctggctcagcctcccgagtagctgggactacaggcgcctgccaccacgcccagctaatttttttgtatttttagtagagacggggttttgccatgttggccaggctagtctcaaactcctgaactcaagtgatccaaccgcctcggactcccaaaagtgctggggattacaggtgtgaagcactgctaggggcctggctattctgacctcgggcttaggaat

SEQ ID NO: 725007 - DNA, 5549 bp, Homo sapiens
  misc_feature (29)..(29): n is a, c, g, or t
  misc_feature (60)..(60): n is a, c, g, or t
  misc_feature (127)..(127): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacactccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaa

SEQ ID NO: 725008 - DNA, 737 bp, Homo sapiens
  misc_feature (134)..(134): n is a, c, g, or t
cagtggacatctttttccaacggtcaccatatatatcatcaggcagcacatggtcctttcaggaaatgagcgtgggttcgaaggtagtcaccaaacgctttctgtctggatacaaagagcatagacgcctgagnaaagggtatgtagaccgtttacgtgtgagctcagctactcgttcatatcgatcatcgcatgatgtggcatcatctctgaaagtcctctgtgccaatacaggactagtgtttccagctgttggctagataatcattcagtgtgcttaggtacggtatggatggtaatgtctgatgatggcagctgagtcagtaatgtcatggcagcatttcgcagctcagggcacttgaatcaatcagcgccagtagtgctagaacagagtgtacaacatggtctgatcgtgttcgtattatcaatagtcgtatagcgtgcgcgtacagctagtagcctgtcatcaaaggtacatgctaggcttgtccagtacagattcttgatggcagccagtactgtgatacagtcagataagctttatcctaccgcctcggagcatggacatcggagagtagaactccgtctcatatcaaactggctcatagactgtatccagctatatcagtgtgtgttgtcattgattcaatgcaagctttcaagcaagtattcatactgtgtaatactacagtttgccatcgtgagcgctatagtctgccaacacctctgtgcctgag

SEQ ID NO: 725009 - DNA, 217 bp, Homo sapiens
tagacatcgtgttccccaatggtcgtgccgtagctatgggggcccgctatcggcagcagctgtaggtgtaccccatctactccaaactatcggccggggccccgggtgatgtccatatggcggcacttgatctatataccaccaatgtgtcatttatggggcgcccatatcgtctggtacgtagacaacacggatccacgtactgccctgcgagtgc

SEQ ID NO: 725010 - DNA, 5550 bp, Homo sapiens
  misc_feature (29)..(29): n is a, c, g, or t
  misc_feature (60)..(60): n is a, c, g, or t
  misc_feature (127)..(127): n is a, c, g, or t
  misc_feature (2848)..(2848): n is a, c, g, or t
  misc_feature (2850)..(2850): n is a, c, g, or t
  misc_feature (2853)..(2853): n is a, c, g, or t
  misc_feature (2862)..(2862): n is a, c, g, or t
  misc_feature (2865)..(2865): n is a, c, g, or t
  misc_feature (2870)..(2871): n is a, c, g, or t
  misc_feature (2875)..(2875): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacactccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttgntnggnaggtaggtntanggtannttgncttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaa

SEQ ID NO: 725011 - DNA, 170 bp, Homo sapiens
cccatgtgttttaacgttccggtaatactttactttaggcaccccccctgttgcaagcacccttttgccctatttccaatccagtgttttcagtagaaaatgttcttttgttacatgaaaaaaatgttaagggtgcattgtaaaattaaaaaccccaccttgcggaccca

SEQ ID NO: 725012 - DNA, 4868 bp, Homo sapiens
ctggtgagcttgttattactgatggcttttcagggcagcccctgagcccagtgaaggcctcatattcccctgggttctgaatataactagagccccttagccccaacggctttcctaaattttccacatccaagcctaacagtctccccatgtgtttgtgtatttgctgtgttctcagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacactccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaa

SEQ ID NO: 725013 - DNA, 171 bp, Homo sapiens
agtgacatcgactcgtggtactggaggatctctagagtcgacaggctccatgtaaacgtgatactggagggccgtatgatagctcacgttgtcgagcggaacttgtacagtgtaggcatgcacctggcgtggtgaatacacgtcgaactggctgcatgtttgcgttattgg

SEQ ID NO: 725014 - DNA, 4310 bp, Homo sapiens
ccagttttcattgctggcagaagccatatcacaggaacatcaagaacttaaagccagaaccacaaatatcggatatttgtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacactccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaa

SEQ ID NO: 725015 - DNA, 5808 bp, Homo sapiens
  misc_feature (29)..(29): n is a, c, g, or t
  misc_feature (60)..(60): n is a, c, g, or t
  misc_feature (127)..(127): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacactccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaaaaaaaaaattgctgggacagcgaaatggaggggtgtgtgtctaacctaatggtctgaacctggctaacgcgggaagcggacagtgacgggaaaaccgggggaaaacccggcgacaaaaggacgagcaaacgttgccggggcgcctcgacacaaaagagaaaatatgacatacaatggacaacacacaaaggagaggcgccacagagaggggcggaaaaagccacgaggagagggcacacctagagacaccgaggaccgc

SEQ ID NO: 725016 - DNA, 5711 bp, Homo sapiens
  misc_feature (29)..(29): n is a, c, g, or t
  misc_feature (60)..(60): n is a, c, g, or t
  misc_feature (127)..(127): n is a, c, g, or t
gctcggcgcgagctcgggagctgcccggnggccccggaccgaggcagccctcccctttanaagaagcggaggacaggattgggatccttgaaacccgaaacccagaaacagcatcggagcggaaacnagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacactccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaactcttttttctggttgtctgtttgttataaagtgcaacgtattcaagtcctcaatatcctgatcataataccatgctataggagactgggcaaaacctgtacaatgacaaccctggaagttgcttttttaaaaaaaataataaatttcttaaatcaactctt

SEQ ID NO: 725017 - DNA, 663 bp, Homo sapiens
gcttcgcaataaatcttgctgctgctcactctttgggtttacactacctttatgagctgtaacactcaccgcgaaggtctgcagcttcactccaagccagcgagaccaggaacgcaccaggaggaacaaacaatccagacatgccacctttaagagctgtaacactcactgcaaaggtctgtggcttcactcctaaagtcagtgagaccacgaacccaacgaaagaaactccggacacatctgaatatctgaaggaacaaactccagaacaccatctttaagaactgtgacgactcaccgcaagggtctgcagcttcattcttgaagtcagcgagagcaaagaacccaccagaaggaaccaattctggacacattatggtggaccacgaaggcactatgtagtcgtagttcactaagcgaatcaaggacatcatattgacagatggtcttacaaacggaaacccagaggagctcaactaacaacttctaccgaggacccctggaacgaaccactggcctttcactggcctagagagttcccctctggaggacactacaactgcagggcccttctttagccctgtacagcaggaagtagctagagcagtcattgccaattcccaaaagcagatggggtgcctgtttagaggcgggatgagaggg

SEQ ID NO: 725018 - DNA, 1505 bp, Homo sapiens
ctgggcacgctgtccttgctgttctgtgccagctgtgccagacagttcctgcagctgcttacctgcctgtgcctctcgtgttcctgctgtgctgcacctgtgagtggacacgcactgtctgctgtgctgtgctgtgcacacagctgaccgacgaactgaccgtgtgtggacagccctcgacaaacatgtgacgacactgaccctctgattgcaagactgcaaaccttgaagactcacttttgtgaatacttattacactacttgtacacactgtacggtgaccgacacacacgaccgttgcgcttgacttccattattgtgacggatgcacagccctacgaaatgtggacttgagcatttgggttgtcagtatgggacaatcgccttgacttcctttctcttaaacctaagcagagactgacaaacgaattacttatagatggtgcttatcctttatatggttcaccatggttgtggccagctgagccctcaatattaaccgcgttggaagcacacggccttggaccaaattgtatatcacacgagagccaatttatcgatatttggggagcttacactttggaagtgggccacgagtagaccatatccaacacaatttatatgagagtagggacgggacacctcttatggtcacggacaaagggaccaactattgtaacttatacggctaccaaacagcatttacaaccacgcaaactcacttattgtacacagggcgacgaatccatagttctacttacactttggacacagtagccccgttgcttactttatattggcagatccccggatagatatatatttacttcccttggagataccattatggcttagagcgacttctgtgctacacttgttttgaacatcttgccccatgaggcaccccaatatacaaaactttggtgttttggcattacgtaggttagatatggacacaacaatcttaattgggtacacaacgctgagtcaaccaatccaaggatggaagctgaaaaaggaatttgggttaccccattccaaagggttaggctcgtacacacaagacagtatggggagcagattggttacgtagctatgcatcataaataatatttggtacagagatccagttttattggtacccgattggtggcagtgtttgggtcactacatcggtgcaagcattgtgatctcccgagaaccacgagtacaataggtaacaattgttaccagggtgaaagtggtgagactcacggagccaatatctgttgatgtcgccaaaacacgacctggcactagcgactcataatctatttaaactaccgggacgacgacacaagacacgaacaacacatgtgttatacccccagtggtatccaccgtggatactggcacagcagggagtgactatcgaatagcaagcagatatacaccacaaggacagctaccggacattgatacgtcatatagccactgtgttggtaccacgacctactcgaggaacc

SEQ ID NO: 725019 - DNA, 190 bp, Homo sapiens
tgaacgcacgcctgctgagtagctgggactataggaacccaccaccatgcccggtgagtgttttttttgactatgtttttttgtttatgtatttttagtagagacagggtttttcaccgtgttagccaggatggcctcaatctcctgacctcgcgatccgcccgcctcggcctcccaaagtgctgggatt

SEQ ID NO: 725020 - DNA, 611 bp, Homo sapiens
  misc_feature (62)..(62): n is a, c, g, or t
  misc_feature (79)..(79): n is a, c, g, or t
ctcagggtgaaacgaggtttctgaaagtcatccgaacaggaaagagacagaaaaaggcctgnaagagaatggtgaccanagtctgtttcgtaggagacggtttcacccgcaaaccgcccaaatatgagcgcttcatcagacctatgggtatgcggtttaacaaggcacacgtcactcaccctgaactgaaggccacattctgtttgcccatcctgggtgtgaagaagaacccgtcctcctcgctgtacacaacactcggggtcatcacgaagggaacggtcatcgaggtcaacgtcagcgagctcggattggtcacacagggcggaaaggtcatctggggtaaatacgcccaggtgacgaataacccaagaaaatgatggctgtattaatgccgtgttgctggtttaacggagaccctgaaaggtttattattgaactgtgcccccgagtacagctggaaagtgcttttctctggaaaacccccatcatcatcgtcattatccagggaatattgaaattgcaaaagaagatttgaagacctctgatggagttttgtttcacctttgcattcggattcacgtggatcagaaataaagtgctgtttattttca

SEQ ID NO: 725021 - DNA, 186 bp, Homo sapiens
gctctccgtgccttaagggaaaagcgggacagctccccccaccctgctgggggccagttttccccaaccccagggcagaaagacgctggagccaggcccggctttcaaagcgtgttttgccttagacccccgtgagggctctcggaaaaagtgtgtgtattccttttttaataaagtgtgggctga

SEQ ID NO: 725022 - DNA, 211 bp, Homo sapiens
taatgcgtgtacaaggggagactgagagtagtagatggcttaggtttggcttgggtgtcagaggtagagataaagaggtgtcatgacatgatggacttacgagggccaggagaaccaggaccaggaaaaacgaagcctctaaagtgggctagggttccttcaggggctggtgccagaagaaaaccgagtgtagaaagactggggagtaggc

SEQ ID NO: 725023 - DNA, 171 bp, Homo sapiens
tagagctctagccgggtaactctgtctattcccactgtctctactaacaatacaaaaaattagccgggcgtggtggcgggccctgtagtaccagctactcgggaggctagaggcatgagacacggcgtgaacccagagcagccagacgcttgcagtgacgctgacactggc

SEQ ID NO: 725024 - DNA, 376 bp, Homo sapiens
ctaatgtgagtagaggggtgcgcgggacacaggccgtcgtgctagaggtgatgataggccattctccgtaatgtgattattacatattgaatacctgtatcaacatattacatgtaccccataaatatatacacctatcatataccctcaaaaattaattttttttttttggagagggagtctggcggtcacccaggcgggattgcaggggtgcgatcgcaactcacggtaacctcggcctcccaagttcaagagattctccggcctcagccttctgagtagctgagattacgggcacgtgccaccacacccagctaattttggtatttttagtagactgggggttccattggctatggaaacttctaaaactagg

SEQ ID NO: 725025 - DNA, 212 bp, Homo sapiens
catagaattacgtgctctgttagtgtgttcaggaagagctaacagaaaggagcgtcgtgagtgggtagtgtcctggggggaaggggttgttcagaagttttgtgcgtgaaatgggtgggaggtacttgaagttggaagcatttcgtgggatctggagatctggattttctttccagatttgttactgattcgctcggtggcatcgataaaca

SEQ ID NO: 725026 - DNA, 860 bp, Homo sapiens
gccaagctactttcgtgtcccaacggtgccatcatcgctgggttgggaataagaaggatctctcggaatgatgagcacacgaaaggcgggaggctagccaagatgaagcaggagccggtgaatacctgaaagataggcagagatatggcaaacaggattggggcttttgggtacatggagtgttcagcaaagaccgaaagtatggagtgagagaggttatagaaatggttacgagagctgctctgtaagttagacgtggtgaagaacaaatctgggtgccttgtcttgtgaaacctgactgcgaagcacaggccttatgcggttaattttgaagtgcgggtttataaatcttagtgtatgataaactgcgcgccgtcgtcattcatcatatagatttacctaagattacaaatcagaagtcatctgtgcctaccaagtatttagaagccaaagctatgattatgacacgatgtccaacccgtctggcccaccagggtcctttttgacactgctctaacagccctcctctgactcccacctgaacaccaggcgctaattcaaggaatttcttaaccttctttgcttctttctagaacgagcacacagttggtaactttggtgaatcaggctgtaactactttattactaaacatggtctgctattatctgtcagtgcaggtaacctggtgaagtcccacttcaggcttactccggaacagatttgtgggtagcttggggggagtttggaaatggtcaaccgaaagccagtcatgcacgttgaaagaacgcgcgggtcagtagacctattcggtaaggcctatgttcaaaaattttcccaaatgtttgagcctgcccaaatg

SEQ ID NO: 725027 - DNA, 192 bp, Homo sapiens
tagggagaccctgtctcttaaaaaataaataaataaataaatgtatgtctgtctaatttggatttttaactgttatttgacccatttttttagggaccatgcagagtgccctgtgtctcaatgcacgtgtaatgtatgcagtcggatacaccaggtgatctggtacccgcagtagactgtccagccataaaa

SEQ ID NO: 725028 - DNA, 400 bp, Homo sapiens
gcgctgatgttttttgctaaagtgatgtttttgcatatgaaaagaaccaaatgtactatgtgagactgactgccatttgtgcgctgagcgtagccaggcgtttataatccggcgtttgcttcgcagagatgtgaccccatgctcaaggccctgtgccaaagcttgtgtcttgccctgtcactgacggcaagtgcgcagccggcttcggtggtgttcctcaaccctgggctgtccaccgagacgttctggaccagctatacccgcttcatgcaggccgccgcggatgagctgtgcatgaccctgcgggtggagtacagcgagcgccgcgccgacctggcgctgagccatgcccgtgcgattctgggtgagacgcagacgccagactacctagtgctgccat

SEQ ID NO: 725029 - DNA, 421 bp, Homo sapiens
aactgctggactcagcgtgagccactgcatccggcccttatgccccttgttaatacggggtttccgaacacgtgcagagcaactgtaactggtgccctgacagctcaccttccatagaagcagaggttccgctcctcctggcgtcccacagaggtcccctgatacccgcacatcttttggagcttgcggggatgaggacacgcggaccccatcagtgccacatgattcgaccgactcctggcggtggcaggggcgtgcattgagggcaagcccagatatcctcaccaaaatgcggtttctcggaaagaccacatggggctccactcgccccacaaatcctcttctttctccatcctgcaccggccatacactttgtatcccgtggctcgctccagatctcgcatctctaccggtgtcatga

SEQ ID NO: 725030 - DNA, 189 bp, Homo sapiens
gtcgtggaaatgtggaggtggtagagcagtaggtgcgggtggtgtcccgggcacgatgaggcagaatgatggctgtacgggagcggggctcacaagctgcagggcggtaccggcccgaattcccttagcaccagcacgaattcccttagcaccagcacgaattcccttagcaccagcacgaattccctt

SEQ ID NO: 725031 - DNA, 146 bp, Homo sapiens
gagctctttacatatctgagtgacttacatctgcactttgtgctcttttagcttcttctaacaacatctcagctctggcgaatgtcagcagcactatgctggaagaataacctctacttgagaaaggctttcaactcgtatcacgt

SEQ ID NO: 725032 - DNA, 150 bp, Homo sapiens
gttatcttctcatggaatctgcacatctgatctctgcatagcctgcacactccttgagggcaggaactgcgtcatgcaaatctaaccacacgtagatgctggaaggctctttccagtagttagctgggggctgaacgagaatgcattgga

SEQ ID NO: 725033 - DNA, 232 bp, Homo sapiens
gcgcgactggttccaacgatattctcgaactggtcgcccgtgcctacctggcgccggggttgaacgcggtgttcagtgaacatgcctttgcgatctaccccatcgtgacccaggcggtgaatgccgaggcccgtgtggctccggccaaggacttcgggcatgacctggcggcgatgctcgcggccatcgacgaaaacacccgtgtggtgtttgtcgccaacccgaacaaccc

SEQ ID NO: 725034 - DNA, 510 bp, Homo sapiens
gagcaaggttgaaagaggggctgcttctcagtccccgcctcatagggggtgcctcaccccctgcgatgggtgtcttaatagccagcggggggagaggggctggctgtcagtcccggcctcctggggtgtgtctccccctcctgcgatgggggtcctaatagcccgggggggagaggcgctggctctcagtccccgcctcgtggggggtgcttcccccccgccatgggtgacctaagagctagtgggggaagagggcctggctccggtagattgcaaatgacctgctttctttctgatcccgagctgtgttcggacccctgtcggatagtaaatctaaagtaacgtcggcagatctgagctttcttcttgggcacctaataccccagtcctccaggtgggtcctaaggatcttaggatccgcgatgggggtcctaagccagcgggggaagaggggctggctctcagtccccgcctcgcggggggtgcctcccccccttgcgatgggggtcg

SEQ ID NO: 725035 - DNA, 80 bp, Homo sapiens
catggatttgctggtgcagtacaactaggcttaatagggaattacctcagctatgacaagatgaaaaggcagaaacgaaa

SEQ ID NO: 725036 - DNA, 960 bp, Homo sapiens
taggctcgctgtgtcgtcagattatgcgctgctgccggggtattgccgggtgtctgccgtggttccgcgccgtttgcgtcgtgtggtgctcagtgtgattgccgcccgcgacccattggtgtgccctggcatcgcagctgccgatggtcggggcacagtagcggggcgcctcgtgcggggatgtggacggttcccgcgcttagaattggggtgagaaactgtgtccgctcgtcctgagtgtgtgggttctacgggtgcgttcgctgctgccacgccacggcgtttcttctttcgtgaaatgtctctcggcccccccctgtagtgtatactgaggggggtctgccgccgacgaccgccaggggtgtgtggcctcgccgttttgtgggtttgtcacggcttaattatcgtgtccggtttgtggccaccacggctcgcctgtgtagtagaagtctgttgtacaacgtagtctgaattgttgtgtaggtgttctgccccgcatgcctgaatgtcccagctggggggcctttccgtctcttccacgtgtcctggcgtgctggcggtgccctcgcttgttgtagagtgcatcacacgagggagtcggccgaccatcgtggtctgcttctcgttgtcaattcctccacctcattctgtggggcgccgttcggttgcggtcagacttcaaccgtgcgccccgcttgtgttctcagtgtcgcatttctgccgccaccagcggtgtacaaccgccgctcttcttgtgttctatcagtaccccacagttatttctcgggtgtcgtgggccaccccctagtaatttcgtacgccatcctcgcggacggtccgctcggcgcggaggacatcccttgttgcatcccccgcgggggcggtgcgtgccccggcgcgcctctggcgtccccccccccccccctggggccccgacccacaccccccttccacaaaaca

SEQ ID NO: 725037 - DNA, 815 bp, Homo sapiens
agataatagcagcctagttctttaggatttgacgattcaaatttttttttggtttggtttggttttttttggagacagagtctggctctgtggcccaggctggcgtgcagtggtgtgatctcggctcactttcagcctccgcacctcaaggcagttcaagcaattctcttgcctcagcctcccgagtagctaggactacaggcgtgtgccacctctcccggctaatttttggtattacagtagagacgggttcaccgtgttagccaggatgatctcgatctcttgacctcgtgattcacccccttcggcctcccaaagtgcttggaattactgggtgagccacaatggccagctcaattatgtttagaacatatcatgtgtcctcctcctctgaagatttgacaagtattgggccaagtactacagtagtctgctcagtactgtgtttccactttcacatgggttcttatagcattaattacgaagcactgcttatggttgatcccaaacagatgtcagcttgaccgtgggtgttaaacttacacaaccttaactttgcgtggaccttttccataatgtggcctggtcatggaatatcagggttcaagaaactgtgttgcctgatcaatgtttttcatagaattctataattacattggtggtgccctggccccaactggttttaatgtggcaaagtggaacaatgttccacaggctccggtgtgactgcgaaacctttatgacaacttggaaatgttgaccggaaaaagggacacgatacttaatggccccgtggaaacttaaaacataataaa

SEQ ID NO: 725038 - DNA, 109 bp, Homo sapiens
ttggctgcgttacacatgcggcttacgggctgtccccgcataatctacccaccagccatctgtgcatgccagcgtgtgatcccagccgcccctgtccctgtcgctgtcc

SEQ ID NO: 725039 - DNA, 1049 bp, Homo sapiens
ggaggccaagatggcggtgctgtcagctcctggcctgcgcggctattccggatccttggtctgcgctccagcgtgggcctggctgtgcaggcacgaggtgtccatcagagctgtggccaccgatggcccaagcagcacccagcctgccctgccaaaggccagagcccgtgggtcccaaaacccagcaagccggggcgagtatagtggtggccaaggctgaatgacctccgtaaacttggggcccggcggaagatactctgtgggcccattgacctatcggccatggaccttgttgcgccggtgagcattgatggcacaattggaaaggcaccacgctacggacattgtgaccccgccatatgggaggtggacgactaccccggaagcacagacaccgtgcgcacaagatcacggacgggtccatggactcggatgggacacgggaacacacatcaaccaaagcagaagaatggcgcccacaaaagatgcataccagacaacgagggcatcatagcagacccaagaagtgacccggaagcccgcgcgacacacgagtaggaacccacacagtgggcaagcctgcagcccaaacagagaagaggcggggcaaaaaaaccaaataatcactaaacacggggtggcacgacgcggcgctcggcgacacaggaatatgagtggccactgggaacatcaacgatccccaaggtgatgggccaaccataacgggcagagggcacttgagacaacagggcactcgtgcagcgtgcaaaggacgaaccaggcgggcacggagaggactgaagaccagggaccaggaaggaggcgcagcgaggcaccgaccggacctgttcgagcaggtcccaagcaggacatgagtccggtgagggtgaaataccagcggccgggtagagcaaaaagacagcaaacagagtggcagcggcgacaagagagaacaaggtagcgcgagggaagagacagctgcgagaggaggggtaaccacaggggcgtagcgtcccgccacacagagacaagagaacaacgaggaaagg

SEQ ID NO: 725040 - DNA, 945 bp, Homo sapiens
  misc_feature (196)..(196): n is a, c, g, or t
  misc_feature (450)..(450): n is a, c, g, or t
  misc_feature (462)..(462): n is a, c, g, or t
  misc_feature (475)..(475): n is a, c, g, or t
  misc_feature (531)..(531): n is a, c, g, or t
  misc_feature (537)..(537): n is a, c, g, or t
  misc_feature (542)..(542): n is a, c, g, or t
  misc_feature (550)..(551): n is a, c, g, or t
  misc_feature (558)..(558): n is a, c, g, or t
  misc_feature (600)..(600): n is a, c, g, or t
  misc_feature (602)..(602): n is a, c, g, or t
  misc_feature (648)..(648): n is a, c, g, or t
  misc_feature (658)..(658): n is a, c, g, or t
  misc_feature (680)..(680): n is a, c, g, or t
  misc_feature (709)..(710): n is a, c, g, or t
  misc_feature (751)..(751): n is a, c, g, or t
  misc_feature (760)..(760): n is a, c, g, or t
  misc_feature (841)..(842): n is a, c, g, or t
gagcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgatttngtgatggatgatacaataagtccctactcaagaatgaagaggcaccaaaaaggagagatggtgctggagtaaatatcattagtgccaaagggattcttctccaaaactttagatgataaaaattagccgggcgtggcggcacatgcctgtaatcccagctacatgggaggctgacgtgggagaattgcttgaacccaggaggcggaggcagaggctgcagtgacccaagattgtgccactgcacttcaccctgngcaacagagcangaccccatctcanaaataaataaatatatataaaaaataaaaagctatttctacgttatgtcactatanacgtcntgctntaattacnnaagctantaacagctatgaatcacagtgtattagtacttcgtacattgntngaatttactatcgttatactatataatatggtaacttgggtaccgngggaccttanaatttcatctgcaaaatacttntaagaagcttgaggtatgatatagcatannagaatgagatgaaatatacttccttgtagctgaatactcantaaaaactntacttctatatggaacccgattagacactgctgaatctgtcaagctactgataataagtactactgaattcaccatcaaannaaaaaacaaaaaattaaacgtcgactggaaacttggtaccacttatcctgacaaatcccttcagtgctgatacaaaggcgacgaggctttaacatggcacgag

SEQ ID NO: 725041 - DNA, 374 bp, Homo sapiens
aactcctgccttcaggcattcctcccatgttggcctctgaaagtgctgggattacagatggagttttgctgtgttgcccaggctggagtgcagtggcacaatctcagctcagtgcaacctccacctcctgagttcaagcgattttcctgcctcagcttcctaagtagctgggactacaaatgagtacctgcacgcctgtctaatttttgtatttttagtagagacagggttccaccatgttgcccaggctggtctcaaactcctgggctcaagtgatatgcccatctcggcctcccaaagtgcttagattacaggcatgagccactacgcccagcaatccctttacctttaaaaaaataaataaataaaccttt

SEQ ID NO: 725042 - DNA, 783 bp, Homo sapiens
  misc_feature (196)..(196): n is a, c, g, or t
  misc_feature (446)..(446): n is a, c, g, or t
  misc_feature (585)..(585): n is a, c, g, or t
  misc_feature (703)..(703): n is a, c, g, or t
gagcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgatttngtgatggatgatacaataagtccctactcaagaatgaagaggcaccaaaaaggagagatggtgctggagtaaatatcattagtgccaaagggattcttctccaaaactttagatgataaaatggaattttgcattattaaacttgagaccagtgatgctcagaagctcccctggcacaatttcagagtaagagctcggtgataccaagaagtgagtctggcttttaaacagtcagcctgactctgtactngcgtcagtttcacttcacagggaaaactttggtgaactctggtggtatctaatccgtcattgaggatgtttcactcatgtctgtcattttataagcatatcatttaaaaagcttctaaaaagctatttcgccgggcacngggttggggcttccaatggcccctaataaatcccccagcaacttattggggaaggcccaaggttgggtggatcacctgaggtcaggagttcgagaccagcctggccaacacggtgaanacccatctctactaaaaaatgcaaaaattagccgggcgtggcggcacatgcctgtaatccccaaggcttttaaaaccaaa

SEQ ID NO: 725043 - DNA, 140 bp, Homo sapiens
tgtgtggtggaattcgaagctgaaggaggctgagacccgagcagagtttgccgagaggtctgtggcaaagttggagaaaaccatcgatgacctagaagatgaagtctatgcccagaagatgaagtacaaggccattagcg

SEQ ID NO: 725044 - DNA, 785 bp, Homo sapiens
  misc_feature (773)..(773): n is a, c, g, or t
tggagcaagcttgaagggttcaagccccgcactacagtgtcaagatggggaaaacaagtaaggagtaaactaagatgcatcacttttggcagtagcttcctctcctgtcaagttccaggctcatttccataaccaacaagcctgatggctgcagccttttaatatatgttttcgcctttggctgtgactgggttgtgggcagctatgcagcttctagatttgtaaagaggcatcgtagggatattgctcaggcaccactatcaggaaggcctgccatgcatgtggccaactgatttcaactggagcaagaaagagatctcataggatcggatgggagcgaaataggttatccctcgcaagcttgaggttacgtgtgttaactgctgatcagctattcagacatctccatggtttctccatgaaactcgtgtggtttcatcatgtccttgcttagttgacctgcacagcgttggttagacactagatttaaccactaaggtaagatgcatggggtatagaacgctaagaattatcccccaaggactcttgcttccattaagcccttcgtggcttcagtttatgggtcgttcacttaaaagtgataagcctaactttgtcggcgagtcctcagggaggaacctgtcaccacaaagtgtgctatcagtgtgagagacagtatctgcacaaccccctcacttttgtggggattgagaacggggtgagtagaggcttgagactgtcctgttgtgtggtaggacttggaggagaatgcncctggctgttac

SEQ ID NO: 725045 - DNA, 634 bp, Homo sapiens
gtacacacgtgttcatatattttgtggggttttagttgttgtttttgaggcggagcctcgctctgtcacccaggctgcactgcaatggcccaacctctgcctcccgggttcaagtgattctcctgcctcagctactcgggaggctgaggcaggagaatgcctgaacctaggaggcggaggttgcagtgagctgagattgtaccactgcacgtccatccagcctggcaacagagaagactctgtcaccaaaaaaaaaaaaagaacaaaagagtacagccaatcagaaaactaccagggaaaagggacaacacggccgcgagacaagcccgacagaacactgtagaggaagcacaaaaggagcggcgatgcgaactaacacgtgaggggctccaggaggctcccagaaccgaagcccggaaccaaaaattggctgaaagacccccagaatcgatcgtgaatgcagcgaactaggcggaaaagaaaacgagtgggggcacaatgcttggcgacgggggtggcacgagataagaaccgcagggggaaaagacgcagaagagaacagagaaggcagcgtgacgacagatccgcgtgagaaacgccggggggagaaaagggggacaccggaaagggggag

SEQ ID NO: 725046 - DNA, 603 bp, Homo sapiens
tgcgcagcatatgattctcctacctcagcctcctgattagctgagattacaggcgcccaccaccacgcctggctaatttttgtatttttagtagagatggggtttcaccatgttgaccaggctgttctcaaactcctgacctcaggtgatctgcccgcctcggcctcccgaagtgctgggattacaggcgtgagccaccacgcccggcagggaccacacaatttattaaccaaccaggttaataaattcttttttttttgggagacggagtctcactcttgtcacccaggctgcagtgcggtgacacgatctcggctcactgaaatctccgcctcctgggctcaagcgattctcctgcctcagcctcttgagtagctaggataacaggctcttgcaaccacacccaacacttttttggtattttaagtagagacgggaatttcgccatgtgggccaggctgatcttgacctcttgatctcaggtgatcggcccgcctcggccctcccctaagtgtgggcactacaggcgtgagccaaccatgcgtggcccaaaccaaaaatggtctctgaggggaaaaatgcctggacgggaaaactgactct

SEQ ID NO: 725047 - DNA, 762 bp, Homo sapiens
aaggagcagcccctgtgatgagtgagctgaaagacgcctttcagcaacgcctatttggagctggtggtggcctacgtgagaacgagtcctagtgtttctgccacctctttcttgccagatgaacagttatcctgaatgggttccagttttgacactgacgatgtgaatttccctatctgataatctgtgctttgttgtggctacatctccatgattgaccctccacgggcggcctgttcctgatgcctgtgggcaaatgtcgaagtgctggaattaatgtgtcatcatggtcacagtgagaccatccaatcacatgctaaatgctatttgccaaatggtgttggagcatcatctcagaacggcaatagatgacctgtggaacgacattgctagccctgcactcaacatcccagtcatgccatggtagaaccccagggatgccaaggcctgctgtagtacacggcagtgatctaaaggacatagacctccgcagcagctgtgctgacattttcgaagtaccacactgacgataagtgtttgccagtgacctacccctcagcatgaatgctcatccattgtgtgaaggctgccaaagacagggagctatccgtggcctgtgacttggtgaccggattgaaatgactcctccaggctttgcagaacaccagacctttgggcgtttgcccatggcggattgggtgctcacattgtgctccaatcaagccagctgcactgcatcctctggcttccacacttcgctca

SEQ ID NO: 725048 - DNA, 330 bp, Homo sapiens
ggtgatctaaggatctgtatatgctgtctcagcatgataattgggtttgggcaccatcaggaactggagaagcagtcagaacttctgagttgacacgaaaatactaactcttcattgagcaagtgacatctatgagaaagtctgatttccataagatagccaccagtttaaaagaaaaaaaaaggtttacgttaattagtggtatagatactcctgaaaacataggtggaggtttaagtataatcttggacatactaaaaagaccacaaagttgaattggtttgaatgtaccactttttttttttcttttttttgggaaacagcatatca

SEQ ID NO: 725049 - DNA, 360 bp, Homo sapiens
aatggagaccgacatatgtgtatgaactaactgtgtggaaaaaggtcattgttcatactagtggagaaagggtggattatttagtaagtgatgctgctacacttgactatttatatgtaattctgaatattacaaactaaacatacagaatatgtatcttatactagaaattacaggataatattgctatattattgtcatggatatgttttaaactctggtcatacagagacataagctataatctttgaatgagacgattgctgcattcacccttgttatagtaattactaactgttcactttgaaaaagattccttacataaagttaacttgtgaaaagacttgtgtaagaactgtt

SEQ ID NO: 725050 - DNA, 181 bp, Homo sapiens
gcgggcggtgttcccctactgagacagttcctcaggtcagaaaagagaaacatagcacacaagctaggaatagagcatataaggaaacctccaaaaggaatgttaactttctcacagaagatgtggagcgctgtttctgcctatatgccactgtctgctaccacgtgtgctgagtacaact

SEQ ID NO: 725051 - DNA, 152 bp, Homo sapiens
gtggtaatgtcttccctgagtcaatcactgttgacaggatcatttcctgagccatctggagtggtgggtacctagaacagagtggaggctctgtcaggaaggaaggagcaggaaccagaggccgggaaggttcccagaagtgcgcctgggtg

SEQ ID NO: 725052 - DNA, 356 bp, Homo sapiens
  misc_feature (9)..(9): n is a, c, g, or t
  misc_feature (129)..(129): n is a, c, g, or t
  misc_feature (344)..(344): n is a, c, g, or t
ggggcagtnctggaacaggaatttgtaccacctgactcttttaaagagacggggtctcgttttgtcatccaggctggagtgtagtcacattcatggctcgctgcggccttggactcccgggctcggcgnatcctcctgcctcagcctcccaggtggctcggactgcaggcgcgtgccaccacacctggctggtttaatttaaaatttttttttgtggagatgggggctcgccatgttgcccgggctggtctcggactcctggggctcgggcggtcctcctgccttcggccttcccaggggttgctggaagttgcaggagtgagccaccataaccccagcccctntttgattcttta

SEQ ID NO: 725053 - DNA, 418 bp, Homo sapiens
  misc_feature (309)..(309): n is a, c, g, or t
tatcttaaatgtttattacatatgctgtacttagggagactccagctgtttgacaccagagttgacaggcacactcagcacggactgggttaagccaatgctcgcttctccttgtaggtcgccatcatcttcttgatttcccgcaatcgctttccccggattcagacccttggggcaaggtctgtgtgcagttcatgatggtgtggcagcggtagacagagaaggggtcctgcagcttggccacggcgttcctctgtgaagtcgtctctggaagtcgatcatccagcgataggcctgcatgagaactgnaggccccaggtactttgtctccgttccaccaagtaagctggggcaagctggtgcttgaagcaaggcaacacaaggaatgcactccgtacaagcccgttcaacttcttcc

SEQ ID NO: 725054 - DNA, 518 bp, Homo sapiens
ccctcttccgtgtataccaaaaaccctagattttgctaatagttggtgatgtgcacacatacatctgtcagtaaagctaaagcactttgtcctacacaataggtttcgcaaaatatactccatcagccgccttaagttgtgcatggatggtgcaaataacgtcaggttatgtggtatatttacaatcaagtgatgattgcgcacaacttaccatgtttgtgacagccctttccagtttgtctttctttaacgaagccccttttagtttattgacttatacgatgtccccctttgttttgtaaattactgtgccgccaagttgttaatgttctgttaaaagagagggtcctacaaaataattattttttaaaccacaaaggtgttctgccctccgacttcagtggaaagcccctgggtaacacaggtccatctgggccttacctaggagtgacacttagatttgtcgactctttttggccacacccaccgtaagccgcttattgacatgagcaaatatc

SEQ ID NO: 725055 - DNA, 254 bp, Homo sapiens
ctgcgacagggctgggcggcttcccttcctgtgatcctcaggaaagatcaggatcacatcataacaaatgaccggaagacacgggaggtggctgagctgggggtttctgctggagctgctccctgggcccttgctggcaggggctggctgttgacagtcagtgtatgttatgccggtagaattctcatttggctgttgtttgtgtgtgcctgtttttatcccttgtaattaaaacatttatttggccttcgcaa

SEQ ID NO: 725056 - DNA, 785 bp, Homo sapiens
  misc_feature (785)..(785): n is a, c, g, or t
cccgcctccaggcctcgccttcctcagctgtagaaggggctgcttgcataaggagcagatggactctgctccaggcttgagtatagctgggtgcctccatcccaggccccaccagggaggctggctggggcgtggccgcactcatccagaaccctgctctgcctgcagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggcgtaggtgcccgcgccacggggcctcggctcaggggcagccaggtgttgtgagcgccatcctgggccagggcctcccctgagggtgctgagctcttgtgagtccttcattggggccgtggcttcctccagagagtgtcaacaggaggtggtctcagtgatgaccatgccctgccctgccctgccctgccctgccctgccctgcccaggaccctctgcctgcctcccccagagcccagcaccttcagagccctctgcagaaggttgggcacagggcggccatctgcgtgtccgttccacccaggagcttctcggcactgtgccggagtggtcagggttgctctgtcatctgcccacagtgtactatgaggggctgcggacaagctggaccgatccgcgatgccgn

SEQ ID NO: 725057 - DNA, 103 bp, Homo sapiens
tcgtcccggataaggcggcgagcgagagaacgcggcgcccactggatagcgcgtcgggatgcaggtcggcatgcccgcgacgtggcgcatgccggcgagcctg

SEQ ID NO: 725058 - DNA, 561 bp, Homo sapiens
aatgggcgtcctccgtcagtgagtgtccagcccatgtgcttgtggatgtacccacccacagtatctatggtttgtgtggtttcgctcttttgtgtttttgtttaaatgcaggaaacacccttaaagcccgacttttctctgaggtgctcaattacatttaaaaccgtttcctgtacaaacagatcacaaatactttaacaactgcacattctccttccagcttacctgtgagctgttttgctctccaatgctatgggtatctgtctcagaagctctgttgggatcttgtggtgtctgcgagcgaggtgggcttggcgatgtgaatagaatgggaaaaacagaacatcatgtgaacattctatcattagaagctcaaaccccaaaggcagtgaaccgcctccgtgatgaggggctctaccctgtcagggtacgcgtcttcccttccatccagcacctgcacagtagcaaactcttcctcagccctttggggtggcacgacaggagtgagctagccagtcttccagagaagacgcaggggcaactggcaagcagctggctttg

SEQ ID NO: 725059 - DNA, 1331 bp, Homo sapiens
tgggaattaatcatttatcacaaaatgaacaatttcaattcttaaacatacaactcacttttttctcatactaacctcaaaagtggagttaaacagaaattttattcaaactttacaaatatcatttacttttagcccgtggagaattaacacttgagaaaagttcaaccgtgaagttagaccttcattgtgcccagtttaagccattctgtgaaaattaaagcgtgaaaatgtgaacattacattcattcaaaacaaagacatttccaatgtgaagttcgtggcaagtgaattgtgtgaccacaaaacgtgaactttaatttgtgcctcgtggtctccacatgtgaattctttcagagagccataagaagttccccgtggtttttataatatacatgtgagctggaacaaattattcgtgccacaatgtgattaaatgtgcattagaagggttattgacccagtatgtcgcaaaatttttatagttctcaaccattttttcttatttagcaaggcgtgcatataaagggtgcacccccttttaatacacaaaacaaacaaaaaacaaacacagaaaaaaaaaaaaacagaaacaacaaagacgaaaaaaaaaaaacacaaacaaagaaacaaaaaaaacaaacaaaaaaacaaaaaggagggggggcgggggagcaccccaacaaaaagaaaaaacacctaccagcagagaggagcgccaaaacaaaaaaatagagacgtacacccaacagtatatttataaaaaaaaaacaggagtgcagccccacaaaaaagaagagaagatacataaatataaagaaaagagaaggagcgcgcaacaataaaaacaaacagcatggagacgacggagaaacaaaaagcatcgtcacgatgacgcaaaaaatctgagcgaggaagaccacccaacacactgcgagagaggggagggaacaaaaatcacgagagaaacccaacaccacaacaagaataaaataggccccgacgagaaaaaaaaaaacacaccgagtcatgataggaggagtcaaaaaccagcaacaataactgcctacgaagaaaaacacacccgcaccgagagatagtaataaagaaaacaaaacaacgagggacgggagcaacaaaaaaccaccgacgaccaacacagagacgaggcaaaagaaaagaggaagagagaacgagcaagggcacgcgagaaagacgacctaagcaagcccaaccacgcaacaaacgacaagaagacacacagagaacaacaaacaaccacaaccaatcgaaaaaagaaacaaaagaactaaagaaaaaaaacaagaaag

SEQ ID NO: 725060 - DNA, 516 bp, Homo sapiens
  misc_feature (6)..(6): n is a, c, g, or t
  misc_feature (41)..(41): n is a, c, g, or t
  misc_feature (47)..(49): n is a, c, g, or t
  misc_feature (81)..(81): n is a, c, g, or t
ccacanaacagtcaccaagatgtcccaagacttttcaaagnctcagnnntgttagaaagactacacagaaatctactacancatacttataatatgcttgatatttcaaaaagtacacaagccaatgacgacaacctataataaaacttcagcaaacaagcactagggaaaactcagcggtgtccttggtatttagaacacccagttctaaaggtttggagtgaagagaccattccaaatcccagtttctccactcacaagttctatgactttgggcacgtcatctcttagctatttcagtccctgtttagtggagctaacatacctatgcatacataaagctcagtgcttgacactcaatgtgaagcagaagctcagtaaagtcttcttccccacctaatgcgctgtggtctgtacctgcaaacatcctttctcctccaataaccctagcagaaaaatgaaccgttggctcctcatttgccccagctgcccaaactacatttccttcactctgac

SEQ ID NO: 725061 - DNA, 497 bp, Homo sapiens
  misc_feature (483)..(483): n is a, c, g, or t
cagttttggtgtcccgtgtagatccggattcccgaaaaaacacaataaatgaaataataaagcgaacaacatcaggaggagaatggccccagatactagttttcccagaaggtacttgtacataatcgttcctgtatgattacttttaaaccaggagccttcattccaggagttccagtgcagccagtcctcctcagatacccaaacgaggctgaaactggtgacctgggccatggcaagaatatacattcattcagctttgtatgcttactttctgccagctcttcacaaaggtagaagttgagatgtttctgttcttttgggaaggaagcagcaagcattgtttaaaaatatcttccttcttttgcattttttctcttcgaagatttaaaagaagaattacacaaagaactagaactgcacatttgttaagattgtccttttaaaattcctctctgttgcaaggaaaaaataaaagttagntaatagtgtcaaaa

SEQ ID NO: 725062 - DNA, 628 bp, Homo sapiens
cagtactgcggactccatctcctctactaacctcgctctcgcggactacctttacccgcccgactgctcggagaccagaacaccttccaccatgaccacctcagcaagtacccacttaaataaaggcatcaacgcaggctgctacatgatcccatgacctcagggatgagaaagtccaggaccatgatatatctggactcgcatggtactggagaaggacatgcgctgcaagacccggaacccatggacagatgagcccaagatgtgtggaagagatagaccatgacgatggaacttatcgactggactccagataccttatacagctcatgagggattaccaacagatgaacagtgatagtcatcgatgacctgcatgcacatgatatatcgggacccactaccgataaaggacacctaaaccacagctagggtggtacgatagtagaaagtattaacacagtaacaacatcgcgctggccaagacaagaacgacccaacataacgacggcacacacgtgcttaaacaggactaaaaggcaccaatgggatgaggcaaacgcaagccaccaccatgggttaggcaaatggaagcacggagatatacacctccaagggggccacgaca

SEQ ID NO: 725063 - DNA, 148 bp, Homo sapiens
aaaaaagggggggggggggggggggcccccccccgccaaaattttagggtgggaaacccccctcattgttttggcccgggggttttttcccttttttgggggggggggccctttttgaattttataaaaagaaagggccttttttcca

SEQ ID NO: 725064 - DNA, 319 bp, Homo sapiens
cagaagaagaggaagaggaggaggaggaagagcagccgcacagccacagccttccacccttcccgtgaggagaagaagaagattcagattcagacagcgatgacgtttttaggtgacgcgcggcacatcattagaatccaagcaagatttgattattaatttgcgttccaggcccttcacgtgcctcagtctctttcgtgccatctgtactagagagtgaaagagtaccttatgtcatgtgtctaacagtacagtcaagttgagtgttgttcctgtaacacactgacgaatctgcgacggattgtctgggagacatcac

SEQ ID NO: 725065 - DNA, 136 bp, Homo sapiens
  misc_feature (53)..(53): n is a, c, g, or t
  misc_feature (123)..(123): n is a, c, g, or t
gggcagaccgcgctgggttgccgctgccgctgccgccatcgtgccagcccctncggtctccgtgaggccggttgacctccagattggagacaagccattttggagcagattgatccactttcntccatactacctt

SEQ ID NO: 725066 - DNA, 166 bp, Homo sapiens
agatccccttttcatcacaaactgagaagtcctgctccatgcccacccctactgctctggacctggtggatcgaccaggacgcgcctctattggtggctccttcaaagctccccagggtcagactgacggtgtgacgtcaggtgctctctcatccgttcccagcct

SEQ ID NO: 725067 - DNA, 315 bp, Homo sapiens
  misc_feature (36)..(36): n is a, c, g, or t
  misc_feature (267)..(267): n is a, c, g, or t
  misc_feature (289)..(289): n is a, c, g, or t
tgcggcaataatgccgttcagattatcgcgcagtcntggttaaaatgacgatcgtggatgatgacatttgcttcgagattcagtgacaaactgagcggatcgagattactggaccctactgtcgcccagtgatcgtccatcaatgccactttgccgtggagcgggcggcggcggtactcaaaaacctgaacgccgcctttaaccagatagttatacagcaagcgcgcaccgactctgacaatcggcatatccggttcgccctgaatnatcagtttgatccgcacccggngccgtgccgctttacgcaaggcgtgt

SEQ ID NO: 725068 - DNA, 305 bp, Homo sapiens
aacagagatacactgcactcatatcttatgtaccttaaaacttacacagcttaaaacttaaataattcgcatcaaagaaacacataaataaactattttacttaggaacaatgcagatcacatttttgctatcactagaaaaatgttatgaataagagagtatttaacgtgagatcaatgaaactgcatatttcatttgtatttgtattgttactacacttgttaaatccttgtaacatgactgacaaagaactcccaggagccgaaatctgagctctttcattatcctactatgtagggagctt

SEQ ID NO: 725069 - DNA, 464 bp, Homo sapiens
cggtccggtatgagatgtctagcagaggagtaattgcagaatcgacggagaaggcaaagaaatcagcaagaagacaagacaacaaataatctcattacaaagtgggcaaaggacatgaagaaacaattctcaaaacgtacaaacagccaacgagcacttgaaaaaaaatgttcaacatcactaatcatcagggaaatgcaaattaaaaccacttattcccgcaagaaaaaaaaggccgtaattaaaaagtcaaggccggcacggtggctcacgcctgtaatccccgcactttgggaggccgaggcgggcggatcacgaggtcagaagatcaagaccatcctggctaacatggtgaaaccccgtctctactaaaaatacaaaaacattagccgggcgtggtggtgggcgcctgtagtcccagctcctcaggaggctgaggcaggagaatggcgtcaatctgggag

SEQ ID NO: 725070 - DNA, 307 bp, Homo sapiens
gaacgggaggactcccggtacgagcacagttgctggggacatcaatggtgaagggtgggactcactggcccaggggagaaatggcatgctcaggcctaaattaaagcaacgcaaggccgggcacgggggctcacgccatataatcccagcattctgggagaccgagacaggtggatcacttgaggtcaggagttcaagaccagccggaccaaaagggcgaactcccgtctctactaaaaattcaaaacattagctgacgtgtggggagtgagcgccgtgtaatcccagtctactgtgggaggctgac

SEQ ID NO: 725071 - DNA, 320 bp, Homo sapiens
gctgggtgactctagacggatccccttatatggctcgtctcaagggaaataagcatctctagaggaaagccctgactatccggaaagtcttccttcgggaactgtcagggtctatctagaacagctcaagaataggaggttccctgaaaacaaaaaaagtaaacataaaaccctctttggggggggaaggacttggtctcattctctttttctctctctctcaatctctctgggtcggtcggtttctctctctctctctctcacacacacacacacacacacaccataaaagctctaaagatgaaaactaaaacagagaa

SEQ ID NO: 725072 - DNA, 1000 bp, Homo sapiens
gggcagtatttgaagcttctatgtctcgtgacctgtgttgcatgctgatgttggtgctactactggttcttcatgggttatctctgtgatagcgctgtctcaaccgaagactgacagggagctactagaaccactacacccgagcataagatactggcatggttaggccagctaccggtctccgtggctgtagttctctagttgccatgtccctccatgctcgcgtggttcgcttgcgccgtgtctcgtcgcttggggtcccaccagtctcactagtcttcttcagcagatagtgaggttagcatccacgtgcacccgactgtgactctcgtatgcgcgttcgtttgggcatgcaggttatagcaccttcggttgtcgcgttgtcgttttcttctgctcctgtgtccatggttaataggctgttcccggtgtcgagcgtgggaggccacgtttgggttccccaggtgcgcagaactgttgctcatctctctctcccaggatcacgtcgacgccgttcgcgtgagtcctggtgaggccctgctagttgatctgttggtctttcgttgcccatcgcccccatggcctgacagcagccgtgggggcgtgcgtacctgagtctgctaatgtccacgcgtgtgtacagaccaggcttgggtgttcacatcgtctgtccttatctgcatcacgtcctgcgttccatcgttgtctcgggcatgccactgctgtgtggtctggaacgcccgcaggccaagggtgagaccgtgtctgctatatgggttacctgcttagcccgtgtcccgtgtgcggtttgtactcctgttgttgccactgtttgtcggtgcctgcccgtgtgcacaggtggtttggctcctctttgtgtataaacctccttaagctgtgagggattgactggttggacctgcttggcctaccgtggcgggtttgtgtgggccacatggttttcggcacgggtttggtttgccgcgtggttgcgggttcg

SEQ ID NO: 725073 - DNA, 123 bp, Homo sapiens
gtggctgctggctgcgctgccattgtagacgtttccagcacgctttaaaacgcaccgacacagcgcagggctccactcttctgtcgggcttcagtaactccttgcagctgtcaagcccaatat

SEQ ID NO: 725074 - DNA, 283 bp, Homo sapiens
gagttaaattaggctgggcgtgtggctcacgcctgtaatcccaacactttgggattgctgaggcgggcggatcatgaggtcaggagatcaagaccatcctggctaacatggtgaagccctgtctctactaaaaatacaaaaaattggctggatgtggtgtgttgggcccctgatggtcccatgctactcgtggaggctgacggcacggagacatggtgtgaacccagggaggcagattcttgcagttgcggctgaggcagtgagaatatgggcgtacgtggga

SEQ ID NO: 725075 - DNA, 244 bp, Homo sapiens
aaaaaaaaaaagggggggggggggccccccccttttctttcccccttggaaaaggcccctgggggggccccccggggggggccgggagggggggttttcaaaaggggggttttttttttttttttgggggcccttgtcccaatttttttttttttggtaaaaaaattttttttttttttttttttttttttaaaaatgttccctataaaaaaaaaaaaaaaaagtccttttaggggggggttta

SEQ ID NO: 725076 - DNA, 114 bp, Homo sapiens
ccgcaccggttacgagtgaagtgatacaatcacagacccactgcagctatcaaccgttccaggtacaaatcagtcttcctgcctcagcctcccgagcagccgaccacaagcatg

SEQ ID NO: 725077 - DNA, 319 bp, Homo sapiens
  misc_feature (24)..(25): n is a, c, g, or t
  misc_feature (232)..(232): n is a, c, g, or t
ggtgcctagatatcccaagctttnncgcctcaccggggctcacttttctcacactatgactacgaattacctggagatttaaaatgcatattccttgcctatgcatatatggacaaaatgcataaaatgcagatttcctggcctcatccaccagatagttggtttaggcaaatcagagacagaatataagcatcggctttttttttttttttccctagcacccggggaaatnctgatcttgtctagagccagatccacccgtggggtaaaagcttgggtcccggagctcgaattcgataactctgtggctcattagctt

SEQ ID NO: 725078 - DNA, 234 bp, Homo sapiens
tcagttgattcctccgtgcctgggctcccaaagggcggggactacaggcgtgagccaacacgcccggccggtgtcaaggtttttaaagatacatgatttagaactggatggctagatttagagtgaaaaagcaggtctgaggctaagcaaggaggtttatattttaggagcagagctggcactaaaggaatgggttcagaacgggaactccagaggataaatttaacagcaaaa

SEQ ID NO: 725079 - DNA, 198 bp, Homo sapiens
gctgagattaggcgatgatgggattaggtcaccggttgcaggcctggtggaagagaccaggacagtgtagccgtgatgtggtcatttgtcctgatgccagcttgaagatgcaaaaaaaagagggaccatatgctgtggtggttctaccatggaggtaatctggggcgcacagaatttatctagagtctggctgctgtg

SEQ ID NO: 725080 - DNA, 115 bp, Homo sapiens
actccccctgtttacagggaggaaggtctaagcagtgggctcgccaagtcaggccaacctccagtttcaaccacgagaatggtgggctgaggaccaagagaaggccattattcag

SEQ ID NO: 725081 - DNA, 272 bp, Homo sapiens
acttaacgcaatataacaccttaacagctatgatctaaactacgtctgactaaccagagacaaagagatggatcgacataataagaacatgccatgccaaaatacctctaattcatatattcacatcacacatctttatgcagtgtctaccctatgccaggcatcctgctcggtgctagggggaaggcagacattcatcaaatgaggtaacaaatgtcaaagcacaaccactgacagtagggacaccctgctacgaagtatacagcgttgag

SEQ ID NO: 725082 - DNA, 174 bp, Homo sapiens
gagccggctaccaaattaaaccaaacattccatgtttaagatgtggggattgggaaccactagttctttcagatggtagttcttcagactatagaaggggcttccagttgaattcaccagtggtacaaaattgacggagacaagcaggtgaaacaaagcttttttactggtgac

SEQ ID NO: 725083 - DNA, 185 bp, Homo sapiens
aggcggctcttcaagcccggaggagctcccagtgcgccaggagccgccggtaacaggggccgccggccagggccccttttccagtcatagctctgtacgttgctacataaatttcttgtaattgttttgctactaagataatttcagaagttcagtctattttttcagcggatactgccgccacc

SEQ ID NO: 725084 - DNA, 266 bp, Homo sapiens
  misc_feature (15)..(15): n is a, c, g, or t
cctccaggtttttgntgactccggcctggtgaaagggagccccatggtcctggctgttggggtcccagggagaggtttttttttggacaaacacaccctcccagcccccagggttgtgcaaacacatgcccctgccataagcaccaacaagaactttttgcaggtggagtggctgttttttataagttgttttacaaatacggaaacagtccaaaatgggatttataattttttttttgcattataaataaagatcctttgtaaca

SEQ ID NO: 725085 - DNA, 262 bp, Homo sapiens
acccactactggctatcatcacccgatgaggcaaccagccagaacgcctgaacgcaagcacatactttctattctacaccctagaagggttcctttccctacttattgcactaatttacactcacaacaccctatggttactaaacattctacccctcacaattatgggaagccaacgccacttattcagtgaaccactatcacgaaaaaaaactttacctttttatactaattttcctacaaatcttcttaattataacat

SEQ ID NO: 725086 - DNA, 429 bp, Homo sapiens
gctccaacttccaccactgcctcctgtgattaagatgtgagccactgcgcccacctgggtagctattcttatatcagacaaaacagactttaaaccaacaacaatcaaaaagggcattatataatgataaagggttcaattcaacaagaagacttaactatcctaaatatacatgcacccaacattggagcatctagattcattaagcacgctcttagagacctaccaagagacttagataaccacacaatattagtgggagacttcagcactccactgacagtttcacagatcatcaacgcagaaaactaagagagacatctagaatctaaacttgacacttgaagaaaacagacctaacagacagcgacagaatgctccacctcagaagagaatattcattgttctcatggacacatggcacatatg

SEQ ID NO: 725087 - DNA, 247 bp, Homo sapiens
cccggggcctgagaacccgggggaaattttaggggttaaaagggggggtttttttcccgccctttatttggaaatgggccttttttttggaaaaattttgggaaaccctttttaggcgggggcccttttggggcccttttggtttagggaagcccctttttttttttttttaaaacccctttccggaaaggggggtttttttttagggggccccattttttttattaatttggttggttaaacccca

SEQ ID NO: 725088 - DNA, 287 bp, Homo sapiens
tacagagtgaaggtcgttagcattttaggaatcactggcagacagagtgaatgtgatgagctgcgcaggggtggcatccagatggtcgccgcagatctggtgaacgactcaatcgatcaacttgccaaggtcttcgcacgcttcgataccgtgatcggctgcgcgggcatgatcgcgggccgagaaaccccgatgaagctggcaaccgccgcactcaaatccggcgtgaagcgctacttcccctggcagtttggcgtggatttcgaagtgattggccggggcagccc

SEQ ID NO: 725089 - DNA, 107 bp, Homo sapiens
ggcaagcctacggtgtggaggaccctgagtatgccgtcacccagcctagctcaaccaaccatgtggatcagagcctcggcaaactctctctggacaagtcttccggg

SEQ ID NO: 725090 - DNA, 794 bp, Homo sapiens
agcggggggtcgcggaggcggcgcggcaccagtgagcgtcgtctccctggtgcgcatgctcgcccccgctgcgggctagctgttgtgttttttgtttttttcccccgggcgggcccgggcggttggcgtactgggctggtgggacggggaagtgaacgccccaagcgacgcggttgcagcggggccgtgaggagcagccagcgggaggcggctggcgagctcggtgagcagctgggaagagcagaaccgggggcggagcacctgcaggcgcgggcgcgggccccaccagggcgattcggcaagaaaaggcaccaaggagcccccagtgctggagccacagaattcgtcctgcaggaatcacggcgggacatcgtctcctgtgtggcagatggatctctccggctggggctcagtgttggaggatacgggcaaaagcttcatatcattttgggtaactcttcagtacaagtgtcaccctcccagcaatagaagaacaagctactgtgattcagggtccctttataactagtggcattcaaagatttggcatacggtggcttcgtacttgctagtggcggataatatatcatgccgaaattcaagagtatatgtgggaatacagttacaaggcgatgtgcatttctccagaaacaaaccacatgcaggtttaaaggactcgggtccagcttaagggcgttctaccttttgggcctgtgttggggggcacattcgcttctcatctctgaacacttagcttctcagaacccaagttatcttatggagcgtttatccca

SEQ ID NO: 725091 - DNA, 542 bp, Homo sapiens
tacttttccacaggaggtgttcgtacagaatactttagaaagatgtcacgcactttagacgtaatactaagaaggccagaaggaacatgaaggtcactagcactcaatatttggtaaattgcactatcaaatgttggctcgaaattaccgagcagcagaatcgtactgccatgtgtagtaaaacacactttatatttccactgcttaaagcagctgaaaccagactgaaaaaatttttaatggcaggggtgaaggtgaaaacgcaaacatgtaaaatgatgagtctgattaagacacaggctttttaaatgtcttttccttttctttgacctatttgatattgtctagtttatctgaaaagtaaattaactactttgtttagttatgataaaagcacattttgaaaaacagtgagtggtattgtgaaattccatggacagttttaattttaacaatcacaaaggtctaggtctaaatatatgtgctgcaatgctacccaaatatgtagcaccaaatctacctggtggtggcccctgtggaac

SEQ ID NO: 725092 - DNA, 285 bp, Homo sapiens
gtgtctattagtttgctatgatgaagtttatgttaagtgtattttaccacaatttttaaaaaatgaggggagggatggcattctaaagtacctgtcacagttttgtcaactgggctaggctatagaatgtagctacttaatcaaaaactactctagatattgctgtgaagatattttgtagatgttgtttacatctacaactgattttaagtaatgtcaatttaaagctttgctttaagtaaagattatcctaaagtggatgggaaggccttaagagcacaaaaa

SEQ ID NO: 725093 - DNA, 127 bp, Homo sapiens
cgtataccaagccggcacagtgtggcacgctcgttatcgtgaacaactatactgcggatcggatcaacttcagtctggctcgcggggacgctggcccgggtgctgaatggcatctcgttggacaatg

SEQ ID NO: 725094 - DNA, 666 bp, Homo sapiens
  misc_feature (653)..(653): n is a, c, g, or t
ttttgttgggaacgggggtttttttttaaaaaatgctttgtttagagataaagccttgtctgagttgttgttgagggaatggctggtgtataatatagttattgggggttttatgataattaagacccatgttggtaaggaacaatttgggcggcttaagtaaaaatatatataagtaaatcttttgatgtagtaagggaaggcagtactcatggagtagcggtcgataatcttagttgttcattttggttatttggattggacattttacagcatttatttaatgattttcgttctcatgagcaatgtgggtttgttactagttttgggtaaattattcagtctgtttattccttaagtttgaagacatagattttatgtggaaaagacctgcattttttggatgttatgatggtaattttctggaagtttatcaaacttttggtagcatgataaagatcgctgttgtggtatacatgttataggagttgtgtgcatgagagctggtttcattagcaccgcctaattgtgtccagatatattttggttttcgtaaatcgttaatagaggttgggcttcaaaagacttatataacgctccctctatatctatatctatctctctctctctatactctcctcgtgccgaattcnctgcagcccggag

SEQ ID NO: 725095 - DNA, 157 bp, Homo sapiens
cccctctatcatgcttagttggctttgcatttttaagtaatcagaaagattctcttacccccatgcccttgagccatttgctagcggcgatcgtcattccagaagatagtgccctaagaacttgtcagattcagactgtatctttttcagcattcta

SEQ ID NO: 725096 - DNA, 387 bp, Homo sapiens
  misc_feature (13)..(13): n is a, c, g, or t
  misc_feature (267)..(267): n is a, c, g, or t
  misc_feature (303)..(303): n is a, c, g, or t
  misc_feature (347)..(347): n is a, c, g, or t
gcacttggccatngtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaaggcagccagagggacaacgggcgcccctcttctatttacctattaaaaggctgggaatgttagggaacaagtttgcaccaggaaccccttncccaccccaatggcagctgttccctttaccctggantattctggcagctggcatttcgggggggccctttttttaggggngcttacaggcaagggttcaccagattttgcttttacaggc

SEQ ID NO: 725097 - DNA, 1399 bp, Homo sapiens
gggctacgttcctctcgagaatcggcgcctcgccctgctgtgcgtctggagctgggctaaatgcctgggcgcgctcccgcgcagcggcgccatgaagctgctcggggactctgcgggtgctctcgggaccctgagacttgccttcaggcgtgcagcaggcagcgaggtcctgggacagcatggtggagcggggaaactcaggacgggaccgagtcctgtggcagacctggactggactgccactttgcctgcatccttgagaacccccgttggacggtatgccccacatgctgctaatcgccgtcgggaggggtccggcggcggagttagagcggaggctggccgggccgggcagacctccccgtttggaacgcgtactatcatggccgatggccagcgcgtgcctggcgactgattgctggatgtggcgagaagtgggcttggccacagaagtagtggggccgcgagagagtggtatgccattgggatgaatggtaccaggtttgtgagaaaaggagacccaggaaacggtgtaatgtatcccggttgcctggttgggagaaagcaccagacagtctaaggatgagacaactgtggtgacggtagagcatacagcgaaagggaccggaacgttgaaacagatagagatgacgagagcgaagccgggaacagtgtacaccagtagataccgggaagagggaacccatgtacccgatgggactacaggcgacgaagacagacaagcgggatagacacgacgaccacaagtagttgggtagagttagattgccgagctccccgtggacgcattcgatgaagatagcgcgccaaggactgagtgagagacaacagccgtaaggacaagacccagaggggcacattgatgtagcgcggcaagaagaaaagcagaagttacaaggtagaagatgggagaacctagtggtgtcaccacttgtcaaactttagaggaggcagcgatgacagtggcaccagtaccggttagcaagaaagcgaaccgctcagaatttcaccgtgtggggtaggcacacgagaatgtggacaagcgctaacagcattgaggaccatagggatgatagaccacacagataggcaaacagtccaattctatgagaacaccgcaaggtgcagagcgcgaaaaaagttagaaatcagttggagaatagcacccacatatagagccagtttgggatctcatcatgcacagttaacgaggataaaagacagacatagacaataccaattgagatcgagaatagggtgaacagaacaattagaggaaaaatttacgaggaaaagccataggatcacacgagagggagcagaatagcagtgggagtacgagtatagaccccgcgacaagtaggcagaccaaaatatg

SEQ ID NO: 725098 - DNA, 203 bp, Homo sapiens
agctcggatcccccacacccggccttcgtttttcttttgacacagggttttgctctgtcacccagtgttggagtgcagtggtgcagtcatagctcactgcagcctcaaagtcctgagttcaagcaatcctcttgcctcagcctcccaaggtgctaggatctcaggcgtgagccactgcacctggcccgaaaccaagctttctc

SEQ ID NO: 725099 - DNA, 170 bp, Homo sapiens
aggctctgacggttctcctcctcctcagggggctgggatgagcactcggccagacgatcttccagcagattccgctcctggctcagctgggaattcgtggtcttccaggagcagcaggatcctcttcaacattgtcttcagtggggggcctcgtggtgcgatccccgttc

SEQ ID NO: 725100 - DNA, 1325 bp, Homo sapiens
  misc_feature (9)..(9): n is a, c, g, or t
  misc_feature (13)..(15): n is a, c, g, or t
  misc_feature (17)..(17): n is a, c, g, or t
  misc_feature (23)..(23): n is a, c, g, or t
ggcgggaantgannntngagatncccatcctgaaggacgtggcactgtggccttctgcgacgcgcagccacgcaggagatccatgagaaggtcctgaacgaggctgtgggggccctgatgtaccacaccatcactctcaccagagaggacctggagaatgttcaaaggccctccgcatcatctgtcctggatatgggcatgtggtttttgacaacatctgacatcaacgtcgtgccggggattaaggcatttgcctgtctgcaacagtgcccagcggcgtcttgtggaggagacaggcctgactcgacgctgtgcccacatcctgaacctgtaccggcgggccacctggctgcaccaggcgctgcgggagggcacaacgagtccagagcgtcagagcaagatccaggccgaggatggcgtaccggacgctagacagggatccgccggggacgacctatggagcatcatcggaccaatggccgccgtgggggcaggccaagtgtgcagcatgcgggccccaaggcacctacggtgactaacaacgattgcacttacaacggacccattaacatgtacggcggatgcgcgtggcagccgtgtcgctggggacagcaagcaggatgtcaagcaaccacatgacaggacctggacacatataccaacaaagaagacaacaggcactagaacccatagagacagggcgggaccaacaacggaagccaacacaacaacccaagctccaatcacccacgagccacacacccggccacagcccggaccagacagacacaaggggagccgtacccatagctagacacaacagacaccgcggagataggaccaagagatggacaatcaacaagaacaaggcaaggctatgagtcccaaagagcaccgcaaagcagaagagaccgagaggcccaccgcaaggcacagagcaagagccgcaaagaccccattcagcgaaaaggcaagacaccgacgaagcacgacgaccggaccgcgtgccaccacaacataccgaagcgaaaagaggcccggaacagtgggcaagggagcacatgccgccacaccgacacacagacgaaacaggcaacccgaccacgacccaatcagacgagacggacagagcaaaaacacacggccagacgacgaggagacagaaaacaaacggaagggaagcgcagacaccaggaagaacagcgaacgtcggcgaacacaaccgcgcagagagacgagaccaccgcacagcacgggccaacagcgagagcaaagcagcagtgaacgcgacagggagcaagaaggacggaccccggacacgaaaa

SEQ ID NO: 725101 - DNA, 263 bp, Homo sapiens
tgtggctgattagaggatccccgcgcagatttgacaggtcgcgcgatgagcagtgccccctcggggcggtgtgtcgggcgaagttgacgagcagcccggcggcggttgcgagctcgaagttgccgatggacgagcccggatagaacagcacgggtggggcgtggggccgctcgctcagcacgggatgcaggtcgagcggctcctcgaagtcggtcaccacgcctacgcactcgatgtcggaccgcgcgggggtcccgaagctc

SEQ ID NO: 725102 - DNA, 245 bp, Homo sapiens
  misc_feature (134)..(134): n is a, c, g, or t
  misc_feature (167)..(167): n is a, c, g, or t
  misc_feature (177)..(177): n is a, c, g, or t
  misc_feature (195)..(195): n is a, c, g, or t
gacgggtatgttatgtatatattatcacaattaataaaatatcatttgtgtcttaggaaaatagtattacttgtattatctagacattaaaatagaatgagaatacttaggtgtttattagaacataagctacnccgtgacaactatattaaaatgacagatgcaanaagagcatanacgggaagccattcatgngggcatgtacttgggtgaaaagctgtgcccgtcaaatacttcactccttg

SEQ ID NO: 725103 - DNA, 508 bp, Homo sapiens
cgcaacagagactcggtatcaaagaaagaaaaacatcgttgtgccaagccagactataatttaatgccatctggtacttagggaacatgtaagataggtaatacactatcataatctgtgataaataatatacatggtaaattcaagtcttgtactacattagggatttattttagtgtcagtaggttcttcctaagattagagttactgggtcaaaggtggagaataagggtctacgagtgtacgttgaccaattgtcttccgtaaagactgtacgaacgtccagttccagtgatatgatactggtggtctcagtagaatcttctccaacactgagggtattagtagtaactttattagatggagatatcaggtgctaataccaattaagataggttaatcaacagggcttgaggttaaaatatatcgtagaggacaggtaaagtcaaatttagacttcataggtcatcggcgtcctcactcctgtgcatattctgtaggaagcaca

SEQ ID NO: 725104 - DNA, 756 bp, Homo sapiens
cacaggcctgccttctcccagagcctctgcaggaaccgtactaccaggcaccctacacgctcgtttggagctcaccggcgtcctcttgcatcctgagtggtcgctggccactggctggaggttataagaagcgcccaggcatcgagatcttgttccaccagctgtgcccctttatatgaaattgtcatcttctacgatcgagtagactggctatgactgctgtttccagctcattgatagatgtggaccccctatggcttcatctcctaccgcctattcctgggacgccacaagatacatggaatggacaccatgttcaaggatatttcatgtctgaatcgggacccagcgtcgagtagtagttgtgggactgcagagaaggagagcctttccgcctgcaggccctagtagacggcgttgccctgcggccctgggacggcaaactctgatgaccgggtcttgtcggatctgtctgccttcctcaagaccattgcactgaatggtgtggaggacgtgcgaagccgtgctggagcactatgccctggaggatgacccagactgtcggctttacaaacagcgggtaaagccggctagagccaggaggtagcagctagtcgccttggtccgagctctccaagtcccaacaagcagtaacctctttccttggctccctcaccagcccgttgttggctcgactccatacagccctgaactcctggggctcctcaaactcagtgctgggtccagggccccagt

SEQ ID NO: 725105 - DNA, 353 bp, Homo sapiens
tcctatcaggctagcagtccgcactcctagagcacggatatacagaacgagtgggtgggtgtcggctgcgtgtgtgtggcctgatgctccacggaggtacgagacggggggctcgtagtcggtttccttctccagccagccgccagggcgtcgcctgatgatgagttttctgacttcgtcatatactccgatgagaagagagtaggggaaggcacagaatcaccaggtaggtaagaggggatacatcctaagagacaacaaccattccagggcagtaggacaggaaagcagccaggactgtctctacaaagaggccaaatatcaagatctagatcttcatcccctgctggaag

SEQ ID NO: 725106 - DNA, 280 bp, Homo sapiens
  misc_feature (218)..(218): n is a, c, g, or t
  misc_feature (233)..(233): n is a, c, g, or t
  misc_feature (246)..(246): n is a, c, g, or t
ggcgctcaatggaattctcgtgtgagagagtatagacggagcttggctttaaccatatgcaaatttaaagagacacagttatagagcagaatctgagctgttggtttctgcctcttctgcagacagttctctaccgtgatgccatttgcagagtcagctggaaattactgacagaatgaatttacaaatggctgtcaaaacctctgagaaaacattgntttaaaaaaaaacangaaaaaacacatnataataccgtaattaaaacagagtaccttaagga

SEQ ID NO: 725107 - DNA, 1011 bp, Homo sapiens
gtagcggcccaagcctgtcctttccagctgctgtaagtcctgcgacaccaagttctaggggactgccgatatcccggtagtcaggaaaggcttccttgaggaggtcacatttaaccaaacttcaatgatgttataactggagcaaaggagatgcggtcggggacgatagaagattaccccagaaagtgtggtgtggcactaccgaagaggtgccatggggagcgagaaaagagtaaccaggtccagacgagaatacagaaacaaagaatttgggtcctccgcggcctttgaactcagcttggctctcaaaccaattgtttgattgagcgcctcgacggaccctgggcgtgttgatttaaacagtcgtcccttaggtggtggtcctgaggaacatggccgtggtcacttcaatacgaagccggtggggatgaccgccaccggaagaaagaaatagccggccggggtaacatgctacgtacctttgtaaagaagcatctagatggagtcagacaatgcgagcattaagtggggctctattacaaagaaggggcctcaaagcagccttgtagaaaatcaattatgctcccgcggctggtggtttatatccttgtgtggcctccaattcatggccagtaagggattaagaaaaccactacttttgaaacttcggcgattgagaacctggaaagaccatgggggcatacaaaaagtggtttcaaggaccacagctccatggaggagtgctcttgaaagggaagtcctgtaaggaggagcgcgtccctggctgtgaagtagagggagtgaatgccagccgcgtacattgagtcttgaattctgcgctcatccaaaagagaaaccgccatcttgacacaggacggcagatgcctgagcccagtgtaaatgtactaccactgaaggatggtggcaccacacgttgagtccttttgcgccaaaagggagtaagggaagaaccatccgacatatgggaagatgcgccataaactgacaacg

SEQ ID NO: 725108 - DNA, 144 bp, Homo sapiens
ccgcgtgcagggatgcgtcccagcatttattcccatgcacagagtgggtcgtcccactgcctgcccacgcacagaagtggtggccgctgcggcacaccctccctggcctcactcaggctgtgccccagggcgggggcgtaccct

SEQ ID NO: 725109 - DNA, 365 bp, Homo sapiens
acagggcccaagacattctgtagatgctttgggggcagaaaggatcctggggctagggcattgggtaggagctcatgctatcttgttgtttcccagcttacactctagactagattttcactgggccttttccaagatcttgtgctaacagctgagatttttatactagctccgttctctctccgtgcccgccccacgccctccgctttccctcattctctgcatgcctggctttgtgttcttccgcccctcgcaggggagcctgggctcgcgcacaccctctgacatggagctgggggcatcgtgcgggccccaagctctgcccctgagctacatggatggagccaggtgaggaaaaggggcag

SEQ ID NO: 725110 - DNA, 780 bp, Homo sapiens
cctgtcacatatagagaaacttcgaacctcaatgatagatgatctaaatgcaagcaagttttctataagaaaaggatagaagagctagggcagagactccaggagcagaatgagctgattataactcagagacagcagattaaagactttacctgtaatccattaaacagtatcagtgaacccaaaggaaatcctttagcctggcaggctttgaatctcagccagctgctccagctgtgcctatgaatgccccagccctgcacactttggaaactaaatcaagtctgccaatggtgcatggaacagggcattctcggttcggacattatggaacccattgaaagaacatcttcacgaagaggagagaaaccagggcggggaatgtgacacagaatattaatataacaacaaagtgcatttaagggaaagctttgaagagtaactcctccctcactaggggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaattgggagaaagcactactctcttcagatcaggcaggtttctcaaatggtacctttcaactggggagtccccaaatgattcaattccttcaaaaacgacatggttgacaaaagtggtctaaggtg

SEQ ID NO: 725111 - DNA, 504 bp, Homo sapiens
gagagggtcccccatttcctcggtaaggagggtgacctcctcgctccaatcagggactgagctgagctgaggacaagctgccctttcggtgagcctatctctgtgttgcttgtttctaggaactaatcctccaggaaattaacagacagtttgctgtggacaactagagccctccccttccttagccctgagcgaggtaaacaattctgctctgccttccggaagtttcaaattagctcttcaaccagcgttttcacgcagcttccagtcctgccacagtcttgaagaagagatcagctttcgcgtcttcattcttgccaagattagctgcccttcgaatctcccgtgtgtcattaatcccagcacgaacaagcacttgggaactgcgggctgcagatggtctgcttatcctacggaaccctcctcttttgaggcttaacccctttagtctttgttgcttctgtagctttctgatgccattaaagagatgatttttaaaaaaaa

SEQ ID NO: 725112 - DNA, 501 bp, Homo sapiens
cagcacggttcagtaggcagaggccacttctactacccggctaaggaaaagatgggcagagcctgctctggatgacgctgtgttccagccggcggagagggtcccccatttactcggaactaatcctccaggaaattaacagacagtttgctgtggacaactagagccctccccttccttagccctgagcgaggtaaacaattctgctctgccttccggaagtttcaaattagctcttcaaccagcgttttcacgcagcttccagtcctgccacagtcttgaagaagagatcagctttcgcgtcttcattcttgccaagattagctgcccttcgaatctcccgtgtgtcattaatcccagcacgaacaagcacttgggaactgcgggctgcagatggtctgcttatcctacggaaccctcctcttttgaggcttaacccctttagtctttgttgcttctgtagctttctgatgccattaaagagatgatttttaaaaaaaa

SEQ ID NO: 725113 - DNA, 476 bp, Homo sapiens
  misc_feature (22)..(22): n is a, c, g, or t
  misc_feature (47)..(47): n is a, c, g, or t
  misc_feature (125)..(125): n is a, c, g, or t
  misc_feature (131)..(131): n is a, c, g, or t
  misc_feature (162)..(162): n is a, c, g, or t
  misc_feature (242)..(243): n is a, c, g, or t
  misc_feature (249)..(249): n is a, c, g, or t
ccccaagccgactggagccgantagcaagccgctttaaaacggattncatgcatagctgcagaacctgatggtagggaccttttggttttgttttgttttgttttgtttggtttttggttttacnagaagngtttttattacaagaaaaaattccgtgattntgcagaatgctggtttttacaccatcctaagaaaaactttacagggtgttttggagtagaaaaaggttataaagttgganncttaantgtaaattaaccattgagtgtcaaagttctaaagctgaactcattttgtgcaatgaacataaggaaagactactgtataggttttttttttttctccttttaaatgaagaaaagctttgcttaagggttgcatacttttattggagtaaatctgaatgatcctactcctttggagtaaaactagtgcttaccagtttccaattgtatttagcttctggttggaattc

SEQ ID NO: 725114 - DNA, 397 bp, Homo sapiens
ccggagaagtaacttctcaagctaattttctcacagctgaaatgagaataagctcatctacctagacaaacccttaacctgggtttaagtgatgtatcagaggaacaataaataatagttacaattactagcatatccctcctaactcagattcccagtatcaagcatggagtcatgcctgtagaggggctttctcaacctcagccttactgacattttgggctggataattctcccttgaggggctgttgtgtacattgtggggtgttcagcagggtcccgggcctctactctctagatgccagaagcaaccctctccttaattgtgacaaccaaaaatggctccagacgttgccaaatgtcccctggggaacaaaggggtcccccagctgagaac

SEQ ID NO: 725115 - DNA, 235 bp, Homo sapiens
  misc_feature (6)..(6): n is a, c, g, or t
  misc_feature (15)..(15): n is a, c, g, or t
  misc_feature (23)..(23): n is a, c, g, or t
  misc_feature (49)..(49): n is a, c, g, or t
  misc_feature (56)..(57): n is a, c, g, or t
  misc_feature (154)..(154): n is a, c, g, or t
  misc_feature (194)..(197): n is a, c, g, or t
gcacgngggccccanccctagangggcccaaatgagagaatggtacttngggatgnnaaacggcgcctggctagagacttcgggtgtgtgtgtctgtctgtgtgtatgcatacatatgtgtgtatatatggttttgtcagttgtgtaaatttgnaaattgttccctttatatatgtatgtatatatatatatgnnnntatatatatatatgaaaaataaagcttaattgtcccag

SEQ ID NO: 725116 - DNA, 108 bp, Homo sapiens
ctgcggatggaaatcagattcaaggagtggttcgaggaaatgtacttgttctgatccgggatgttgcaggtaacctactgaagagcttaaatggtttggttgaccagg

SEQ ID NO: 725117 - DNA, 323 bp, Homo sapiens
gcgagaagccactgtctatccatcgaagtgttgtgtaaaggctacccttccgaatatgccacatacctagaatatctgccgttccttgcgtaatgacgacaagcctgactactcgtacctgcggcagttttccggaatctgtcccatcgccagggctactcctaatgactacgtgttcgactggaacatgctcaaattggtaagtcgcactgccagcacgttcgctgagtgtggtgtgcgggggatggcttgtcagtgagaggccggcggccgccttgtagagagctatacgctccccaagaagattatgaagtatgaccctt

SEQ ID NO: 725118 - DNA, 673 bp, Homo sapiens
  misc_feature (361)..(361): n is a, c, g, or t
attttaagtgatgactgtgccaccctaggcacccttggcgtcattcctgaatctgtcattttattgaaggctgatgaaccaattgcagattatgctgcatggatgatgtcatgcaagtttgtatgccagaagaagggtttaaaggtactggtcttcttgacactaatctttgatacatgctgactgctaagaaatgaccagaggggaagaggagtttgacatgttagggcattaaagcaaaggtggatttaagaattaaaccattacatgccccttccagcagattgcactgatggacatcagacttgaaggaaatgtttccaattttatatttaaggggggtggtgggtgggagagggcnagttaaggccgtacaagtttagtagcagtaattggtaatcatgtttacatatgaaacttatagtcgcggtaagggaattaaagtctgttatatttccttggtcgagttcataccatatgcgttgttccataaaggattgtttcaagtaaatggtacaacaatctgcttttaacgaaatgtattttagcgaccataccttgtttaccaatgcctgtttttgatttataattctacctttaaatatagccttgaaggtgatcaaatattcatctttcgctcttttcccttctctacttcactctttttcctacc

SEQ ID NO: 725119 - DNA, 1487 bp, Homo sapiens
ggctcacacttgtaattccaagtgcattgggaaagctagaggcggaggggatggatccgccttgagagccgacggagattgtacatcactcagcactggtgtcgacatgtagcgacgcacccgtgatatctacaaggactaaaatacatacgcaactgcgtacaagaatgacagaacatgagatacctggtgcctgtttcatgtgatgtgagcgtcctgaatctgtccccacaagttggcttagatagtggtaatcgtgtgtcggttgtggagcatgttaatcgaatgcatcttccagtagaatagataggtgtgcttggttacgaggactctctagggcgggtctacggtctgaaagataggagaatttttgcttcgaataccacttgtagaatgcaagcatagatcgccctgcacgtcgtaccatataatttctctacccacatattgtgagtgctttgaacaggaaaggatggcctggaggattggttcgcaccattggtcgtgagtgagtcttttaggggcatcaacgatgggtgaacaccatctcaaagccgttcccctagggcgtctccactcactttgtgttgagtctcgcccaaggctcggctcttttcatggatcggaccccaaggaagttacgcggaggggaggatccccctcacggacccaatcaggaaatgttccaagaatgatcctcaaaaaggtcttggcggccgatttgagttggaacctacctggcgaccacttggctgaggatcctacggaggtcctcaacctttttgcgtgaacgacggcatttgatggggccaggcggaaggaagttccgacttcttggcaaaggatcgttgcgtcaagggcagggaatgcggtttggccaagttcgagaggccccgcagagaaattttgttgcctcacatcatgtgggtacctctcctaaggactcgtgggtccctaacaggtacagcaggaaggaactccgcggagatcttttcagaaaaaggaaaacacgattgttcggcaaaagcaaagaaaaacgctgtggctgggtaaccagcggacacactgtgacacctatcacacattatgcaccacgttgttgtgtgcgtgctgtgcgtgccatgggaagacccttcttcgaaagaatatcgtcgtgttcttgtaaacaaaccctctcttgtaagtgggtgcgcgcggcgaggtccccaaagaagtgcttcttcaggcaccgggttgcagcaatcggggctggggcccacacaggggaaaaacccgggtggcgcaccagagacgtctgtgtgagcgtgcgcagccatatcgccgacccaggaaaaaatgaggaacgccccgcggggagggggacaatcgcagagagcgctcagtcggagagagagaccccgcaaagagaggggttgcagcggggcagcaaacagcggggaatctcttgccaacgtgcagggttcaagggcagtggccaagtcatagat

SEQ ID NO: 725120 - DNA, 403 bp, Homo sapiens
  misc_feature (246)..(246): n is a, c, g, or t
ccgctctaaggatggatgggggccatgagcaaggagtgaagatggcttctacaacaggaaaagacaaggtcacagattctgccctagagcctccagaaggaacatagtcctgccaacaccttgattttagcccagtgagatgtgcctcagactctggcctccagaactgtaagacaataaatgtgtgttgttttcagccaccaagtctgtgggtaactttattaacagtagctgtagggaaaccantacaggaaaggaggcaagggggagacctgttctattatgttttttcacaacggcatctactttaggcagtgcttatggatttctgggtattccttttggggggggaaaattttaaaaggcccaaaaacagggacccaggaaggcacttttcaggagt

SEQ ID NO: 725121 - DNA, 219 bp, Homo sapiens
ccctagcacttcctgtacctgggtctataggtgggcgtcaccatactccgctagtgtgtgtgtgtgtgtgcgtgtgtgtgtgtgtgtatgtgtgtgtgtgtgtgcgcgcagagatggggtcccactgtgtgtatatgtgcgtgtgtgtgtgtgtgtgtgtgtgtgtgtgtgtaggggtaaaacatgtctctgtcgcgcaagatgtatctcacatattgt

SEQ ID NO: 725122 - DNA, 1255 bp, Homo sapiens
ggacgcgtgggtcgacccacgcgtacggagcgcggctcagatgtggcttctgcccagcttcccaacttcaggcatgctcttgctggtgttcgggggcctccagggctctggcaacgctggagcggcatgctgaccccaatcctggcaggctgcgctgaacgccagcctgtcctcgtttgaccctgctacgctcaactacgctgctcgctggcccacgcggctacgcccgctacccaactccgccaccgcgcacgcgacaccgccacctccctcactgctacccctgcgcaccggccgcgtgcgcacgcgccctcggccccctccacctccaacggcgactgcgcgctcgcccccgcgcccaccactccgtgtacacacgctctcctcacaggggcgcccccgcaccgcgcagccgctctccacgcgtgcaaagcccacggtccacgctcgcagacaacccacacgcgggccgcctctcctcgacccacgccgcgtccacccctctgccgccaacctggtcacccgtgccccaacccacgccaccctctgctccctccccaccgacaccatcgacgcacacccctctctaccctcaccctccccccgcgcgccatcgcacatcagccgcaccaccgctccttccaccctcgcgcgctcttcacatcctcctccaccctctgagcgctgcccccgcaccgctgcacctcgagccaccctctgcacctcgcctgcccatgcccctcggccgccccacgcgcactcgctcgctgcgaccaccaccacgcacgtccacgccccccgcacacgacccagcccctcacactcgccctcctcgcaactgcgcgccacccaccgaacgccgccgctccaccctcccgcactgcgccctccactccaccccgcctcgcccttgcgcgcccttcaccctaccctccccgcaccctcacccctcgccccacctgcctgcccctcccacgctcccgccccccgcaccaccccgatgtcggcgccctgcccacctcccccccgccccctcaccctgcccacccccagctagcgcatcccccctccagccctccggccccgcggccccccccccacgctccccttgcccaccgccgcgctcacctcaccccccgcccacctcctcccggccgccctccccgcctcgcccccccacccccgccccccccgccccgccctcccgcgccacccgcgccccccccctccctccccccaccccccccgcgccctc

SEQ ID NO: 725123 - DNA, 314 bp, Homo sapiens
  misc_feature (29)..(29): n is a, c, g, or t
  misc_feature (144)..(144): n is a, c, g, or t
  misc_feature (196)..(196): n is a, c, g, or t
  misc_feature (250)..(250): n is a, c, g, or t
caaaagtgcactcttctatatctaccaanagcgtattaggaagtaagaaacgatgaataattaaaacaggaaaagatactaaaagtgctagaggtaggcgggtcaccatgttaaaaccttactcgaaagatgacatcgaaccanacacttgaaagaggtagagaacttttccatggggatgtaagtgggaagagcnttccaggcacagagaacagccagtattgaggcctaaagtggttgtctacaaggncagtatggtgagtggacagagagagtagatatagaagagtgcactttaagggatccgctaggtc

SEQ ID NO: 725124 - DNA, 310 bp, Homo sapiens
gaaaatatttggagagatttattctaagccaaatttgagtgactataacccatgacacagccctcaggagaccctgaaaacatgtacccaaggtggtcagggagcagctgggttttatacattttagggagacatgagacttcaagtacatttaagaaatacattggttctgtccagaaaggcaggacaactcgaagggcggggaggggaggatacctccttttccatcatcttttagatcatttaattctagatatttctttatttttcacaaatgtatgtatttcttccctcttcatatacaagtctt

SEQ ID NO: 725125 - DNA, 295 bp, Homo sapiens
agctgactggggagagtaaagggaatcaggatatatgtcaggcatagggctgtccagtcatgctgacaacagaggtcctgggagtgaaggacagagaaaaataaaaaaactcccccaatctttaacagtactgtaacagctcctgtaatttcatgtgtcagacagtaatctctgctaccccttcttctggcaacccccacagcctccagcagggcaggcacctggtagaggcatatacagatggctagaatgaaacaaactctctggcgcaataaacctccaggctctgtggaaa

SEQ ID NO: 725126 - DNA, 142 bp, Homo sapiens
atggtcatacctgttcatgtaaaacgacggccagtgcatgcccatacctgttcatgtcaaacgatggccagtgactgccaatgcctgttcgtggatgtcgacggcaaatgactgccaatgcctggtcatggctgtcgatggc

SEQ ID NO: 725127 - DNA, 892 bp, Homo sapiens
aaagcacaccataaatccactatgatcaagtggggggactctggtgccgggttctgaatatctccctcttcatccctcccgaaatctggaatacttatctattgagcctattacatccaggtttcacacgaccattcctcgttgtcatgtttaatacaattcatattaaattctcaacgaataactcattttaaatataatgctacagggtttgcccggcccgtggaaaaaaacttacaggtggcgccgttaataggtatcaattttaggagcttctatttggtgcatttacatcgcaactggtaatctgctagaatccactttgcctgtgtaagtgaaagaatatagactgttatctatgtatggcccttatcgaatagttcctgcacttttcattataatacgtctttaaccttcattaaattacttatctaggccaaaggtgttcatggtctttagcagcttcagttgcattcttattcctttcctcttcctgttcattttatgcttctcaatgtctgaggaccatatgagggttagaatatattatctctgaaaaatctacgaaaaaattgtgtatagagcgaaccattacttcaaaagttggactggccacaattctccactgatggttatttttcagtactcattcataatcgtgtcaccctccaacttaaatgaagtttggtatgatccagtgctattcttccggaataggttgtctcgcgggttgggggtaattactaccctcgtaatacggtgccaaattcctgcctggggtgcccggggaatttaactgttaggcatacacatgttgcactgggcgaatacactaagccggttcggtgaaccacaacaaaaagtgggggcgaataaccagggggcggagaat

SEQ ID NO: 725128 - DNA, 849 bp, Homo sapiens
gagacagagccaggaccctggaaggaagcacggatggcagccggcaacacgcagttggagcctgggctgctggtcctcagctctgctgggcgggcacgtacgtagcgtgctcacacacatcacagcccggcattggcgacgccactggctgctcgaagtgtaacgggggcccccaagcaaaccaccccagcggcctggacatggaaactgaacacagtgccggacagcaagcttggcaaggtcctgtctccccagggagcgaggcccctgggcaccagtcgctggctcgctgtccttcccaacggctccctcttccttccggctggtcgggcctcccggctgacgcgcggattctccggtgtccccgccctgtgacacgccactggcccccggaccccgctccccactcctcgcgatctcgtgtttctcaccatcatcccgtgcccccccacgcaagctgcaccattctcccctgctgatcctcggccgcccggttgttccccactcgccggcgcccgctcctctgctgctccgcaccgcagcctccccctgccagccgcctctctgcctgccccccttggactgggcaccgccccctgcgctgccctaccctccccccccccgtctcctgtgccccacacctaccatgaccactcccccttccacatctccccttctccccttccacacccccaccacaactgcctaaccctaatccccgcgcccacaccatcatcaccaaactcaaacattactacttaaacctaccacaccaatccccttacctcccaacacctgcccccgacacaccacacccacttccaaaccgccaatcacagacaccctatt

SEQ ID NO: 725129 - DNA, 207 bp, Homo sapiens
ctgcaggtagacagaccattcgagaaggtctagtgaaagacataattacctgcaccagaataacacaagcctaaccttgacaacgaggcaaagggaggggtgctaaacagttattacaattaactgcatgtttatctttggtcctgttatcctctaacacaggtgggtaggtagaacaggcggccgtatttcagggccagagtacaa

SEQ ID NO: 725130 - DNA, 1172 bp, Homo sapiens
tgtggcagggcagccaggcctggcgatgcggggctgtgtctgcgatgcctggagctggcatgtgcagacaggtggttggtccacccccctggctgcttgctcacgtgtgtgtggactcatttcacacctgaactcgcgcacacggctttggacaaccagcaatgcgtgctttgcttgcgtgttgccatctctgcgcggctcactggccacaaagcacaaactactctgcactgtactcgtaacagcttctctgccagttccattctctgcactgacacgcactgcacacaaagcaccgactctcctgctactgcgctctcctcaaggcactcactgcatctcacttcctcgcgcaacacagcacttgctacctgcgcacacctgctctctcacacgcacacacgactcaatctgtcctatggggtaaatacgctatctacgctactggaccttgtgtttaccccaccaccatgcgacccccttaacaccctcaccatccaacccacacctcgacacacctctcgccccactctcaccccgacacccctccactttgccccacaccgcctaccctggctccccctaaccctctccccgctcacctctcgggctcccttcaactttctgactcgcttgactctggccccgcccgtgcactcccttctacgcgcggcccttggccccctttacacccatcgcaacacgcccgccttcaccaatgttctatatctcacgccttggctggcaacccgtccaacatcggtctccccacttggcaacttggcactcggcgctctacccctttcccctcactcactcccctcgtctccgctatctgactcccagatttcttctgggcagacaacgaccgcggtgtgccaaccccgatctgctcggcgccgcaccttctttggcgcatcggcccacgaactgcctgcgacaccgccctttgggcgcgtcgggcaaagccgtttccttggtcgcacgcgttccttgggcgaacccagcctcctcctctgtctcttcactctcgtacacgcgagcttgtatctgtcccagtctctctcgatgccgatcctcgtagaacgctgtctgctttggtcgctgaccactactgtactccccttggggtctgcacccccccagcggactaggggacagctttccacgcc

SEQ ID NO: 725131 - DNA, 1223 bp, Homo sapiens
aagaagcaaaatttaatccaagagcaacttttagtgaatttgcagccaagcatgctaacagattcaagcattccaaagcaattgcaaacagcatgcaaagcaccgcagcacagcctatggtttcaatgcagctttggtggcccgctgctcacggaagcaacagcagaacagcaagcattcgcaagacccagcaggtgcagcaagcattaacatcggcatttctttgcacactattcatcgtcaatccatccacttgagacagtccagtcatcgcatggcagccaacagtaacacagcaccaacagtagcaaagtgcatcccacgttcacaacagccagtcagaatagttcatccaagtgcagcagaaagcaccatatttccaacaccagtcaccatatgcaacacaacatcagcaccaagcaatttcagcactccagcaacacacagcaacacaggcagcttgcaacaggccaagcccggccattggaggcccaagccattcgcagcaacagcagcacacagggcagggtctcagacacaaggacgctggtctcaggcacccacacacccacaccagcacacatcagcatcagcagcagcagcagccagcagcaacaaacacgcagcaaggcaagctcatccagcaatttcaaacgctacttctggtctgaccatggctacgttcgttcacgatgtgtccatggtctagatactcgtaggaccctccgaaacagatcaccgctgggaatctggatccttattggacccgacgacgagaacagagcagcctacttacactgccacaccttgaatgcaccttaccaaaaaaccagcacagagcactattcagcaaccttctggactgaaacttcctgcatatcctttacatccacgtgcacagaagtcacacacacatcactcaacgcgagaaccatcgacgggcctcaaaagaaccaccacacgaggagcaggaacaaacaacaaagacaacatggagcacacactccaaggaaaagacacatacacagacaccaggtaactaacggacagccctggacccaacccgccggagcaacacagcaccaaaaaaacgcaaaaacgcgaccaccgtacacaacaaaattcaagcaaacggagcaagcccagacacgacagcaacgcacaaacgagagcaaacagaaagaacaccaaacgaagccagagacaaaacaaccggtaacaca

SEQ ID NO: 725132 - DNA, 871 bp, Homo sapiens
  misc_feature (2)..(2): n is a, c, g, or t
  misc_feature (197)..(197): n is a, c, g, or t
  misc_feature (263)..(263): n is a, c, g, or t
  misc_feature (265)..(266): n is a, c, g, or t
  misc_feature (272)..(272): n is a, c, g, or t
  misc_feature (275)..(275): n is a, c, g, or t
  misc_feature (277)..(277): n is a, c, g, or t
  misc_feature (281)..(281): n is a, c, g, or t
  misc_feature (305)..(306): n is a, c, g, or t
  misc_feature (317)..(317): n is a, c, g, or t
  misc_feature (346)..(346): n is a, c, g, or t
  misc_feature (349)..(349): n is a, c, g, or t
  misc_feature (352)..(352): n is a, c, g, or t
  misc_feature (373)..(374): n is a, c, g, or t
  misc_feature (376)..(377): n is a, c, g, or t
  misc_feature (383)..(383): n is a, c, g, or t
  misc_feature (385)..(385): n is a, c, g, or t
  misc_feature (392)..(392): n is a, c, g, or t
  misc_feature (398)..(398): n is a, c, g, or t
  misc_feature (401)..(401): n is a, c, g, or t
  misc_feature (403)..(403): n is a, c, g, or t
  misc_feature (405)..(405): n is a, c, g, or t
  misc_feature (410)..(410): n is a, c, g, or t
  misc_feature (415)..(415): n is a, c, g, or t
  misc_feature (417)..(417): n is a, c, g, or t
  misc_feature (423)..(423): n is a, c, g, or t
  misc_feature (432)..(432): n is a, c, g, or t
  misc_feature (471)..(471): n is a, c, g, or t
  misc_feature (478)..(478): n is a, c, g, or t
  misc_feature (488)..(488): n is a, c, g, or t
  misc_feature (507)..(507): n is a, c, g, or t
  misc_feature (519)..(519): n is a, c, g, or t
  misc_feature (538)..(538): n is a, c, g, or t
  misc_feature (549)..(549): n is a, c, g, or t
  misc_feature (557)..(557): n is a, c, g, or t
  misc_feature (572)..(572): n is a, c, g, or t
  misc_feature (588)..(588): n is a, c, g, or t
  misc_feature (594)..(594): n is a, c, g, or t
  misc_feature (611)..(611): n is a, c, g, or t
  misc_feature (641)..(641): n is a, c, g, or t
  misc_feature (663)..(663): n is a, c, g, or t
  misc_feature (670)..(670): n is a, c, g, or t
  misc_feature (718)..(718): n is a, c, g, or t
  misc_feature (722)..(722): n is a, c, g, or t
  misc_feature (725)..(725): n is a, c, g, or t
  misc_feature (743)..(743): n is a, c, g, or t
  misc_feature (762)..(762): n is a, c, g, or t
  misc_feature (867)..(867): n is a, c, g, or t
cntggtattggggtaagggggtattgcaggtaaaaagaggtgaagcagattctggctttcagtttcttagctcagaaattccagcaatccctgtagttctttgcatcccctcaccacctctggaatagagagcagggtcttataaatatgctgaacaatgtcatctagtttttctaactccttgtcagagcgccgangttctcctctaggatatttctatggctctggaacttgatcatgagttttccttctcatttttcatntnnaggaanatnantctnagtttgtccacctcctgagagagnnaaactttctcntggatccaattggaggccataggctggcngtnggngtccagctggcctgccagggnntnntggagnantttggtntatgtntcngnangccgnagtgngngggtanggtgggtcncctcctctctaaggcttaatgagctcgccactcatgaanaactgtnctaggatctnctcaattcatgctgctgtntcacttcctggngcaccttttcattcttgtngcgcagcccanggccaggnacagcatcactatgnctgcttcttttgcctnactggnactatcctgatgctgtncttcctgggcctgcagcctagcttgcagcncacaaatttttcgctgcagagncctggangggcttcttctttagactcttgtagcagggaacaaagactctgaagcncagnagncataatactcatttctgncaggctctcctccatgccntggggtctctgcgggctgaagggataccattgatgctactcgggtgaaagcactcttgtcacttccaagcaagggcacaggagtagattctggctctcatctgcnctgc

SEQ ID NO: 725133 - DNA, 379 bp, Homo sapiens
  misc_feature (39)..(39): n is a, c, g, or t
  misc_feature (196)..(196): n is a, c, g, or t
  misc_feature (206)..(206): n is a, c, g, or t
  misc_feature (217)..(217): n is a, c, g, or t
  misc_feature (247)..(247): n is a, c, g, or t
  misc_feature (274)..(274): n is a, c, g, or t
  misc_feature (303)..(303): n is a, c, g, or t
  misc_feature (327)..(327): n is a, c, g, or t
  misc_feature (338)..(338): n is a, c, g, or t
  misc_feature (358)..(358): n is a, c, g, or t
ggcaccaacctgcattcatgcccttgtatccgcacacgnccagtgtgtacaggcgcaccccgtggactggcccaggaggacgtgcatcatcactgcaatcagcatgaacaccaggcacccctgggacacctaacgcccagttcccgtgaccccaactgcaggccccccctactctgcagcctttcccatgctctgncccctgtctnatggacgagtngtgcggggtgctgggagcgaggggggccgnatgctcctgtccttgtgcttctccttntgcccctctggtctttcctgttggtgctncaggcattgtttacctgctcttgntccccggtgtnagcccacagccatatttgtnatggtttccccggggggccaa

SEQ ID NO: 725134 - DNA, 163 bp, Homo sapiens
tcgtatgtggtgtacgttagtacaatggtgtactctccgctctgaggaggtatacaaggaactcatttttaatttgcctttcttttttctcttccccgatgctacataaatggaatttgcacacattcctcacagcatcacctgacggtaaccacacagtacg

SEQ ID NO: 725135 - DNA, 535 bp, Homo sapiens
  misc_feature (2)..(2): n is a, c, g, or t
  misc_feature (197)..(197): n is a, c, g, or t
  misc_feature (263)..(263): n is a, c, g, or t
  misc_feature (265)..(266): n is a, c, g, or t
  misc_feature (272)..(272): n is a, c, g, or t
  misc_feature (275)..(275): n is a, c, g, or t
  misc_feature (277)..(277): n is a, c, g, or t
  misc_feature (281)..(281): n is a, c, g, or t
  misc_feature (305)..(306): n is a, c, g, or t
  misc_feature (317)..(317): n is a, c, g, or t
  misc_feature (346)..(346): n is a, c, g, or t
  misc_feature (349)..(349): n is a, c, g, or t
  misc_feature (352)..(352): n is a, c, g, or t
  misc_feature (373)..(374): n is a, c, g, or t
  misc_feature (376)..(377): n is a, c, g, or t
  misc_feature (383)..(383): n is a, c, g, or t
  misc_feature (385)..(385): n is a, c, g, or t
  misc_feature (392)..(392): n is a, c, g, or t
  misc_feature (398)..(398): n is a, c, g, or t
  misc_feature (401)..(401): n is a, c, g, or t
  misc_feature (403)..(403): n is a, c, g, or t
  misc_feature (405)..(405): n is a, c, g, or t
  misc_feature (410)..(410): n is a, c, g, or t
  misc_feature (415)..(415): n is a, c, g, or t
  misc_feature (417)..(417): n is a, c, g, or t
  misc_feature (423)..(423): n is a, c, g, or t
  misc_feature (434)..(434): n is a, c, g, or t
  misc_feature (436)..(437): n is a, c, g, or t
  misc_feature (453)..(453): n is a, c, g, or t
  misc_feature (491)..(491): n is a, c, g, or t
cntggtattggggtaagggggtattgcaggtaaaaagaggtgaagcagattctggctttcagtttcttagctcagaaattccagcaatccctgtagttctttgcatcccctcaccacctctggaatagagagcagggtcttataaatatgctgaacaatgtcatctagtttttctaactccttgtcagagcgccgangttctcctctaggatatttctatggctctggaacttgatcatgagttttccttctcatttttcatntnnaggaanatnantctnagtttgtccacctcctgagagagnnaaactttctcntggatccaattggaggccataggctggcngtnggngtccagctggcctgccagggnntnntggagnantttggtntatgtntcngnangccgnagtgngngggtanggtgggtaaantnntatatacggattttgngatagaaaatattgtatttatgttattgggtattatanttatgatgatgtttacattaatggcgataattttatttattgtc

SEQ ID NO: 725136 - DNA, 399 bp, Homo sapiens
  misc_feature (200)..(200): n is a, c, g, or t
aatgttatttaagattgttagattactaagtaattagaagtaagcagaaagggaatctattaaaagtttcgggtgaaggggtggtagaagaatagtgtgggtgattataagtttgaatggaatagatgttaaatatgttatgtggcccttatgctgaaaatgctgctcttagtgctgttgttgggctgtaggcaagttantctacctctctggaccactttcccatctacaaaactgtgcttggctctttgcacaaagtgcttactgtgtgatgtgctgacgcaatgaaatacaactggctgaacgtttaagtccaatcaaccaactgtactggcagctttaccaggtcaggaacactgctgccaaggcgaatgaagagtggaactcccgcgtcgacgc

SEQ ID NO: 725137 - DNA, 275 bp, Homo sapiens
ttcgagttcggtacccactctgatccagttagaaaataatggaatactcattatttacattacctgatatatacagacaagcaaaaaaaatgttttggtcggccgggcgcagtggctcacgcctgtaatcccagcactctgggaggtcgaggcgggcggatcacgaggtcagaagatcgagaccatcctgaccgtcggatccgcctgccttgaccgtccaaagtgctacaactacaggtgtgagccaccgtgcctggccaacagagactggatca

SEQ ID NO: 725138 - DNA, 364 bp, Homo sapiens
  misc_feature (40)..(40): n is a, c, g, or t
  misc_feature (101)..(101): n is a, c, g, or t
  misc_feature (123)..(123): n is a, c, g, or t
  misc_feature (234)..(234): n is a, c, g, or t
  misc_feature (247)..(247): n is a, c, g, or t
  misc_feature (251)..(251): n is a, c, g, or t
gttgatcagcagtgaatccagaggaggaagagagctacgngtcactcaggcacacggtttgactggattcctgactcagatcacggttggtacgggccatngcccagccctgtcagtcagtgnaggagggaacagtgggacccggaggctctggtcggatgtaccctcttgctttggcaccaagcctgttgtcaaagtgatggccccatcagtcagattggctaggtgggtggnggtctctctgacnaaangtccctctagatcacccctaaccaagtgggggacccagggtcacagtgtccaccctgcacccatgacagcacacgggacctctgccggccagctgtcctgcgcatgccttgcc

SEQ ID NO: 725139 - DNA, 239 bp, Homo sapiens
ggtgtctactctatcttaggggacatcaatttcatcacaactattatcattataaaacccccgtgcataacccatataccaaactgcccctcttcgtcgtgatccgtcctacatcacatgctgtcctactatctccttatctctccccagtcctagcttgctggcatcacctatacttactaaacagacgcgcaacgtggtacggcgggggtaccgcagctcgacattccgtacatcat

SEQ ID NO: 725140 - DNA, 81 bp, Homo sapiens
aacgaggacacggccatttattattgtgcgagatattgccgtgatgactgctatcccggctttgaatcctggggcccggga

SEQ ID NO: 725141 - DNA, 690 bp, Homo sapiens
  misc_feature (570)..(570): n is a, c, g, or t
cggacctagacaaccacagtaaagatactgtatttgtggtccaaggaagtttaaatatttgtggtcaaacttaaaattcaacgtaaaactctcatctgtgatggaaactttccagaaactgcatggagcgggtgtgcaagctgcataaactctcaaaggcctctcctctcaccaggctgagctggaaaagcctgttctccttccttcaaactgtgtagctaacaagcccttcgatcagagaaggaactccttgatgctccagccaccacccaagaaacccgctctaaggacctttcgggccaggcacagtagctcatgcctgtaatcccagcactttaagaggccaaggccggaggatcccttgaactcctgggttcaagtgatcctcccaccttgacctcccaaagtgctgggattgcagtgtgagccactgtgcccaacttacttcctttctgtctgtctctctgtctctctctctatctatctatctatctatttttttaagacagagtcttgctctgttgcccaggctggagtgcagtggtgcgatctcggctcactcaccggaanctccacctcctgtgttcagcgattctcctgtctcaggctcccgagtagctgggagtgaccaccatgcccggctaattttgtatttttagtaggtcgagtgcagggtacggactcgaatcg

SEQ ID NO: 725142 - DNA, 1076 bp, Homo sapiens
ggatacgggagttcctccttgctctcgcccctactctttctggtgttagatcgagctaccctctaaaagcagtttagagtggtaaaaaaaaaaaaaaacacaccaaaaggctcgcaagcccacaaaggggatgaaatttcttctgggacatcctccgggttctcccggttaactggatcgtctggcttccctagagtccttcgggaaagctttttattcctaagaggagaaactcagtcaccgggcgaaatcgtgctggattaacagggagctggggcatgggaattggggagacctggactggcctatgaatttggctaaacttaaaagcaagctgggttctcggggatataaataagcatgggactgggagggaaacaggctggccaaatggcaaggggactggggtgccaagggttcatacctttggtgggtagactggcagaaacccgagaagatatttacaggctcttgcaaaagaaggtgaagggcagaatttgggagatgtagatatttaagtaaataaggcggggggtagtctatacattcagattggttggctaccacaagatcctcagcatggaaaagactttggaaggttacggtactggcacattttcgtggactacaaagggcaattacttcctggaagtgacgcacgaatattaccatggggccataatgggtacacgtgtggcttccgggcagacttgcgacactgtcctcgtgtcccccctttcgtaatagggctaactggtcaaggccaaggttatgcctggcaggtggggaattcccgtcaaaccctgtgcacagactggacctcgggggtggcctttacagcaataacgtgggaggtccaaacccacacccgggtcctgggggccccaagtgtcggtaaaccgcaggggggttacaccagaacacccagaggtccaacggttggcgggccccacgtcgtggagaacaggacaagcagggtggacaaccacggcgcgagccaacgggagacacctgcagcgctgcaccaaaacataggtgagtatcaccaacgctagacggctactaaacacacctgg

SEQ ID NO: 725143 - DNA, 618 bp, Homo sapiens
  misc_feature (397)..(397): n is a, c, g, or t
  misc_feature (542)..(542): n is a, c, g, or t
  misc_feature (615)..(615): n is a, c, g, or t
  misc_feature (618)..(618): n is a, c, g, or t
acgcgggggtttaaaaaaatctttaaaaaaatggaggaattatgaacttaaaaagcaaattaagaagctttttaggtgctactgcacttgtgttgccagtagcattttttgcttcttgccaaacaagatttgatcaagtaaatgaccataaattagtgattgctcacacttttaatagtagagaaggaaggtttttagcattagatcaaattgttaagctttgaaatgaaagcgaaaaagttaaaaacaaagaagaaggattttatccaataacactaaatcgacaatttgcgcaaacttatgcagaacaaggtaatgctttagagttaaaattaaaagcaaaaaacgctaaccaattagttaatttaatttttggttatcctactctagctgctgntgcatcccaatatgatatgagtttaaaatattcagattttccaagtttgcaaaatgcaataaaaacaacttttccacctgaatttcttcaagaaagcaaagaaattgcaggattaaatccaaaggaatattgaataattcctagnttaaaatctttcaagaacattactagttaatggacctgttttgaattatgtagttcaacaagctacaacacanggn

SEQ ID NO: 725144 - DNA, 763 bp, Homo sapiens
ggtgcacttccattctgagctttcaatcgatcttcctcattttatgttgctaaactactcttttggcatggtatacagactatatatatttcaccacactcctcattatcttgtcatttgtattatccttacatgctctttgaattcgtcaatagtttatcttgatccatgtattacctaatcggattgcctctctttatcctgcactaactaattcttgtctatcatcgttcttgaaaatgccagcagctatttgagttctcaaataccatagcttctcaacagtccattgccagtgccattactttgtcccaggcactcagacttctactctcctatctttgaaggcaaagtaggtataggatagccccaactctacgaatgaattttggagaggggtatgaagataccatagtcaacctatgacatggacaatggttggacagcatatttgtgtacttcccttcatacatcatttgctgagcataaaggttttggtaaaccaaataagatacgggtcgctggagtgcaagaggcttatgcttgtaatcccggcactttggtagtgccaccgcgggggggatcacctgaagtcaggagttcgagaaccggctggcgaacatggtgaaaaccgtgtctctcctaaatgcgcaaattggccgcctcatgcccatgctatagtcccgctactttagagttgagaccacactcatttggcctgacgtacagtgcctggcccaatcagtgcaatgaacccgcttgc

SEQ ID NO: 725145 - DNA, 215 bp, Homo sapiens
cagctcgcttatgtgctccctgtgttccatgtgtgccatggctgtgagccacagccaccccactatgccgcaggcgccctacccatcttcagtgctgcctatgggacgcagggccctatctgtccctcggtcgccgtgtggccagagtgggtcccgtcgtccccaacattcgtgctcgctcagacattttggcaggttgtctggggcctcaccaa

SEQ ID NO: 725146 - DNA, 253 bp, Homo sapiens
ctccagcgtattatacaatatagagtaaagttttgtttttgttattttgagacagggttgcccaggctggagtgcagtggcatggccacagctcagtgcagccttaacctccagggcccaagcaatcctcctgcctcagccactccctaacccagtagctgggactacaggcatgcaccaccacccccagccaattttttgtgtgtgttttttggagagacagggtttcgccatgttgcccaggctggtctgg

SEQ ID NO: 725147 - DNA, 1520 bp, Homo sapiens
aacaacactctatatttgaaactgatgaacgctaccgacatttagcgattctctgttgatgacctctggactgctgtaaacgtgattcgtcatagtctctggggatacccatgctagtctgtagggagctatcttcactaatgcaacaccagacagccactattatgaagaacattacagtggacacttagcagacaatatccacttcacttctgcttgatacgtagtgttgctaatgctacactagtatatgggcttgaatcatagtagaacaccatggtcagcagcataacacagcttacagtaacaagtaatacgttactttcatacagctacttcactcttcaaagcaatctctacctgacagcacgctttctgccagacacacatatgagagcacaagcatgaaattactgaggcaagatctcttcacacacaactctgccaatactggctctcacctctctatcttcactaatcgacctctgagactagcgacgcctgtggaaccaacaagtacccaacaaatatgggtactaacgagcaaatagataggactacaattctacgccctctggctaaagcacaagtgcgacttactgcaggtccgttggccctaactgtggtcttactattaacatcgccatccataatatacgtctgggaaacaacacacgcggctcccttcaacagggcttactatattatatacacgtgtcagattgtacatgtccgctgtaccacgccagataagacaccctgaactgtagattccaaggcaacacgaaaattctcctggggggacatttaacctcataatgaagagacaatatacggggggcaaccggcggatcccgtgcactttcccttaccgcaatcgagtaagttcccccccgatcccggacaagtggacagagggccacccccgaagtaggctccatttgttcacccggccccggacataaccgccccctaatggcgcgattgtttccactgagggtgcttaacgcaaatataccgtagtggagagcttcccccctagttatcattagaagcgtttggaaaggactccgggtgaaggctccgaagtttgaaagcgtacctataagggagacatacctctggtggcgctccatgtctacccggcactattctctgcattcgacaaagcgaggatatcagcgttggaaccattgtcgggagcaaccatagaaagcctatgtgcccgttattgcccgttttgggatggcaaacgttcccgcgtgtctcggattgacacacgcctgttaaactccctctgttacaccggacgtacacctatgctatgagtcaataggattgacatactccatataactgaatgtaggggaaccgcacaaagttctctacacctgtttacgccaggcgacgggaaacttgtttatacgaaggcacgagtatccgaattaaggacgggattacactaacagcagtttctagagcaacaacatacatcatactatggtctgggtacatacaga

SEQ ID NO: 725148 - DNA, 182 bp, Homo sapiens
ctcgcccagtacaatggatatcagaaagcgctgtgatacctcagacagaatggcatatcagcgcacgtaggtctacaagacgctactatcccctatcatagaagagcttatcaccttacatagatcacgccctcataatcattttacctatatctagctatacctagatccatgatatgcca

SEQ ID NO: 725149 - DNA, 142 bp, Homo sapiens
  misc_feature (1)..(1): n is a, c, g, or t
ncaggaaaaacaatgcctgtctttgtctgactcaaaaacatgctggtaatttgcatatgagatatattttattaagatgttgttatatttgaaagctatgtcatcccggtattgtctaagaaatacagttcacgatttatgg

SEQ ID NO: 725150 - DNA, 578 bp, Homo sapiens
  misc_feature (38)..(38): n is a, c, g, or t
  misc_feature (67)..(68): n is a, c, g, or t
  misc_feature (74)..(74): n is a, c, g, or t
  misc_feature (85)..(85): n is a, c, g, or t
  misc_feature (97)..(97): n is a, c, g, or t
  misc_feature (123)..(123): n is a, c, g, or t
  misc_feature (174)..(174): n is a, c, g, or t
  misc_feature (275)..(275): n is a, c, g, or t
  misc_feature (345)..(345): n is a, c, g, or t
  misc_feature (357)..(357): n is a, c, g, or t
  misc_feature (367)..(367): n is a, c, g, or t
  misc_feature (393)..(393): n is a, c, g, or t
  misc_feature (412)..(412): n is a, c, g, or t
  misc_feature (474)..(474): n is a, c, g, or t
  misc_feature (476)..(476): n is a, c, g, or t
  misc_feature (489)..(489): n is a, c, g, or t
  misc_feature (492)..(492): n is a, c, g, or t
  misc_feature (504)..(504): n is a, c, g, or t
  misc_feature (560)..(560): n is a, c, g, or t
ataaagtaaagtgtatatggggaggaaagaagaaggtnctggggggaggatgatgggaaatggtgcnntatgtnttgtgtgaaanaactaggagtgnagtgtggtggtgactttggaattgcnatggtaaataaaaaatgtagggggaaataaaatatataggtagagtattgntaaaaataaaaataagagcacgttagataaagattctttaaaaggaatataaaaatgtatttgtaaacaaacagagaaagaggggagaaaaaaaaatatanaaacatctatcaaggggatcaaggccgttacgaaacacacaggtactctcccactcactcagctggggantgctagaactangtgaacacancatacttcaatgctgcagagcatgcncgggagaaacaatgaggcnccctccttgggacagttgagaaaggcaggaggaagggcaaaggaagtaaggctgggcggganancttgagcccaganacncaggtgaaagancaaaatatatctgttgcttcctttcttaaaaatgaagtggagaaaatactgaaganttgtggacaactaacagt

SEQ ID NO: 725151 - DNA, 900 bp, Homo sapiens
  misc_feature (3)..(3): n is a, c, g, or t
  misc_feature (62)..(64): n is a, c, g, or t
  misc_feature (93)..(94): n is a, c, g, or t
  misc_feature (100)..(100): n is a, c, g, or t
  misc_feature (103)..(103): n is a, c, g, or t
  misc_feature (119)..(120): n is a, c, g, or t
  misc_feature (195)..(195): n is a, c, g, or t
  misc_feature (206)..(207): n is a, c, g, or t
  misc_feature (227)..(227): n is a, c, g, or t
  misc_feature (252)..(252): n is a, c, g, or t
  misc_feature (352)..(352): n is a, c, g, or t
  misc_feature (371)..(371): n is a, c, g, or t
  misc_feature (412)..(412): n is a, c, g, or t
  misc_feature (427)..(427): n is a, c, g, or t
  misc_feature (454)..(455): n is a, c, g, or t
  misc_feature (469)..(469): n is a, c, g, or t
  misc_feature (541)..(541): n is a, c, g, or t
  misc_feature (560)..(560): n is a, c, g, or t
  misc_feature (606)..(607): n is a, c, g, or t
  misc_feature (609)..(609): n is a, c, g, or t
  misc_feature (612)..(612): n is a, c, g, or t
  misc_feature (639)..(639): n is a, c, g, or t
  misc_feature (643)..(643): n is a, c, g, or t
  misc_feature (684)..(684): n is a, c, g, or t
  misc_feature (711)..(711): n is a, c, g, or t
  misc_feature (740)..(740): n is a, c, g, or t
  misc_feature (763)..(763): n is a, c, g, or t
  misc_feature (765)..(765): n is a, c, g, or t
  misc_feature (767)..(767): n is a, c, g, or t
  misc_feature (833)..(833): n is a, c, g, or t
  misc_feature (896)..(896): n is a, c, g, or t
aanttcaaaaacatatatattcagtaattttcttaagtatattttattgtaagcataacctnnnaatagtttgctctatttaattcctcaagnnaaattnggngggggttaaaaaagannaatttttctgatcaagttcataaaaatgaaaaatcaagaatgttggttggattttataaaaggctttaatttctntacttgaaaannttaataattttaagtatttnagtgcaaagcagcattttctatgtnatcaactttttctattgtgaattaaaaatatatccaactcttattttgcaacttatttatgaatatcgaacttcaataaaaatattcattattgtgcttnggtcttggcattggggggnggggtagttgtggtagaagataggatttggtggtggttacncaggaggtaattttnaagagctctgttgaggattctaatatnncctttatttttaanatacctcactgtagaccagaagcctaacagcccctttaccaaaattttcaagtaatttgtaaaatgaaagtnatcacttttctgtatgcangccaattctggcactttctaaattagatcatatgtacaaatctttnngnttntttttttactagtctttcacttctggntgancatttttctttctgctttattgcaccactttactgctcatnaaaatcactaattcttcctgattaatntgaaatcaaatggcaatgcaaaacatatncatccaatgtttctcctactttngnanagctttggccaaagcttttattattcaatatggtggtgggaaactatcataatgcatgtggtcatntgcctaagtgagctactttgttgcgggacagaagcggataataggagcataggtaatggagcnaaca

SEQ ID NO: 725152 - DNA, 327 bp, Homo sapiens
actttggcgcgagcccagctgataccctgtgagagggctgcttagcagggcatgtgagagcaccacaggttgcaaagtatgtcttgtggattggcaaagtgcggagggtatccacccatgggggtagtttaacatggggcgtcagcactctcaccccaccttgaccttcatcatgttggttcagttccatcaaggtgttacccccacagttaggtcctgtgcgtcctgacaacgtcatctgcagtctgggaacagtatccctggtacatcacaggaacctgacagatggttggcacaccgtgaacgtttgtgaatgacaaaaaaaaa

SEQ ID NO: 725153 - DNA, 1021 bp, Homo sapiens
ggttgagacgctaagcagacatcaggactaccagctgcagagaggagctacccgactgtgggcttcggtctctgctgagatctgaacactcactgggacgccctgccctatggaaaccagctggttcactctgggtctcctcgtgagctgtggctgtcgctcacgggtaaaggtctatcttcgtgctgtactcgaccaccgtccatttggtacctgccattacctaccttcatcctggtacacgaggacaagagactggtggactgtgccgggtactggatggagcgtaaagactaggcatgctaggacagcaaaacaggagttggaaaacactgcgcgccgttgactcgccgaacgattgatgagatgaccaagaggggagcgcgataggaaagggagagcaagcatctgcgatcgcctgtgcggcgagaaccccaggacgtaaagagaagatccggagcacgtcgcaaggacctgtggaacgacccattctcgtgggggcttctgttgggctttccctgggctgtctccagagacgtactggagccatgctcgcgtctattcctccgggtaagtccaagtgtcgttggaaagtcgtgctttgctgtcaggacgtcattggccttagtgatccaccacaagggtctggaatgctagcacgagtgaccagatgaagtcagcagcctaatagctgaaaagcgctcttgccgtttcatcaagggctatcaacgcctgaagtttctcggttcttgctccctcccaaagcccgttcctggtgattagtgaatgcttgcgcggaaaatttccacccaacgatgtgagttgcacggccacagtttcacgcttggaatttgctcccaggaccccaattggcacgaaatcgacgctcgtgtgggaccatttcgccatccactgagattaagaggaaaaaccggctttggcccccaaacaggttggtttaggaaccttacaattacacgttgaaccgagggggtttggggaacaagactggaaacccccc

SEQ ID NO: 725154 - DNA, 383 bp, Homo sapiens
ctcttttacaagaagaaacattatgatacatagatgctgaagtttattgatacacccatccatctgaacatattaaaattttactgtatgtataaaatggaacatcatctaggccactgctgaagactaagttcccaggaagaacatacctgtaaaacatatcctctaagtcattgagggtctttgtgattctctatgcttacagctatgtcctgttagatcttacaagacttatttacagcaagaatcacaaacagcaagggataaaagtacctgtcgagtcaaagcgcaccaagagctgaggtcctctgccatgcagcttcttccactctcgagcccccagcacctgcactgcctggcagtgcatctgagggggacaaagg

SEQ ID NO: 725155 - DNA, 768 bp, Homo sapiens
tggaagatggtggattttttcctgggggataatctatattatatggactccctattacttattataacccggggttggtatgggaaatgtgtctactatgcgggggaaaaggtctctcgtaactcgcgtcggggggaaactcagggctcgtgccgctccgtgccctcttcgtgtgtggccggtgggataccacggtgggccctcgtggcgggtgagttcctccaatgtttcgtgccgtagggcgccgtgtgtgcgtattacctttctcgtggtgagcggagatatagctatagaacatccttgtgcaaaaggcgaatcacgttcacaaataaatgtggggaacactggcgtgctcccagaaaggattgccctccgtggcgtcatcagagtgactcctctccctcgcggccatcgccggggagcgtggcgagcgagccgaagcgggttgacccgtcggccccctctgtggggggcagcgtgccagacctccacccagctggcccaccgacggggccccagccccagggcctatcctccccgagaggcacgacaaagcttctgggaaaaacctcaaatctttaattccttctccttcgccgggtgcagccagagtgtgagacacctgagcttcaaaacacaacctgggtaaaaacagcccagggccgaaagccgtagagtaagcgcaggggggggagcccctctccaaacccctcaaagtgctggggatggcccccaaagggggcccaaaaccctggaaaactaaggccg

SEQ ID NO: 725156 - DNA, 211 bp, Homo sapiens
gcaagcagttaatacagactcagctaattttgtatttttaatagaggtggtgtttctccatgttggtcaggctggactcgaactcccgacctcaggtgatctgcctgccctcggcctcccataactgttgggattacaggtgtgagccaccatgcctggcctaataatggctttttaactgaagctagtttgagtctgtattaactgcttg

SEQ ID NO: 725157 - DNA, 927 bp, Homo sapiens
tttgcgtcgccggagccgagccagatcgctcagacagcatggggaaggtgaaggtcggagtcaaacggattggtcgtatgggcgcctggtcagcagggctgctttgaactctgggtaaagtggatatggttgccattaatgaacccttcattgaactcaactacatggtttacatgtttccacatatgattaccatccgcatggcagaattgctcgatggctaccgtcatacgggctgagaacgggaagcttgttcagtcaatggaaatcccgatcaccatctatactcagtgagcgagatccctcccaaaatacagagtggggctgatgctaggacgctgagtacgtcgtggcagtccactggcgttttctaggcatccatggcagaaacggctgggtgactcgatttgtcatgtgggggagcctacatacagggtctatgcattcgtctgacacctccgtactgcctgatgccccccatgtatcgctcgatggagttgtgaagcatgcagtaagtatgacaagcatgctcgtcaagatcatcagacgaatgcctcctgtcactcacacaaatgcttatataccctgtgaccaaggtcattcatgaccaacttatggtatcgttggcaaagcgagctcattgaccacagtactcatgaccatgacttgaccatctagtaaggacttgttgtgatggctcgctccaggggaaaactgtgggcgtgatggtccgtggagggttcttccaaaaacatctatccctgactctaattagggtctgtcaaaggtgtggggccatatgtcaattccctgatctgaatcgggaagcctcacatggcatgggccctccgtgttcccaaaggcaacgtgtcaactggggggacttggactgcggaaaaaaatcttgcacacttttttgcactccga

SEQ ID NO: 725158 - DNA, 188 bp, Homo sapiens
ctgatagagatagttcacttgtttctgatacagattaacattaaagattggttggagaggggcccttcataatggtcttgaactttacattgaaggattatatttgcctagaacctcatgccaaaacactcaggtgaatatggaatgatttgcaaatgcagatcaccacatctgagatacttttcttt

SEQ ID NO: 725159 - DNA, 1492 bp, Homo sapiens
gactagttctactactcaaaggtcttgtccttttgcaaactacataagttaatccagctcatataccaaacaatgcatgtatgaggaatagtctgacaatagggagaaaacacctatcatgctaagaccagcctttgctaagatatattccagcccagcatactcttcatctattcaatactggagtggtctgtattctgagcgaagagacctgctcggttagtcattccatgcatagcgtttggcaggttacccaacccaacacaccacattcttctatttatgccaggcctggtggcgtaggataattaaatgactggccatagtcagaaaatgatcaagtgaagagctaaacgtgggttgggtaaaagtctcagactagtactattcgtcaaacacatccatgctaggctaaatatattatttggatgaggcaatcatggctaagaacacttacgaacatgataatcattagcccaggctaggattgcggtttacttcaaagtaaatataaaagtacgatcctatatccggacacatacagataagggggacagaggtaacccaagatataacgctttaacacggacagaagatataatgacctgggctccagaggcctatatgtatccaaagggccagttgccatcttagaccccaagggaatgcagaaaaaccaaaacaaaaaaaaaacactgcacgagagacagagcccagcgaaacattaacccaaaaagggaaaggggacccaaaaccacaaaagtggcaaattgtcaccaaagccaaaaaagaacacataggggaagtgaccacaaaaagcacaacaaaagggaaacaactaaccacggccacaagggcacaacaaccaaacaaaaaaataacacgaaaaagctaaaaaaacccggagccaagaaccgagaaaagcaaaacggaacaacaacgggaaacggagaaaatagagagacacaactaaaacaacacagggacgacaaaaacaaaagcacactcgggaacaaaaaaaagaacaaaaacaaaagtaatcacacgcgagcgcaggcaagaaccaaaaaaccacgacaaccgaaccacacaaacatagaacgcactaacaaaacaagcaacacgagcgaaaagaaataacacaggcaaacaagaaaatgacgccacacagcaccaacagaaaattaatgacacaacaaaaaatgaaacagccacaataaccacaacgacacaacacaccaaaaaagaaaagaaaacacgagaaaaagcaaacaacaaaacgccaagaaaaaacaaacaaaaaaaaagcacaatcaaacaaaaaagaaaggacacagaaacaaaaaaaaaacaaaagagacagagaaccaacacacacacaagacagagaacgaacacacacacgcatagaaaaagacgacagcagacaggcaacaacaacgccgacaacgcaacaacacacagacaagaaaggaacgactctggagccacg

SEQ ID NO: 725160 - DNA, 807 bp, Homo sapiens
gcctctaccttagcgagcgctggagttggaatacggcgggacagtggctgtcgcacgccaaagctttccctatggcttcggtgaccaggccggtgttggagagctgccctcgtggtaggagggacacgtgggagtaagttccagcgtgcagattcagacgtcttgagaggtggacatcatctcctggggcctgcacgatcatcggccctagaggtcataacagaggtaggcaggggagagcctcggagcggtggtgcttgagggttcgcctcgagtgggatagggataggctccaaaagcagcacatactattggagcgagctatgggagggtggccagaacgaatcgtctggaggatccttcaaggtggatggggaacggagtatcaccttggcgattaaacaaggagccgcaacatgtcttgcatgggagggaagtcagaggggtcgtggtacaggtgctctagcgaccccgtccgggtgactgtcaacagtgggtgtcccgttctcgcagcagtcaggtccaagatggtgcaagaaggtaccgcgagaagacgtggaaggagtctggggtgaacgatactggcacctggtatgggccggtgcagcaggcgtccactttatccaagttgaaacagcagccgaacatatgcccagagcaggacctacaattgaagttcacaaagcggacgcacacgcgaatcccgttagctgtcaccgccgggcacaggtcccagggctgggctcccataatagtagttggcccgtggacactcaccatacaaccgcggactggtccatctggcct

SEQ ID NO: 725161 - DNA, 213 bp, Homo sapiens
  misc_feature (112)..(112): n is a, c, g, or t
tcctctcgtcgatccgacctggcggttcatgacgctcgacaccgacggcaagattcgcatggattgctcgtcgcccgacgcgatggcctcgcttatcgggattcgggatcgntacgacatcgcgaccggaaacgacgcagactccgaccgccacggcatcgtcacgcccgacggcggtttgatgaacccgaatcactatctcgcggttgccat

SEQ ID NO: 725162 - DNA, 683 bp, Homo sapiens
  misc_feature (1)..(1): n is a, c, g, or t
  misc_feature (236)..(236): n is a, c, g, or t
nccgagtcccaaacttccattgtgatagatagccaagccttggctaatgtttgcttccacttggcaaaccctgtttttggggggcacgtgaaattatacttctcatccctaattctcttccgttgaagttttttcaagactatccacctaacaagaatgtgttgttaagcactttggaccattctggcacttgtcacatggaataatagatgtctgttaataagtttgtcctttcntgaagtgtgatcccgtccagggagtgtcaagagcagtgctttgtcatttacaaatcttgtgtccttgggaaagttactaccctctccatactgtttctttctctgtaaaatggagataacagtagtgcctatcatacagtaccaaagtgatgaacaagtgagatatttaataagtctttagaacagtctggcacagagtaaacacctgataaatgttggccattatcattataaaggtactatgcctggcagatattaagcatttagcaaatgtcaggttaaaattgtatgtatcatctaccacacagtgagatgtctgtgaatattgagttcacaaacatttttttcagtttaaaaaatatttcaaaaacattttgaacaaacactcaataaaaccacatttggatggggtgggcctaaataagaaagagaggatagagctttagt

SEQ ID NO: 725163 - DNA, 1173 bp, Homo sapiens
ggtaccctgcatccgctgagatgtgatgcctaagaagaatcggattgcacatttatgaactccgtttttagatgcgagaggagtcatggttggccaagaaggatgtccatgatgcctaagcaccgcggtagctggtctgactaagaatgtgtcctcagatccgttcatgtcttgaaggtccatgcaagtctctcatgtcccgaggctatcgtgaaggaacagtttgcctggagacatttctactggtaccttaccaatgagggatatccagatatctccgatgattaccttctatctgccacccgtgtagcattgtgcctggcaaccctacgaccgtcagccggtccgagaaactgggccaggtctcgtgcctcaaaggtctggaagggtgagctgacctcgacgcagtactacacaagcatggggaatgcttgtacgagaggatacctaaccagaccggagttgctgttgcctatctggttgtcctggactaagtagaagcccgatgtcttcggggctgggttcgtgcaaaccccggaaagtacacgatgtttgttaagaaagagccgcgactataggtccagttcgagacggttgggtccaaggcctgacgccttcaaggtaaacaaagttggcgcaaggaagcgcctctcgtgtgcaggcgaggttcgaatacttcaatagctttaaacatgttcgagaaatataagcgtttaaagcgacacgttccaatttggacgacaaaacaaaggttctccagtgggcccaatttcgaattcttggcccaatgccctcaatgcacaatgcaaccataggtgaggccacttggggccccccataccccgcggagggacaaaacttcggtttgggccatgattgacattacggcgcctaaggaccaggtgcgagacattccattcccaagtaaacacaaatttcgaattccccacttgatacctatcattaacactcgggtcgcggcgttggacccaccataagtgtatcattagagactgcggcgtagaccaacaatggtatacaaaatcacccgaattgcaaaaggctttgagcaaccactggtgggaaaaaagcggattttccatcgttgtgcgcccaattggatgcgcccatatcacccgggttgtctacacccgctcgcttgtggcgcgagtc

SEQ ID NO: 725164 - DNA, 840 bp, Homo sapiens
  misc_feature (179)..(179): n is a, c, g, or t
  misc_feature (188)..(188): n is a, c, g, or t
  misc_feature (247)..(247): n is a, c, g, or t
  misc_feature (256)..(256): n is a, c, g, or t
  misc_feature (313)..(313): n is a, c, g, or t
  misc_feature (339)..(339): n is a, c, g, or t
  misc_feature (370)..(370): n is a, c, g, or t
  misc_feature (413)..(413): n is a, c, g, or t
  misc_feature (421)..(421): n is a, c, g, or t
  misc_feature (441)..(441): n is a, c, g, or t
  misc_feature (443)..(443): n is a, c, g, or t
catttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaacaacaacaataaatagggcatgtgaaangttaagttncagcaatagatatttattggtattccaggtagtactttttggtttatatcacttataangggtacagnggtactcttggtcacagctcagttgggtaaccgcattccattgaaaagttgggcctngtaaaatacaactctcatttaatatncatgctttggtgcctttaagaaaatattttngtcatttttggtggttacagaactataaggtgatccaggggtnataggctngtcataaaagggtcatttcngngtgtacttccttttaatatagctatagtatatttaccaataatactatctttaataggggtggctatttacctattctttactcagacatggatgtagactgtcagattatcctgagtatgtaacagggccttttcgatggaatcacacttttggtgtcaccttgtgccatatacacacaaaatctgtgtggaaggcagtttaaatttcgtgaagaatatcctcgtcaagaatttaagaaaaccaattggtgttcaaatcccatctttccagtggttaagcattttctagtaagcagggagggtttgtcgtggaccataacaggggaatgagggcttattggtaaggcaaaatgagatggcgaataattggaccatattaaaggtgcgggaattaaa

SEQ ID NO: 725165 - DNA, 1248 bp, Homo sapiens
  misc_feature (189)..(189): n is a, c, g, or t
ggcgagaacgatccccggaccgaccaatagcccggcgtcgccggtgcatcccggcgtccagtcgatcctacatcccgctgccgatcgccgccgaccaccaatgtcccaagagaaaggctgtaaggggatgctaagggagatagagagcgaaaggtgaaggacgaaccacagagaatgatccgggtaggnttgtctgtcataaacccatgtctccgtccaaatgccagacgcccaacgcctaaaaaggccgcctgcacatgaagggagaggaatggtacccaatagggaacacacagggaaacagctgatgctggcatagggaggggaagtaactcgcatgcagaaaagtgggatgatggcatatacagaccaggcatagaaagctgaaggtgctggagatgccaagtgaagtgtggtgcgatttctgataagctcgtgtagcttgctggtgagtggtacagtttgaagatagctagttgtatttgatcaaggtttgtataatgaatgcagaaattgggtctttacttgttttgtttctctgtaaaagctcatgttgtaatgcacgatcgagaacatgttcattgggggataaggagggggaaggggcctatgtccctaacttgacggtctccaaggccgggcattgaatggggagaaaatcagctttgccccggcctccaagtgacgagagactttcctctggagctccccagacgagggagcggatgcccactgactttgatacgcagtgggcaccccttggggaatagagccctgtgggttattcgccaagaacacatgtgggggtttgaaggttacccccactgcccttttcacactgcttccggaactgaaatttaacctccgttaagacccaagaacctctgcgttgaaaacctgaacgctaaactggggtcacacagtcgtcacggacatcgggaaaccccgaggagacccctagtagtgcccgtccaaaaagagtgcgccaaaaacagggggagacctagcaagaaagtgaggaatgaaataaccggtgaaggtggggggaggatgaggagggtattacaaacactaggaaggatagacccacaaaaatgcgtggaacgagaaaaggagctagtagagtatggtaacagaagaagaagaggagtataagtgatcaccagagttgtagtctattgacgtgaccaggcccacttttttctgtcaggatgtgtgttctactatcttcttttttttcatcgcgcg

SEQ ID NO: 725166 - DNA, 418 bp, Homo sapiens
actctaggggctagtacgggtagtaaaaaaaaaaaaaagatacgtaacacataatctttggtgtcgggcttcttcacggagcaggttttggcggtcatccaggttataacatttatcagcacttcatccctttccatagttgaataatatgatggaataaaaatatggctttatatgtataaataagaatgcaaatgtggccaccggtttaagagtttctggacctcacatgattactttagggttatgagtccaggtttaatcggtggcctactagatgtggtgtcagggcttaaagatcccatatccataagacaatttttttcacttctatggtagacgggtaaatccccggcgggagtgaatcttttatcattggcttatgatctagaagcaaaagcaaacagttggcccctgg

SEQ ID NO: 725167 - DNA, 243 bp, Homo sapiens
acaccaagcagtatatatcacacacagctgaagcaacatctctgcagtggtgtccatgtgtgtgtctatgtgcatgtatgtgtaggaggataggtgtaattagggaagggctgcccgaacaacatggataagtccatgcaagacgtctggctgtggtgggtaccacagaaacatacacagtcttcatatacaaagtcttcaggggtatgtcttctagcactttccggcgtcggggtctccatg

SEQ ID NO: 725168 - DNA, 173 bp, Homo sapiens
ggagacacgtggatctcgatggtgtattgattgtccaggccgatttgggtgcgtcgtaggaatacgccggcatgcgccgcacgcggcgctggcccgggaagtaatagaacgtggtggcttgctcgccggccttggtggtgaccaccccggcttgtccggcaagcgcggcgggg

SEQ ID NO: 725169 - DNA, 138 bp, Homo sapiens
ggctcttgaggatccccgtggagtctcatgacatcggtggatatacagaaactgaggaagcagaaaatttggaagatttgctcaaagcagcagagaagcatgcatgtccagcatttcaactgattcatcagttctccg

SEQ ID NO: 725170 - DNA, 974 bp, Homo sapiens
gtgaccgcgcctgtgtgctgcacttcgggccattctggagttcccggctggcctgggcctttgttggtccccgcattcagactagtccagtccaggccttgcttggccccgtgcaatgcgggacttagcacctgggcccagtggcttcgtgaggctgttactgagtctctctagcagtgctggccaaccggcgctgcgctcgattctcgctgggcttggctgccttgccacggggcagggctcgggactgcagcccgcaatggcctgagcctccttacccaatccatgggctcctgtgcggcctgagcctccccgacgagcaccaccccctgctccacggcgcccagtcccatcgaccacgcaagggctgaggaatgcgagcgcccggcacaggacctggcaggcagctccacctgcagccccagtgcaggatccactaggtgaagccagctgggctcctgagtctggtgggtacgtggagagtctttagtatctagctcaggggatttgtaaatacaccaatcagcaacccctgtgtttagctcaaggtttgtgagtgcaccagtcaacactctgtatctagctgctctggtgagggcgtggagagtctttatgtctagctcaaggattgtaaatacaccaatcagcactctgtgtctagctcaaggattgtaaatacaccaatcggcactctgtatctagctcaaggtttgtaaacacaccaatcagcaccctgtgtttagctcaaggtttgtgagtgcaccagtcgacactctgtatctagctgtcctgatggggacgtggagaacctttgtatctagctcagggatttgtaaacgcaccaatcagcgccctgacgaaacaggccactcggctctaccaatcagcaggatgtaggtaggggccagataagagaataaaagcgggctgcccgagccagcattggcaataacgctcgggtccccatgtcacac

SEQ ID NO: 725171 - DNA, 978 bp, Homo sapiens
ctgaaggcagctaccttaatagatgccgggatccgcagcgaagggctcggagttgtcagagaggatcgagagcttcgtggtagaccctgaagcggggtggtgggccgcgcagctccgaggaaatggctcgggagaccctagggttgctgcgcctagatcatcacggaccaccgctggagcaacgcgggggagctgatggagctgatccgcagagagggcaggagagatgacggtccgctcagccctccgaagaaccgaccgtggagcaacatggatgctgagtagtagatgctccaagcattatcccgggaggcagtatggcagcacctcctatggacagcagctgcacgagagctgatcaagcgaggagttcccttgctacaaaacttgtttgacaatcccggaggccttaaacgaggatttctagcttccaattatgccccaacttcccagtcctaaccatcattgaggcagattaatgagctgcttagtgggaagctggcaaagggacaatggagaacattgcagcccagggctctggagcacattcacgtccaatgaggtgatcatgaccattggcttctcccgaacagtagaggccttcctcaaagaggctgccgaataaggaggaaattccatgtcattgtagcagagtgtgctcctttctgccaggtcatgaaatggctgtgaatttgtccaaagcagcgtattgagacaactgttcatgactgatgctgccatttttgccgttatgtcaagagtcaacagggtgatcattggaccgagacatctgggcaatggggccctgaaaactgtgacaggactcacctctggctggagcaaaacacattcaccccattcttggctgtgcgccttgtcaacttttcccagtccctgaaagatcactaaaattgggcgaaaaaccgctcaaaggcctgaagcaggtccgtgagaacccccactccttccaggaaccac

SEQ ID NO: 725172 - DNA, 1548 bp, Homo sapiens
gtggccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgacccaccacaacctccagcctcccttttcagagcacagcattaaagtttggggaattctgtaaaaaaaaaaaacaaaaaaaaaaacaaaacaaaaaaagggggggggcgaaacaaaaaaaccccaggaggggcgacaaaaacacggagacacacatcatggacaaagggggcccatagagagggcaggagacaacgcaggagaggcgcaaaaacaacacgcggcgagcaaacgcgaacgggcactgggaggaccaccgcggcggcacacggccgaccaccccagacatacccacagggcaacacaccaggtaccagggcacaccccgacacccccagagaagaaccggatttaatagcgacccagagacacacagcccaagcaccagaggggcccacacaaggcgagcgcgagagcgacagcgcagcgacgaccgcacgccgccgcgccggcacacgccacgcccgaaggc

SEQ ID NO: 725173 - DNA, 1569 bp, Homo sapiens
gtggccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgacccaccacaacctccagcctcccttttcagagcacagcattaaagtttggggaattctgtaaaaaaaaaaaacaaaaaaaaaaacaaaacaaaaaaagggggggggcgaaacaaaaaaaccccaggaggggcgacaaaaacacggagacacacatcatggacaaagggggcccatagagagggcaggagacaacgcaggagaggcgcaaaaacaacacgcggcgagcaaacgcgaacgggcactgggaggaccaccgcggcggcacacggccgaccaccccagacatacccacagggcaacacaccaggtaccagggcacaccccgacacccccagagaagaaccggatttaatagcgacccagagacacacagcccaagcaccagaggggcccacacaaggcgagcgcgagagcgacagcgcagcgacgaccgcacgccgccgcgccggcacacgccacgcccgaaggc

SEQ ID NO: 725174 - DNA, 540 bp, Homo sapiens
cagagtattacgtgtacacgctttaaataattacaaagtcatgtctccatgtaagtttatctgaaacccatcactcagtgtttgctgcaagcccaagctgtgataaaacacccatcataaatttatattaaaactctgctcgatagcaattatttaccaacaaagattatcgactgcattagagactgggggtcttaaccaggccaatcagtctttgtatagagtctcatttaccaaatgctgccggcctctgctcgcacagggatcatcgttacacagagggaacatttcatggctaagctcctacggggtgatgggagcaacagtctcaacgcagggcggcgccatgtcaagatcagattatcaacaggcacgtccacaaccactacgcctttgctctgcgggcagcattcctcatcggctttaaaccagacaccggggggccgtgcatgcatctgacttgaatgtacaaggacgggtgcacgtgtgatttcgcactgagactcaatgaatcctcttgctgctgcaggagcgctaata

SEQ ID NO: 725175 - DNA, 1241 bp, Homo sapiens
gtggccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgacccaccacaacctccagcctcccttttcagagcacagcattaagttggggaatctggttgacaagacaggagtgacaacgacccaccagcgaagaaggtggacatccgcagaccgaacgaacagagccacacagaaacaagg

SEQ ID NO: 725176 - DNA, 381 bp, Homo sapiens
caaggcgtatattttccacattggaaaacctcgcggctatttattgataggacatatgggttgatttctagtcttatgctaatatagtgaataatgctgcaataagacatacgtgtgcatgttgtctttatagcagcaagatttatagttctctttgggtatatacccagtaatgggatggctgggtcacatggtatattctagttctagatccctgaggaatcgccatactgacttccacaatggttgaactagtttacagtcccaccaacagtgtaaaagtgtatcctatttctccacatcctctccagcacctgttgtttcctgactttttaatgatcgccattctaactggtgtgagatggtatctcattgtagttt

SEQ ID NO: 725177 - DNA, 1666 bp, Homo sapiens
gtggccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctgcttctggagacatttctctgccaaaccaagactggaaaccattgagctcacctgtgcactttgcaaacttcgaagtgcagcgcacagggcaacagctgggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgacccaccacaacctccagcctcccttttcagagcacagcattaaagtttggggaattctgtaaaaaaaaaaaacaaaaaaaaaaacaaaacaaaaaaagggggggggcgaaacaaaaaaaccccaggaggggcgacaaaaacacggagacacacatcatggacaaagggggcccatagagagggcaggagacaacgcaggagaggcgcaaaaacaacacgcggcgagcaaacgcgaacgggcactgggaggaccaccgcggcggcacacggccgaccaccccagacatacccacagggcaacacaccaggtaccagggcacaccccgacacccccagagaagaaccggatttaatagcgacccagagacacacagcccaagcaccagaggggcccacacaaggcgagcgcgagagcgacagcgcagcgacgaccgcacgccgccgcgccggcacacgccacgcccgaaggc

SEQ ID NO: 725178 - DNA, 570 bp, Homo sapiens
gatttggggccaggacctccctatacacacacacatgcacgcatgcacgcacgcacacacacgacacgcacgcacacacactgtcctgtaaggttgaaatttggggccagtacctccctacacacacacacacacacacacacacacacacacacacagcgcacgtctgctctctgtaccatcctatacacacacgacacacggctgtcgtgtcaccgtcccatacacacacaacacacacacacacacacacgctgaacctatataggtggctcttatctcctcatatacacacacacacacacgacacaacacacacgacacacgacactcttgactatatctctctctacacaacacacacacaacctctctgatcacttcactgctggcgctctatctcatagtaacaccacacacatcagcacaacacagacaccacacacatgctgtcttttctctccctactcatataacacagcactgctgctgtttgcagtagcgtagtatgcatgcctgctgtctacaacacgacacacacgaccctacacacgtgggtcgtctaccctc

SEQ ID NO: 725179 - DNA, 1805 bp, Homo sapiens
gtggccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctggcataaggattgcacaccctgcaggagctgggagggagacgtggaagtgctcatcagagctccccagggccttccccacagtgaggcctcagcactgcagcttgattttcacctttaccatctcttttaatctgttgagcttctggagacatttctctgccaaaccaagactggaaaccattgagctcacctgtgcactttgcaaacttcgaagtgcagcgcacagggcaacagctgggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgacccaccacaacctccagcctcccttttcagagcacagcattaaagtttggggaattctgtaaaaaaaaaaaacaaaaaaaaaaacaaaacaaaaaaagggggggggcgaaacaaaaaaaccccaggaggggcgacaaaaacacggagacacacatcatggacaaagggggcccatagagagggcaggagacaacgcaggagaggcgcaaaaacaacacgcggcgagcaaacgcgaacgggcactgggaggaccaccgcggcggcacacggccgaccaccccagacatacccacagggcaacacaccaggtaccagggcacaccccgacacccccagagaagaaccggatttaatagcgacccagagacacacagcccaagcaccagaggggcccacacaaggcgagcgcgagagcgacagcgcagcgacgaccgcacgccgccgcgccggcacacgccacgcccgaaggc

SEQ ID NO: 725180 - DNA, 1514 bp, Homo sapiens
  misc_feature (1514)..(1514): n is a, c, g, or t
caacgtgaagagggtcaagatatatacagtactaggccagatcctgttgtaagttctgcctgtgagagttgagaactgatgcatactcccaatcagaagtgagcacagaaagatctgtgactcttgaatcatacagctcatgtgttagtgaaaagtgttgatacatagataccagtttgaatctgtgagttgccccgttatacatggtgttaccctcgtcacctcttcttcgtctgcggctctataggataccgactatcgcttttacgttatcgcccgtatgaggtcagtacattgacttagactaaggctccaatcgtgtcctactgaccataagcgtgattctaaatatgatctggtcaattgcgacttcgtcttgtcaattcagctcgtgcgatgaggccctcgagtacgtatccaagccgatttcatcaatcccgaaaaccccctcattgagacgctcttcaaccctgagctggcgagttcgcactatcatacaatgacactcaggccccacctgtgtagcatatatcgagtgcccatcacgttaagcctatatgcttgccactgaaccgatatgcttcataccagactaatcgtagaagcgacaagcgatccatgcgagtttcggttcaattcacttagccgtgccggatccgttcgtccacaggcgcacctttgtcataagaagcgtccttgtcagttcccccaagcgttagagctacggcgcttcttgtgcggaactggaaggctgttctcgttaaggaaaacacgaggcagccatccggacatgtagaacgcgctagtacgggcaccttattaccaggccgccgcgtcaagagtgtactgactaagccgctccgtgaacacgtcgaggtgaatgtgaacacccgttctctccgtttgccgttgccgttaacacccttcaaacctcaatgctgggttctgcactccacgacgttaggacactttcgagctacggcctcagttcagagagcgttccttaggcgacactaacactttagagaaccaacagaggcgacaccgttccggaacggcgcactcagccactaagcggctgcacatcaacgggtgcgcccggttaatgtaagcagtgccgacgcattacagtgaacgcaaactcaagttgcaacagcatcgagtcagctgagactcatctatgactgcgcggcgctgtctttcattgactgtcgtaacaccagcgatggcgcgacccagtgcgataggcgcgcacgtcattgcaagagaagactacgcgcgttgcgcaatcttgccgcaccacccggggaactggagtcgtacggacagagacgtccattcgcggatgcgtgtgccctagtcgaccgacaccctctgattgcgcccacgcgatcgtcgctgcccatgcgcctgtgaattgccggcgtaccgagaccctccctcggatagcgatggcgatgtcgactcgggggggttgattccgccgcgcgcgtgtgcacgcggcgcaagcatcn

SEQ ID NO: 725181 - DNA, 124 bp, Homo sapiens
cacatcatgtcatacagcttcttcacagctgcttaatctggtgcttgttggctttaacatcccataatgaacacaagtgtgttgttgtcttctatccatcttccatggccagactccagtggtc

SEQ ID NO: 725182 - DNA, 1645 bp, Homo sapiens
gtggccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctgcttctggagacatttctctgccaaaccaagactggaaaccattgagctcacctgtgcactttgcaaacttcgaagtgcagcgcacagggcaacagctgggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgacccaccacaacctccagcctcccttttcagagcacagcattaaagtttggggaattctgtaaaaaaaaaaaacaaaaaaaaaaacaaaacaaaaaaagggggggggcgaaacaaaaaaaccccaggaggggcgacaaaaacacggagacacacatcatggacaaagggggcccatagagagggcaggagacaacgcaggagaggcgcaaaaacaacacgcggcgagcaaacgcgaacgggcactgggaggaccaccgcggcggcacacggccgaccaccccagacatacccacagggcaacacaccaggtaccagggcacaccccgacacccccagagaagaaccggatttaatagcgacccagagacacacagcccaagcaccagaggggcccacacaaggcgagcgcgagagcgacagcgcagcgacgaccgcacgccgccgcgccggcacacgccacgcccgaaggc

SEQ ID NO: 725183 - DNA, 444 bp, Homo sapiens
gcagttctgaccttttgtatggtcagaaatatgctaactgttgtaatcaacagccccagaattttagtgctttaacccaacatacattgactgtttgcttatataattcagtgtgggtgtcctgggggtggctttctgcgggactcaaagacccagattccttacctcttgtaattccagcctctctcaagactttggagtcttttctgttcctcaaggagataaggaaaaggaagtgcagcaccaatacttttttaatgggtcagtcttgggagtggcacacttcttcaggtccagagacacgagtgtctctaatttcaaggaaggtgagtaaatatggtctaatctagagatgtggaaggggaaaaatatggttggatgagcatctagtgagttgctatgacagaagaaaattcactgaggaagttattttcttttggaaat

SEQ ID NO: 725184 - DNA, 1494 bp, Homo sapiens
gtggccgcaacgggcggggcggggccgggcaagtttgttccccgagttcggagcctaggagccccccgcggctgcggcgcaggtgccctcggcctgagtcgggatggagctgggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgacccaccacaacctccagcctcccttttcagagcacagcattaaagtttggggaattctgtaaaaaaaaaaaacaaaaaaaaaaacaaaacaaaaaaagggggggggcgaaacaaaaaaaccccaggaggggcgacaaaaacacggagacacacatcatggacaaagggggcccatagagagggcaggagacaacgcaggagaggcgcaaaaacaacacgcggcgagcaaacgcgaacgggcactgggaggaccaccgcggcggcacacggccgaccaccccagacatacccacagggcaacacaccaggtaccagggcacaccccgacacccccagagaagaaccggatttaatagcgacccagagacacacagcccaagcaccagaggggcccacacaaggcgagcgcgagagcgacagcgcagcgacgaccgcacgccgccgcgccggcacacgccacgcccgaaggc

SEQ ID NO: 725185 - DNA, 201 bp, Homo sapiens
aagaatataagacatttgcaggaagatggtgcaggaggagttctggaggtccaaaggcatgtgctggagttgcaggataaatatgaattgctctagttcatgatccaagccacggccaatcacatgacaataaaatagagactgatggcacatgcacccacgtacacacactcacactcacactattaagccttacgagga

SEQ ID NO: 725186 - DNA, 1220 bp, Homo sapiens
gtggccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgacccaccacaacctccagcctcccttttcagagcacagcattaagttggggaatctggttgacaagacaggagtgacaacgacccaccagcgaagaaggtggacatccgcagaccgaacgaacagagccacacagaaacaagg

SEQ ID NO: 725187 - DNA, 101 bp, Homo sapiens
gaagttccccgcgtgactcaacagacatctacaaatgccaagcctctgattgtcttagcagtcagtaaggaagaaagatcagataaggaagaggttagtcc

SEQ ID NO: 725188 - DNA, 553 bp, Homo sapiens
gtggccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcggggttcttcggtctctcagaccgtagtgctacagacgatgactcacagagcgcccagatccttgcagtccagaggcagatcaatcacgaggtactgaccaccgccgagat

SEQ ID NO: 725189 - DNA, 116 bp, Homo sapiens
  misc_feature (102)..(102): n is a, c, g, or t
  misc_feature (111)..(111): n is a, c, g, or t
gatcctattacaagtagtggaattaaatttgcaaatgatgaaaacgtgaagcacatctcctgtcccctgctcatcctgcacactgaggacgacccggtggtncccttccancttgg

SEQ ID NO: 725190 - DNA, 854 bp, Homo sapiens
  misc_feature (456)..(456): n is a, c, g, or t
gtggccgcaacgggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctggcataaggattgcacaccctgcaggagctgggagggagacgtggaagtgctcatcagagctccccagggccttccccacagtgaggcctcagcactgcagcttgattttcacctttaccatctcttttaatctgttgagcttctggagacatttctctgccaaaccaagactggaaaccattgagctcacctgtgcactttgcaaacttcgaagtgcagcgcacagggcaacagctgtgagtaatgtgaactgtaaccatcatgattcacgaccttgagaagcagggccanaatacagatttcttagtcacacttccccaagattctgagttggtgattctgggctgggacccaggcacctgctttcttaaaagcaaaagataagatggtttattcaaagacctattgaaccgaatggcactccacacctgccttgcacatgtcttctgcatgttacactttagtgaatgtcctataaatctaggaagcgcccgctgcatgcaggggaaagcaaggcccagtgggtttggtaataaatgaggtagactcagtccccgtccccctgagtcttccttgcaacacagcagggtgacaaggagcatggcctctccagccagactccaaatcccagccccaccgctcagcaactgtgtgaccttggcgagttactaacctcacttgggtaaggc

SEQ ID NO: 725191 - DNA, 257 bp, Homo sapiens
tactaccagtgtgattcattataacagtctccatgtcataagtgttcaaggagttgaggcccatcaggagacccacattcgggctgtccctggatgaaaattatccgagtctgtactcggaaaatgcctgttctgaccccatcctttgaatccccatctagccttgggcttgcctaggccactgttctctgctgagtgccctgaccaggagctctgtactgtttccaacaccatgttcagtccccgcccgcgggccg

SEQ ID NO: 725192 - DNA, 262 bp, Homo sapiens
tcggcggcgaacctctctgtcagcctcgccgctgggaggccggggcatcgtgatgagccaagaactcttccaccttccgagcggagagaagttccattcctctccctcttcctcctcctcttccacctcctcctcggcctcctgtgctctcctggcccaggaccctgccatggagacaggcctgagcatgtattccgatgactttggcagcttcatgcggcccaactcggagcccttggccttcccagcccggccctggttg

SEQ ID NO: 725193 - DNA, 389 bp, Homo sapiens
  misc_feature (68)..(68): n is a, c, g, or t
  misc_feature (195)..(195): n is a, c, g, or t
  misc_feature (355)..(355): n is a, c, g, or t
  misc_feature (365)..(365): n is a, c, g, or t
aagcaagactccatctcaaaaataataataataaataataataataataataataataataataatantaatccttccagctgggcgcagtggctcagctcaggtgatccgcccgcctctgcctcccaaggtgctgggattacaggtgtaagccatcacacctggccctagtgacaggtttttatgggtactttntagatgatctaagaaatcatgtgcatatatctttcagatttttattttgggaaaatgaaggtttctacaacatagttgtttcagtgttcaaataaacctgaaggactcaacatttacatttgaactatatccttcctagtgggttaagtgtgaaaaagantttggcttgnttcctaaaaactctgccaagccct

SEQ ID NO: 725194 - DNA, 805 bp, Homo sapiens
gcgggagaggtgcgggccgaatccgagccgagcggagaggaatccggcagtagagagcggactccagccggctggaccctgcagaccctcggcctgggacagcggcgcgctgggacagagcgcccaatgagagcatcgagacagcggaacccgcgaagccaggcccgaagatcgcgagcgcgtgcagccgtggcgcgtctcccgccgccggtccgggcagcatgaggcgctgcggagcttctggctctggctgtgcgcgcatggcgctgagcctgctagccgagcctgcggcagattgtggctactattttgccccctgaagatcacgatggctctggggatgactctgacaatttctccggctcaggtgcaggtgctttgcgagatatcaccttgtgacagtagatccccttcagttggaaggacacgcagctcctgacggctattcccacgtctccagaagccaccggcctggaggctacagcttgactccagctccaccctgccggctggagaggggcccaaggagggagaggctgtagtcctgccagaaagtggagcctgtgctcaccggccgggagcaggaaggcatcaccgccgagccagggaggacaccagcagatcccgagcactcaatcagtgctcaaagacacacagacaagcacgagccatggagccagcaacgttccaaccgccacagggcacatgcaagctggcaacatgagagctcaaccctgaggaccagcaagctgacttcacatcccaaaagaggatggaggcctctgcacgagaaggctgtgagatg

SEQ ID NO: 725195 - DNA, 184 bp, Homo sapiens
gtgaggtctttgtggacgaagttgttgcaagatcgggatgacgaagttgttgctgcacacgccgatggatccacacttttaaggatgctcggaagtcagaatggacgaagttgttgctcacacgcctgaatgcccaaacgcctgagatggggatcctcataaagattgaccttgcagtgcatgc

SEQ ID NO: 725196 - DNA, 555 bp, Homo sapiens
  misc_feature (555)..(555): n is a, c, g, or t
tacaaggaacaccatcagttaactgtggttggagacatgacaataatctgcttgccaagaacacttgaaggaacccttttaccagtacgcttgaaggaacgagactcactggacccgaattacatcttgatgattatgccagatcacattatgtttgtgctacagatgttcatagatctgccctggtgaaagaactggagcctaataaatgttgaacctttgcttgtcacttttcagaaaactaatactctgctggtctgaatcgcctgtaccacaagggcacgctgccaactttcttattgtctagcgaataacacgataggacaaaggcagagatggtacagccaatgccgtagctccattatcgttgaggagagctcatgctctccaagcttgagtgtatgcggcaaatcaagagaatcgacccttgcattcacaaccatgtgcccctattcataaaattttggttcaaaaatctgtagggcaagtgtagctcaattgcaataaaacattttgcacgcagtggaggcttgggccagatcaagaagctctttn

SEQ ID NO: 725197 - DNA, 752 bp, Homo sapiens
  misc_feature (51)..(51): n is a, c, g, or t
ggtgttgggatttcataaaaaaagttaaatttggcctttcaagacccacgnaaaaggggccggggggggggtgcgaaacatccccttccctatgggggcagcttaaaaatactgccacccagatctggtagggtttctgggccaaaggttaggaaaagagttccctcaggggtgaaaaccaagagcccgttttaatgttgttgaggcatttggccggtttaaagccttttcttccctccccccaaaaattttgtttgcccaacttcaaacctggtggggtggtgcattcccttaggccccatttaaacataatttaggggccgtgacccctttggccgactctgggtcaggattttcttaggggattatattctccccgggcccggtcccgggaatttaaatgtttaagtcaccctaaatggattccgccccataaaatccaggggaaacccaggtggttgccttccctctgtatgttgcctgccattaaaaaggttaaaggcccggtttcccccccgcccctgccctgttttgccccttccccccgaggaaaaccaagccaaaggttccggggggggcctaagtaaaaaaaattgttaaaaaggggattcctgggtttttgccccttttgctttaagcccccggttgggttaaaaacttttggtctggccaaaggggggtttccgggggggaaagggtcctaactaatttgcccatttttttatcctaaaaaacccataaatctctagctt

SEQ ID NO: 725198 - DNA, 901 bp, Homo sapiens
gctttacttcggtctccggcggccgggctggggaagactggtgtggtctggccatgtgatggtctccatgccagatgcaggtgcgttgaggcgcgggcgtggcgaggtcgccgtgcgcaagccccagtcacacagcgggtcggtcctggccctgcccttgaggtccaggaagatacgaaagcagcgtgctaaggtgttgtatcccgcatggcagttgcgtgaggacgcagacgctgcctagcgataactcggaggaatcgaggtgtggagtcgactggcctgacgatctgggggatcgcgctaacccggtggggcggcggtggcggtcgtctccggactcagcgccggcgagatccttacggtcacctggggcccgcaggagctgctggaggcctcgcccgcgggcgtctcccttgctagtaccccgatctgggctgcctggtgtccgtttccgtgtccgcccgcgcgcctggtgtgaggtgcccgccgccgccggtccggtctgtgtgtgagacctcgggctcctgtctgtgcacgcgggcaacagttaagctggcgtccagtcgtccggggcccctgcgatcgtgcgtctggggccgcaggtggactaacacgggtgtgggacgccgttctggtgactccctgctgccgggcgtcttgggcctgagctgaagcgcatttccccatcaagaccgcgcggcgagcgggcccggcctctttgagtggctcatcgctcccatgcgcgcgaatcagttctaccgggcgacctatgggagcggcagcgggtgctggtgcggtgggaggatcagactaataccggggaatttttacggtgactgattcgttctgcgcaaagggagatggtcggcacattgcacccgcgtacgtacgggaggaacta

SEQ ID NO: 725199 - DNA, 398 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctcttcacacgcctgtagacaagatagagccgagaaaggtagagccgagacaaggtagagccgag

SEQ ID NO: 725200 - DNA, 291 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctcctcggctctaccttgtctctcggctctaccttgtctctcggctctaccttgtctctcggctctaccttgtctcttcacacgcctgtagacaagatagagccgagaaaggtagagccgagacaaggtagagccgag

SEQ ID NO: 725201 - DNA, 945 bp, Homo sapiens
aaggcgagtgccgcgcgggccaccatggtcacggacgagctggccaccaagctgagccggcggtctgcagatggagggcgatgggcggcgtgcgagaccccgggagcagcccgggcatgaacggggcagcgtgcggtctgcggcgggggcaccctgacgaggcggtcgaggcgctgggcagcgcggactgcgagcttgagcgcctagatgcgtgctgcggctcgcagacctcatggcagggcatcggcgagccccagatcgcgccagctcgcgcgcgatcttcttacctccgtaaaccgagttcaaggagttctcctaggaagcagatcaaggcacatggacgaagtatgttcaagcagtcatgatgccgggctgggactggcttcatcgacctgatggagctaaaactcatgatggagaaacttggggcccctcagacccagctgggcctgaaaagagatgatcaaggaggtggatgaggactttgacagtaagctgagcttccgggagttcctcctgatcttccgcaatggcggcggccggggagcttcaggaggacagcgggctgtgcgtgctggcccgactctctgagatcgacgtctccagtgagggtgtcagggggtcaagagcttctttgacggccaggtccaggccattcgacgtgtccagccgcttcgaggaggagatcatggcagaccaggatgacgtggacaaagcaggggaggatgatgagcaggtggaagcgggctcaatcggaggcttgccagggccaccgttttacgttagcaggggtgtttggatagcgaccgcgccttggctcccgggccccagttgtttgtgggaaaagggatggggctttagggagccccggcttagaatcttgctgcgtgtatagggagagcgcattaaaatataaggttttggcattgggccagatacaggcta

SEQ ID NO: 725202 - DNA, 275 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggaaacccactccacctactacgacaaggtagaccgagggggatcctcagagcgaagcagaga

SEQ ID NO: 725203 - DNA, 270 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctctcggctctaccttctaaatcgctcccaacaatatcctgccttattgatagctgcctaagcaaaggcttctgtcacacactcgtacactgacagcagtagagccgaggaccgagc

SEQ ID NO: 725204 - DNA, 1308 bp, Homo sapiens
gtgaacgaaccttatgaggtacgtggatagatttgcaaaaaatcaacgcagtcctgatgttaaattggagttagtggctgatgttgtgcagagaaatgatggaatagatgcagagaagaaggtaagacgattattgaattgtaggctatagtgctcgatttggggaagaatgcaaatgatcgatgtaacatagagagtgatgtatcccagcgtcctgggccatcatcaaggagtatcaattgggcaagatatgacatggtctgcttgagaaaagagctctcacagagaaatttggctcaatttgttcgcgcagaaaaaaggtagagaacgcgctaatttggcgagcattgcgtttatttcggcatcagagaaaaatgcatcagtacaggttagaagattctgtaagttttacaaaagagtaaattaatgtaatagcaatttgaaggtctggagaagtatatttgactaataaaattgaccttgttggtgtggttgctgaggcattttggtatctcggagtaatctgtatcaatttatatccaagggtgccacattggaacgaaattgagactttgaatgtagtcgcatttgtagcggtgcgaattctcgaagtggcttgtcggggatgaacgttctctacgatatggcgtggggaaaacgtgagctggaaaatagcccaaataatggataaacatgtcttcgcaatggcggtatttggcccttgtgggtggcgtgaccctattcccaataccaagggtatgtcttggagaacgggttcccagtccttttgtttccaacccatgttcgttgtgctgcccctggaaagaaattgaggctgacctgggggaacctccggttgggaacgcaagcgtaacctttggcatttcccccaaatgtggggccatggcacaatctatcatatatcgtgtacttgacgccaattttggagttcctcacagtccaaccgcagggaaggaaagtaaccaacagtgcgcgaggccaaacagtaaagcgacatttggtcggatgctcccaacaccattaattgtcccgaaaaaaaggaccccgaggaatttgccaaggcagagttcacaaacaagggacactttcaagtgctagggaagtgaatactacaaacttttttgtcaccaattgggggggttggttaactctgaattggacaaagacacaggttaattgggcgcacacccaaattggcgccctttggtgtggacatggacatctcctggaagagaatctcctgggggaggccaaaatggttattcctaacgacagtcaacaaggtct

SEQ ID NO: 725205 - DNA, 282 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctcctcggctctaccttgtctctcggctctaccttgtctctcggctctaccttgtctctcggctctaccttgtctcaggagaagggtctggactagagacatagatttgagagtcattagttgtcagca

SEQ ID NO: 725206 - DNA, 507 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctcctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctgtgttaaaagttcacgattgccagcttcccatgataacacggaaatcagcctcctgcctatactccgtcccaaatgcggcctaattatattgtaggttctattagcttttcttctcttcaagacattctgtcttatgtct

SEQ ID NO: 725207 - DNA, 324 bp, Homo sapiens
tatcttggctaaatggctttacactgcaaaatgaccctaggttgttgctacccgctataggtttggctgcgtcccacccagaggcatcttgaattgtagttcccataatccccatgtgtcgtgggagggacccggtaggaggtaatcgaatcatgggggcaggtttttcccatactgttctcgtgatagtgaatacatctcactaaatctgatggttttataaagggcagtttccctgcacgtgctctcttgcctgctgccatggaagacataccttttagctccttctttgccttccaccatgattctgaggcctctccagcc

SEQ ID NO: 725208 - DNA, 565 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctgtgttaaaagttcacgattgccagcttcccatgataacacggaaatcagcctcctgcctatactccgtcccaaatgcggcctaattatattgtaggttctattagcttttcttctcttcaagacattctgtcttatgtct

SEQ ID NO: 725209 - DNA, 117 bp, Homo sapiens
tagaggatccccttgcttgtaccgggccggggggagagaagtggtggttctgcaaggcgcaaggagtacagagcctagagttggcaccgtcttgagtgggagacccaccacttctct

SEQ ID NO: 725210 - DNA, 502 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctcctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctcttcacacgcctgtagacaagatagagccgagaaaggtagagccgagacaaggtagagccgag

SEQ ID NO: 725211 - DNA, 308 bp, Homo sapiens
tagaggatcccctgatgtcctgatgaagaaaaacaaattgaagacttttccagaagtctaactcaacaggaattttctcattccccaacctcttaaaaaaaagaaaaaaaaaaaagaagaagattattttcagagtctatttgtttcactgctggagaccagggaatagagatgtaagggctgtttgtcaactctcaggcagagaaatcactaattcatttctttcttgggtcaggggacctgatctccttttatcaaaagaaaattacttcacagagaaagcactgtcactataagggggaaaggaa

SEQ ID NO: 725212 - DNA, 563 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctcctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctcccgtctttaataaaatcttgtgttaaaatttgcatcacgtcgccttcctatgtatgacgaaccagaacagagatttccatgctcttttttctgcagaacaggtagaccgaggtaccgagctcc

SEQ ID NO: 725213 - DNA, 444 bp, Homo sapiens
tgcggatcccctcggctctaccttgtctctcggctctaccttgttctctcggctctaccttgtctctcggctctaccttgtctctcggctctaccttgtctctcggctctaccttgtctctcggctctaccttgtctctcggctctaccttgtctcctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcggctctaccttgtctctcatccaagtactaaccaggcccgaccctgcttagcttccgagacagacgagatcgggcgcaacaagtagacacac

SEQ ID NO: 725214 - DNA, 181 bp, Homo sapiens
agaggaatctagatcttcattcaagggtgtcttctgccttcttgcgtgccactcaattcggttctcccagtaacatgcagctcagcacacgttctcactcacacacatttgcacacataaaacccatattgacctctgcatctgctaaagctgttatttctaaagatctccaggtaataac

SEQ ID NO: 725215 - DNA, 411 bp, Homo sapiens
gaagggttctcagatacaactctgagctacttcagacccatgaggtaggcttgaagacaatgactggcagctgatgagaaagccaaacttattatcacgtagtacatcagatctatagcatgcagacacattgtgaacgcatcagaaaacaacagcagcaacaaaactgcctgttgggtagctctgtaaatagagctctcattagtatgtttaaaattgcagttggattttgcagagctgctctgcaacacaggttttgcatcacgtgcagtaaatctctattacgtcttaatatcttcctgccactgtagccgtgggaatggggaagcaggtaagttttaggttgtgacaggcacagagtgtgctgttagtatttagtgggtagggatcagggaacgctaaaatatcttt

SEQ ID NO: 725216 - DNA, 261 bp, Homo sapiens
aatcaggttatggtggcagaagatcttggagggagagaagaggtggctggtagcagaggtggccctgatgtgtagatgaaacctcctaggtagcagccctcacagagaaggcagatgtttctttcagacctttaaagatgtcagactctcagtcaatcttccctagatctggaccagggagggccttagagaaagatggtctcccatcagtgcagtttcctccccaggcaggaatgtgctattgaaacttctaaaactagg

SEQ ID NO: 725217 - DNA, 107 bp, Homo sapiens
cgctttcgctcgccctctcctcgaggatcgaggggactctacacagacatgtgctgggaagggagacagaggcggcggcggctttaggggaaaccgaggccttcagt

SEQ ID NO: 725218 - DNA, 803 bp, Homo sapiens
  misc_feature (4)..(4): n is a, c, g, or t
  misc_feature (116)..(116): n is a, c, g, or t
  misc_feature (119)..(119): n is a, c, g, or t
  misc_feature (121)..(121): n is a, c, g, or t
  misc_feature (131)..(131): n is a, c, g, or t
  misc_feature (136)..(136): n is a, c, g, or t
  misc_feature (138)..(138): n is a, c, g, or t
  misc_feature (141)..(141): n is a, c, g, or t
  misc_feature (170)..(172): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (206)..(206): n is a, c, g, or t
  misc_feature (209)..(209): n is a, c, g, or t
  misc_feature (211)..(211): n is a, c, g, or t
  misc_feature (232)..(232): n is a, c, g, or t
  misc_feature (244)..(244): n is a, c, g, or t
  misc_feature (246)..(246): n is a, c, g, or t
  misc_feature (249)..(249): n is a, c, g, or t
  misc_feature (256)..(256): n is a, c, g, or t
  misc_feature (259)..(260): n is a, c, g, or t
  misc_feature (300)..(300): n is a, c, g, or t
  misc_feature (307)..(307): n is a, c, g, or t
  misc_feature (324)..(324): n is a, c, g, or t
  misc_feature (326)..(326): n is a, c, g, or t
  misc_feature (328)..(328): n is a, c, g, or t
  misc_feature (331)..(331): n is a, c, g, or t
  misc_feature (333)..(333): n is a, c, g, or t
  misc_feature (345)..(346): n is a, c, g, or t
  misc_feature (351)..(351): n is a, c, g, or t
  misc_feature (354)..(354): n is a, c, g, or t
  misc_feature (356)..(356): n is a, c, g, or t
  misc_feature (359)..(359): n is a, c, g, or t
  misc_feature (362)..(362): n is a, c, g, or t
  misc_feature (371)..(371): n is a, c, g, or t
  misc_feature (377)..(377): n is a, c, g, or t
  misc_feature (383)..(383): n is a, c, g, or t
  misc_feature (390)..(390): n is a, c, g, or t
  misc_feature (400)..(400): n is a, c, g, or t
  misc_feature (439)..(439): n is a, c, g, or t
  misc_feature (455)..(455): n is a, c, g, or t
  misc_feature (458)..(458): n is a, c, g, or t
  misc_feature (460)..(461): n is a, c, g, or t
  misc_feature (496)..(496): n is a, c, g, or t
  misc_feature (577)..(577): n is a, c, g, or t
  misc_feature (586)..(586): n is a, c, g, or t
  misc_feature (594)..(594): n is a, c, g, or t
  misc_feature (598)..(598): n is a, c, g, or t
  misc_feature (610)..(610): n is a, c, g, or t
  misc_feature (614)..(615): n is a, c, g, or t
  misc_feature (622)..(622): n is a, c, g, or t
  misc_feature (643)..(643): n is a, c, g, or t
  misc_feature (654)..(654): n is a, c, g, or t
  misc_feature (657)..(657): n is a, c, g, or t
  misc_feature (665)..(665): n is a, c, g, or t
  misc_feature (669)..(669): n is a, c, g, or t
  misc_feature (674)..(674): n is a, c, g, or t
  misc_feature (697)..(697): n is a, c, g, or t
  misc_feature (701)..(701): n is a, c, g, or t
  misc_feature (716)..(716): n is a, c, g, or t
  misc_feature (801)..(801): n is a, c, g, or t
acancagttaccgtgggtaagcaggtcgcctgcacagcaggaaccccaggaaaaaaaaaaaaaaaacacaagagacaaaaaaaaaaaaaaaaaaaacaagaactaaatgagtacanatngntaaagaaganaccantntanaaatataaagagaatagaaaaagaaaaannntntanaanaaaacataggaaaaaaaaataaagtntantnaaggtgtgtgtacaaaaagcntcacgacggagntnctntcctttnttnntttctctcttccccgtgtggtcatcaagtcctgggggatnttctctncccagccgccctcgggnanancancnccgcctcccatnnggccntgngnctnctntactcactncacttncttaancaacccnccatcctccnttccccaccccacccagcacgcactcattcagtccattnccttaacacaagcctnaangnnctgtattctcacaatataaacgaataaagtgtctnctggcctacttctgaattacttctcaactgtatggtttggggaagtgtgagggaaacctacaaatcccgtccaaataagtnaaattcctnaagaagtngctnagtcctaccagnttgnngttaggnaaatgttctgggttcaggcgnccctcccaggnctnagaaagtncagncaggnacagctttctgttctctcccagngtgnctaggttagtatctnacatgacaaaaaactgagagtgttctaacttctgtgcaagccaggttaatcctgagactaaatcttggcgttcagactcccgtanag

SEQ ID NO: 725219 - DNA, 597 bp, Homo sapiens
gcgaaatttcccctcactaaagggcccaaaagttggcctcccccgcggtgcgccccttctaaaactgtgtttctcccggggtccggaattcggcccaagcaggtggctttttaaagtgttggggttgggatttttttctccccgttttttcttttttgttctgaggataaagccctgaggcccacgcggttgcggagtccctgcccaaagcgccctcccctccctttaaaagccctggtctttctgtcggacctctggccaagccaggggttcgggtccgccccgatctctttctcctgggcaccaaaccgggtgtccgcgggcctctccccttttttaccagacttttccacaatttgacattttcttgtctatttattgagaccagtaaatcgggttgtgttgtatttcgtgagtggagataaaaaattgtaggccctagtcattcttgccctcctagtcacaccaacatatgtttgtgtggtgtggtgggctgttttcttttccctcttgagcgcgccccgtgtgtttttctcccttcttgggcgggcgataatatataatctattccgctgggcccgtcgtgagggtgtgttt

SEQ ID NO: 725220 - DNA, 1644 bp, Homo sapiens
  misc_feature (1011)..(1011): n is a, c, g, or t
  misc_feature (1318)..(1318): n is a, c, g, or t
tccggttgtcgtcagttcagtctgtgttctgctgctgctgtgtatcgtgttcgttgtatgatctgtcgttgtgtgttgtgttgtctggtgtcctgtagttttgtgtgtgttgcttctgatgtctgtgtcgttctgcctggtcatgtcatgttagtctcatgttgctgatattgttgtgtgtctgttgtgtgcgttcgtctctcgcttgtcgtatctcatcatgtgccatgttgtgtatgtccccgctaatccctttgttttcaacaccctccccgttttgggcccccctatttggtctcgccaggggccccacaccactgtgttgaccacaaaacccgcgcctttttttacccccccgccccctgttccttatacccggttccttaaggtttgcccgaggccgcttggggtggccgctaatctccgccccctaaggggggatccccgcccgcccaaaatgcggcccacgtcccatatatccactcaacaagaaggaggggagaaattttgtctccgcctcttgtaggggctattcttttccaataaacgttgtgtacgctgggataatggaggtttttttattactctccggggggaccctctggtctcttgaaaagagatatggtccataaacatttctcttggggagttttttgagggtttctccgcgagggtgtacccaccccccagccccatgggcccacatgaaattccacttttattgtgtggacccccctcccacgggaccacccagcagaaggtttccttggttgtagaaaaggggcccctcccgtattttctcggggaaacttgacctgtcctggtgaagagttctcagaaagtaagtttttttggctttttcccacgaaagccccacattgttaaagaagccttttttatagcctcggtaaaaaagggggggcgaccccttaagagggtttctttgttgtggcccccatatgcgccccaggcccgaagtgtctccctcggctgtttcacccaagagctccnctctaggagggggctctttcttcttttcccgcgaagggcccctcccctctatgagtcgtgtcctcccccggtttcccatccatgtggagaacatgggggccccccaaagagcctttccgagagttgttgcgatgttcttgggaaaacatccgcggaggcaccagataggcgcctaaatacccatggaagcatttgtttggattgtgccctggatgtatctccactcaccgcgatgacccctgtttataacgtattattccttgaacacctgctgttgcgccacacctgttgctcacagacaccgggntttgtctgtggcactaccaaggtgaaagagatcacatgctggccctgggagaccccacactggtataagagttggcccctatatgagagcctcctgccctgagaccaccgctgaggcactttgtggaaccccaagattgagatatctgcccacccaccccccacttctcacggacacgaaagggtgggaaagccacgaagccccctgccacatgccccacgccacgtcccccccagcattaccgggtctccttggccagctgtattttggaggatctggatgttgctcttttaagaccctttaattaaattttgtaccaagaccca

SEQ ID NO: 725221 - DNA, 1060 bp, Homo sapiens
ggccctctctggcctcctaatgacctccggactagccatgatgattgcatttccactccataacgctcctacatagtaggcctactaaaccaaaatactaaccatataccaaatgatagtgcgctgatgtacactacagagaaagttagagtacccaatcgtactaccccaccatcatcgaccgtgatcttaatagataggccattcaggatacggtgataaatcctactccatctcagccttcaggacagtgtgttctgcattcgcaaggacttgatatctggacgaccttttatacgcacctcctagtccttagcctcatacacccccagtcttggtggagcctcgagtgcccaaacacggcatcagcaccatgctaaattagcgctagaatgtacccaactgtaaaaggacattccgtattatctctacatcagggctgttatcacactacagctgatgatcatccatgacgtctacctaggataagaagggcgacacgccatgactcattgaaagcaatggctaattgagcacgttgttacctcgtagtctcgtagtaaacaggcctcctaacacgctctgagagttaactttcggggctcgctttcagaatgtgttccgacggggattctaacggtgtcaacatattttggacgccgagagttgctctgggcccttagaggtcggcgagtggtgtccccacggacgttcgcgtatgtagcttagggcgcctaacttatattacaggttacagtgccctacactacttcgagttcgctagcgacgcaggttgctgtgaatattggtcggggtggttgccagtagttggatgcatccacgagggggtggttagctcacagacaagggaaaacatatggttggaggcctgcctgcaacggtcacgtaccttgtgagcgggcgccatttaggtcatccctcgcgtcccccatgccagagcccgggtcctaagcgggccgaccacgcaggggggggaggatacagaagcggagagagcggagcgcaacaaggagagcggacgatgagcagacagacaaac

SEQ ID NO: 725222 - DNA, 145 bp, Homo sapiens
  misc_feature (23)..(23): n is a, c, g, or t
  misc_feature (40)..(40): n is a, c, g, or t
  misc_feature (85)..(85): n is a, c, g, or t
  misc_feature (104)..(104): n is a, c, g, or t
aggtgcccagtcttgagtgggcnccctccttctcccctcnagacccctaccctttcccaaaaccttcggtattgttcaaagaacncccctccccaaggaagganaaatatgattctcctctcccaaataaactccttaaccacct

SEQ ID NO: 725223 - DNA, 640 bp, Homo sapiens
cttgttatatatccagctgtgtgttcgatttcgctccccatggcgtgcacacctcgtgttccccgaggccagtccttgggtacacagatcaaagtgacgcctgtgacactgtctgtgggtaaagctaggtgccttcagcaccagtttacttcacagcagagtatcagtattctcagtatgtcttagccaggccgtcagctccgaagcgttgcgggtatttgtcactgcgcaggcaacactcacttatagcgatgagccacgcagtcctgcaagtcagtacggtagtttccgatatccctagtatgattataagtacgtcaagctatcccctgaaccggacagtgagtcatccagcccagacacccctaggtcctatgtgggggagcatcatagctcccccgagcgtatgatatatcagctcagacattggtgtgctgacactcaacaggttcaactagggtttgcccatgtccccaaccccgtggagcgcgtccttgaagaacttccgtcagcttccagagctgcctgcaatggctaagcaccagataccaatgcctgtacatagactctttgagctggaggcccgtctccaggtgctcctccagtaaaggcacagatcacagtttgttatgcaagtgcc

SEQ ID NO: 725224 - DNA, 957 bp, Homo sapiens
tccaggacatgtgatgaaagtacccagagagaatcactgttctccaggttcatcataccagcaaagtcctggtgaaatgcagctcaacaccaattatgagtccctgcaaaacccagctgagttttacgataattactatgcacagcattctatacataattttcagccacccaataactctggtgatgggatgtggcatggtgaatttgcccagcagcagcctcctgttgttcaagactcacctaaccatgggagtgggtctgatggcagcagcactaggacaggccatggccctctgcctgtaccaggcctcctccctgcagtgcaaagagctctttttgtaagacttactcagagataccaagaagatgaagaacaaaccagcaccaactcatagggcaccaagcaaggaagaaagatgatacagttaactggtattccagtagtgaagaggaagaaggaacgcagtgtcaacatcaatactgaaaaacattcacagaaaacaaacagaaacctttaaggaatcagcaacaaccttccacaagaactcagcactcctactgatccaagacttgctaaagagacaagtaccaggaacccagtggttgaacctaggttaggactatcccaaggcaagaacttgaagcttccgagtctgccccactggattcttagacttgcgtggatccccggaaatgcaagcgaatggaagtggcacataggtctaccgatggggagcaactttggtttgatcacgcaatgccggcttatgtaaacacacaaaagcactctaatttaaactcagaaacacggcaaaattttgactctggagctccccgatatgccagtacggcaaccgaatagcttaaggctacacacccttgccatgtgggccaactcgctacaggattcaacacctaccagaaataacaatagtccaccacaaaaagcaaaaaa

SEQ ID NO: 725225 - DNA, 87 bp, Homo sapiens
ctgctgtgctccaggttgccactggagtgatttctaccctccaggtaaggtttcagcttctcattatttaatgtggttggaggacac

SEQ ID NO: 725226 - DNA, 289 bp, Homo sapiens
ctagtgttttaatttcctttcatctactaacatccttgcaggacatggaccattgccacttactcgagtcaggatacttgatggattaactcgtatcatcctgccgaatcttttccagttcacgtaattttccatttgctaaaaactcatcaatcttctgcagctatgttcgttcctactccaggagatttcttagtcttcagctccactccttattttgtgtgggtattttgctcttacagatgctgcttttctatccggaaagaagaaaaggaaaatcaattagaat

SEQ ID NO: 725227 - DNA, 190 bp, Homo sapiens
ctcggtaccgttcgacatccggtggcagcttctggcctgtcctgcatatggcgagctagctgtacacggcatcaagctgatccccgatcaccggatattcctgtcgtcggcgttcagcgtggttatttggctggtggtggattttcaaacgtgtatctcccttccaaatatggccagcacttcacggtta

SEQ ID NO: 725228 - DNA, 170 bp, Homo sapiens
cggaacgaggtaggagcacgtggtctcagatttctcagagcagggaatgttaaaatatcttcatgagaccctccctattcctcagagaaacaccaactgaaaagagccaggaaaaccggggaattttccaaataggtcttcacggttaaactggtcttactctcagtgag

SEQ ID NO: 725229 - DNA, 931 bp, Homo sapiens
atcatgctccgattccccgatgccagaatcggcgcatgatcccggcgttgtggcgcacctaacggcctgtgcctgttagcttaccaaggaagtcacaagacgggaggggaccgtgcccttgacctaggtcctcacgcgcttcgcaggtttctcatcccgcagcctcgcggcgtgtcatgttcctgacggcgcctgtctctggcgcgtgtgatgtttcattctcttccagattgtgaatcatggcactgagcgcgtgtcctttatactttgtaaaggtcccgtattagctcgtggcgtggtcttggtggtcgggtgtgtactgttccccatctacggtcctgcgcgtgtgcgcatgatactacctcgtctcgcctcattactgtgaggagggtctgggtccatcctggtacacgtctgtgccccaattgtgatcctggggtcgatagaatgtcgttctcatgagtcagctctgtgagccgctcctttggatgggggtcttcttccttcctggaatgttacgttgatatcctctgtcgctcttctggttcccctattagcttctcttctagccttgtcctgttgtggtgcagttccctggtcgctggcacgggtcgtccacttttatgcgcttatctcgaatctgaagagtagtgcgtgatggccccgagcagacctcctttgttcataccgttcttccctctgctccgggggctgtgactgatccattgttctggctggtagattgttcaccacctgctgtatttccgtcccttcctttgtgacggggcgcgatgctggtgtgtctcccggggtggggccagctgcccggcaggtcttctgaggcagtgcggggctcgtggcacgtggggggctcacccttggggtcggggccgggggtgttggtaaccgaaacaagttgggcccgcatgtt

SEQ ID NO: 725230 - DNA, 353 bp, Homo sapiens
cccggccgagaaacgtgtgtgtcaagaaagtagatttacgccgattcactaataatattgaaatggattgggtcgtaggttaggtctagggtgtagctcgtgagattagggtaaatcagtgaatgaagcctcctatgatggcaaatacagctcctattgattggacatagtgtaagtgagctacaatgtatagtgtgtcgtgtagtacgatgtcaagtgttgagttggctaatacaatgccagtcaggccacctacggtaaagagaaagatgaatcctagggctcagagcagtgcagtagatcatttcatattgcatccgtggcgtgtggcgagtcaggtaaatactttgacg

SEQ ID NO: 725231 - DNA, 134 bp, Homo sapiens
gggtgggggggggggggggttggggttttttaacccggggttttttttggggggggggggggggcatttactgggtttttttttcccccccccccctttttttttcctttaaaaaggggtcccctttttcccca

SEQ ID NO: 725232 - DNA, 159 bp, Homo sapiens
ccaccctctttacagttctagtgatttgggagttgcttccccatgtctgagactcagtttcctcatctgtaaaatggagatgatagcaccgtacctcaaagagtggttgattactagggcttatgatcctgggaactcggtcataggtgtgggatgttt

SEQ ID NO: 725233 - DNA, 424 bp, Homo sapiens
  misc_feature (18)..(19): n is a, c, g, or t
  misc_feature (31)..(31): n is a, c, g, or t
  misc_feature (49)..(49): n is a, c, g, or t
  misc_feature (64)..(66): n is a, c, g, or t
  misc_feature (70)..(70): n is a, c, g, or t
  misc_feature (76)..(76): n is a, c, g, or t
  misc_feature (79)..(79): n is a, c, g, or t
  misc_feature (99)..(99): n is a, c, g, or t
  misc_feature (129)..(129): n is a, c, g, or t
  misc_feature (207)..(207): n is a, c, g, or t
  misc_feature (216)..(216): n is a, c, g, or t
  misc_feature (236)..(236): n is a, c, g, or t
  misc_feature (245)..(245): n is a, c, g, or t
  misc_feature (279)..(279): n is a, c, g, or t
  misc_feature (284)..(284): n is a, c, g, or t
  misc_feature (345)..(345): n is a, c, g, or t
cacgagctccttgtaggnnctgtcactgtanggcaacgcgctgatgggnctgtacgtggacctnnnctgngttatntgnctcaagcgcgtcaatcttgncgagaaccgcctggccacctttccgcctgnacacacagctgtgtcactggaagtgctggacctgcgcaacaggttcaggcttctggcaagcagtgccatgggtggccnggagaccangcttcggcgcctctacctgnaagggaatncactcagctgttgtggcaatggctggctgtgagnccagntgtaccaaggccgcgtggacctggacgccacccaagacctgagctggcgcttagattccangaggaggtgtgcctgagccacgtgcgtgccgaggactgtgagaaggggggactcgggaacattcctcatcatcatactc

SEQ ID NO: 725234 - DNA, 386 bp, Homo sapiens
atcccggactgtcggatgcatgttcttgtgacatgtcctcacatagatcaacatttaagatagagaaaagatcagaagaactgaaatgatgtgatgtggagataagaagccgtgtccagtatgaatctcaatttcaacaaatgaggagaaagtagatacagatgatcgaactgaaggctatttacgagcagaaccacaagagccctcccactttgattctcagcagcctgcagtcttggaagaagaagaggtcatgatagctcatgctcatccacaggaagtctacaatgaatatgtacccagacggtgcaagaataaatgccattcacatttccacgataacactcgggcagtcagacgatctcattcaacaacatcatgactac

SEQ ID NO: 725235 - DNA, 669 bp, Homo sapiens
agcgggggggactcgtggtcccggctcgactcagtcctccagccgcccggggaatacctctagttcttcccggccgccgcgactacgacccgacgtaacatccatccgcacatgacagtgaaaacatatcgtcaactcctactactagaacagagtcagctgcggatgctgagcactataccgtaatttatctcacgcgtacatctcatacgaacagccatcaagcccaaagcacgacatggcaactgaatcagagaaaagaatcaagcaagacaaagtaagcacgacccagcaacgaaagaaaaagcaaaggaaaacatgatagacggacaacaaagcagcacagacaacacacaacaacaacaacagcaacagcgaaagaccagaaacacaagcgagacaaaacaaaaaacacacacaacgcaaaacaacaaagacacaacaaaacacaacacagcacaaaaaaaaaaagaaaaaaaacaaagagtaaaaagaaggggaaaaagcgccagagcgacatacagaaaaacacataacgccaaaataaacacacaaaagagataaacacacagaagagtgaaagaaaccataccctccaacaacaggtaaaccacaaaacacaacagcaacaggaacaaaagcgagactaaaaacacacaaaacaacacc

SEQ ID NO: 725236 - DNA, 919 bp, Homo sapiens
  misc_feature (196)..(196): n is a, c, g, or t
  misc_feature (218)..(218): n is a, c, g, or t
  misc_feature (306)..(307): n is a, c, g, or t
  misc_feature (313)..(314): n is a, c, g, or t
  misc_feature (333)..(333): n is a, c, g, or t
  misc_feature (586)..(586): n is a, c, g, or t
cctgagcatggtgacaccagatgatgtcaacgccatcatcctggcccagaagaacatgctggaccgctgtgagaagacccatgagatgctgctcaacttcgctacctgtccagtgcccgcctgcagcagatgagcgaacgcttcctgcaccacacgaggaccctagtagagatgaaacgggacctggacagcatcntccgccgtatcaggacgctganagggaaactggccaggcagcacccagaggccttcagccatatcccagaggcatccttcctggaggaagaggatgaagacccctcccanncgcccnngaccaccatgccacctcanaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagcctgctgcccggtgccttgagggggtctcagggcagcagcatacaaggtggcagcgggtaaccctgccttgttctgtcatccagggctcctttgctgccccgtnctgtcacccagggctcctaggggacaaggctctctcccgaggggtgtggaattctcggggggtctttaattctgctccttcttctcagacatctctattctgcaagaccctctgacatgccaggcacgccattccagctggagtcgtggggctgggcacaggggaatttttcagagctgagcctgacgtctgctctgagaatgcttagaaggttccagacacagagccatgaccaccaccgtcagactcttgagtgcacagcacagtctctctgagtcgcccagccaccccgaccactaatctgctttctgcccttgctcgtaaagatcaata

SEQ ID NO: 725237 - DNA, 971 bp, Homo sapiens
  misc_feature (196)..(196): n is a, c, g, or t
  misc_feature (218)..(218): n is a, c, g, or t
  misc_feature (306)..(307): n is a, c, g, or t
  misc_feature (313)..(314): n is a, c, g, or t
  misc_feature (333)..(333): n is a, c, g, or t
  misc_feature (638)..(638): n is a, c, g, or t
cctgagcatggtgacaccagatgatgtcaacgccatcatcctggcccagaagaacatgctggaccgctgtgagaagacccatgagatgctgctcaacttcgctacctgtccagtgcccgcctgcagcagatgagcgaacgcttcctgcaccacacgaggaccctagtagagatgaaacgggacctggacagcatcntccgccgtatcaggacgctganagggaaactggccaggcagcacccagaggccttcagccatatcccagaggcatccttcctggaggaagaggatgaagacccctcccanncgcccnngaccaccatgccacctcanaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagcctgctgcccggtgccttgagggggtctcagggcagcagcatacaaggtggcagcgggtaaccctgccttgagggggtctcagggcagcagcatacaaggtggcagcgggtaaccctgccttgttctgtcatccagggctcctttgctgccccgtnctgtcacccagggctcctaggggacaaggctctctcccgaggggtgtggaattctcggggggtctttaattctgctccttcttctcagacatctctattctgcaagaccctctgacatgccaggcacgccattccagctggagtcgtggggctgggcacaggggaatttttcagagctgagcctgacgtctgctctgagaatgcttagaaggttccagacacagagccatgaccaccaccgtcagactcttgagtgcacagcacagtctctctgagtcgcccagccaccccgaccactaatctgctttctgcccttgctcgtaaagatcaata

SEQ ID NO: 725238 - DNA, 405 bp, Homo sapiens
  misc_feature (1)..(1): n is a, c, g, or t
  misc_feature (20)..(20): n is a, c, g, or t
  misc_feature (24)..(24): n is a, c, g, or t
ntactactactaaattcgcngccncgtcgacgtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataattaagaaagaactctccaccacggggaatgtgaaaggtatatgagtcccttttcacgatgcgatgtcatgtcttttaaataagccatactttatgttcaataaaaagagaataagcaggaaaaaaaagtcgacgggcgcgaattt

SEQ ID NO: 725239 - DNA, 921 bp, Homo sapiens
  misc_feature (1)..(1): n is a, c, g, or t
ntctgccttacatactccatcgcgagggactttacttagtcgcgcgacggttcccgggttgtgctcgactgtttccccttataccgggtttgtggcaccctctgcctgtttgcgcccccggggagtgtaaccctttgcccgaggcgggacattttttacccggcgagcccctttttggaccgggggccactccgacaaaccgtgggtgacacccccgctacgttttgtagaaatctccagggtcccaagtagtaaccgtggtgacgccccccctcccgggcccgcttagtccccccccagctatttaagggcatccgcacctgctctcccgcaaaggtttccccccccgcctcctttccatgccgtgtgggagtaatacccccaccaacggcttctcaaaaatctgctggctctttattattttccaccaagataaacaccaggtctccagtgaaattaataaagtcccgccagacagagttcaggtaaacatgttggtggcgccccaatcaatatatccctccaatcattctttgtaatcccttcaacaaagcccccttgtctaaccaagatgacgtggctttaagaccaccactctccacaccttaaagaagtatcgccccccccaggcaccaatctatctcatttatcaaccacgacatattggggcacattctttacaagatctccattttacaatgaacagctgtcctccctggaatgcatccaaatatcgaggttcatacccactccccgatcgcaacctataaataggatataatcattatctatgtcttgccaaatacttcgtcttgtgtcacccaccctcccaaccaaaaaatattgttttcaccgggcaaagagtgtctctccccccagggccgaaaaagacacacgggaaaaggcaaacaaacataacaa

SEQ ID NO: 725240 - DNA, 504 bp, Homo sapiens
  misc_feature (1)..(1): n is a, c, g, or t
  misc_feature (20)..(20): n is a, c, g, or t
  misc_feature (24)..(24): n is a, c, g, or t
ntactactactaaattcgcngccncgtcgacactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaatttaatgtgtaattaagaaagaactctccaccacggggaatgtgaaaggtatatgagtcccttttcacgatgcgatgtcatgtcttttaaataagccatactttatgttcaataaaaagagaataagcagga

SEQ ID NO: 725241 - DNA, 120 bp, Homo sapiens
cctcctgaaagctccatgaactgcttgagtaccagacttgagcaatggttcccacaattatttatgagatcagctttggtcttgccaatgcctgtgtctaccagagtcagggtacgttcc

SEQ ID NO: 725242 - DNA, 691 bp, Homo sapiens
gatgtaagtgagattctgaagaaggaagagaagaacagtgttaagtatcctggcaaaggagcattagggttacagatagaattgaagttgctcgtcagctgattgaagataaggagattggcctggattatccaggtaggctcaatgtaatcaggaagggcctttaaagtgagagagggaggcagaagaggaagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaatttaatgtgtaattaagaaagaactctccaccacggggaatgtgaaaggtatatgagtcccttttcacgatgcgatgtcatgtcttttaaataagccatactttatgttcaataaaaagagaataagcagga

SEQ ID NO: 725243 - DNA, 798 bp, Homo sapiens
gtcatctgtgaatgagcttcgccaggtggtgggcacctgggagccatgcagaggctgtggtgctgagttagactccaggtacttatgtggtcaaaaggaaatcgccactagctccaggctgtgttaggacagtattagcatgaaggctgtgcgaccatcatgcctgctgatccttgcagtgcaggcctggtccagaaaatttctgggtcagtgacttgctgcagggaccagccgctaccagtgacggccctgaaacaggacacatctgtaatttatgtccctcacccatgggacaaggcacgccgtctacaatcacagtcctcctccatcacccaccctgacagtctcgagctggcagggcttgaattgttagtccacaactctggccaaaagatactattttatccagagacaagagtgccaggaggcaagtgagtggtgagccccgctgggagagagctggcggctgactgccacatgccattccagacctgtcttgccatgtggcgacccatggttacatatttgacgttataattgtactgaccctggaaccagataagacagaaacttcgtggtctcttggcggctccacaggaacccacttcacgggacgcaagattctacactggtggttacccatacttggacaatagggaagccctacttcattcgaatggacgcagccaccttagctgacacaccacgaaccggccacctgccctaatactacacgtaacaaacagcaagaattatcaccctgcatctgccctggcatgaaaagtaagcgtacgcggc

SEQ ID NO: 725244 - DNA, 695 bp, Homo sapiens
gaggctcccttgcctttggctgggtgcaacttccattttaggtgtggatctgagggggaaaaaaaaagtgagagagggaggcagaagaggaagtcagagcgatgtgctgtgaaatctactaccgtttgctggttttgaaaatggagaaaaagagtgaggaactgagaaacatggatggccttgggaacgtggaaaagacacatactaacaaaaggccacatgaggacacagtgagaagctggaagtctacaacccagaagagagccctcaacagaacctaaccatgctggtaccctgatctcagacatccagcctccagaagagtgaaaaaatataattcttatttctaagcaaaaaaattacaaaaaaaaaaaaaaaaaaacaattggtcgggcggccttggcccctctaggaaaaggtttttcataagaaccaatagcgagtattagagagcgccacagcgagagaccccaaagagagagacaggaacaaaggtgcgaagaaaccacaatgtgtgggaccacatcgacgcggatggatccaccaaaaggaagaacaactcctgtcgcaccagtgagacgaaaggggcacgggaactctcaccgcgagataaaaaagcgccccggaggcgtaaacgaacgcgtctgggaaacaatacccagaagggggtccggagcacaaaacgggcctgacga

SEQ ID NO: 725245 - DNA, 677 bp, Homo sapiens
  misc_feature (47)..(47): n is a, c, g, or t
  misc_feature (94)..(96): n is a, c, g, or t
  misc_feature (100)..(100): n is a, c, g, or t
  misc_feature (119)..(119): n is a, c, g, or t
  misc_feature (130)..(131): n is a, c, g, or t
  misc_feature (157)..(157): n is a, c, g, or t
  misc_feature (162)..(162): n is a, c, g, or t
  misc_feature (194)..(194): n is a, c, g, or t
  misc_feature (196)..(196): n is a, c, g, or t
  misc_feature (199)..(199): n is a, c, g, or t
  misc_feature (206)..(206): n is a, c, g, or t
  misc_feature (222)..(222): n is a, c, g, or t
  misc_feature (225)..(225): n is a, c, g, or t
  misc_feature (236)..(236): n is a, c, g, or t
  misc_feature (240)..(240): n is a, c, g, or t
  misc_feature (246)..(247): n is a, c, g, or t
  misc_feature (282)..(282): n is a, c, g, or t
  misc_feature (308)..(308): n is a, c, g, or t
  misc_feature (314)..(314): n is a, c, g, or t
  misc_feature (317)..(317): n is a, c, g, or t
  misc_feature (328)..(328): n is a, c, g, or t
  misc_feature (343)..(343): n is a, c, g, or t
  misc_feature (351)..(351): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (375)..(375): n is a, c, g, or t
  misc_feature (378)..(379): n is a, c, g, or t
  misc_feature (421)..(421): n is a, c, g, or t
  misc_feature (438)..(438): n is a, c, g, or t
  misc_feature (447)..(447): n is a, c, g, or t
  misc_feature (457)..(457): n is a, c, g, or t
  misc_feature (489)..(489): n is a, c, g, or t
  misc_feature (496)..(496): n is a, c, g, or t
  misc_feature (666)..(666): n is a, c, g, or t
ggaggaacagaggtggggaaacatgggagatgggcatagctttccanaagcttccagcatgggatacctagtggctcatccctgtttgcttctnnntgtntagatacccacatgctatntgttccaatgnnccagatccctctagaccacgcatagncccancctgagatatgttggaagaagcttagtgaaananctnccaaagntcgagttccagcttgnagnttttggatatnaccncgcttnnaggcacagggaccaacctcccatgatgttcatgcnaggtagagtggggtataaggttcggnagttgntanttttggttagntttaccgtcccgttntcccaganaaccttgtntggagntangatttntanntggagccattattgtgctcagcactcacacggtgggctactntggggccacaggaagtncagggaganaataacccangtgtttggggccctgagcatgggtggggccangcagggnactacaagggggactttcccagatggaaaccagggctcccacccagtaggcgcacagcacagatgggacgggaagaccctggacagaggccaaaggcccaggccccagcctccccatcagcctgcgccagcacaggcttcggactacttggagactgtaggcaaccagtntggcacagatg

SEQ ID NO: 725246 - DNA, 942 bp, Homo sapiens
  misc_feature (787)..(787): n is a, c, g, or t
gatgtaagtgagattctgaagaaggaagagaagaacagtgttaagtatcctggcaaaggagcattagggttacagatagaattgaagttgctcgtcagctgattgaagataaggagattggcctggattatccaggtaggctcaatgtaatcaggaagggcctttaaagtgagagagggaggcagaagaggaagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaatttaatgtgtaattaagaaagaactctccaccacggggaatgtgaaaggtatatgagtcccttttcacgatgcgatgtcatgtcttttaaataagccatactttatgttcaataaaaagagaataagcaggattcgcaagagaacacaatccctttttaactgctgggaagatacttttagtcattaatgactggacgacaatttgggacacatatatggatattggncggttgtgatgatgtgattggctctaagtgacaacattgttccctgtatagagtgagtggcaagtgcatttataaaattggccatcatggctgttaaattatgagtctagaagtgtgctcttcaaacagttttgggaggtttcctgaagaaagaa

SEQ ID NO: 725247 - DNA, 939 bp, Homo sapiens
gatgtaagtgagattctgaagaaggaagagaagaacagtgttaagtatcctggcaaaggagcattagggttacagatagaattgaagttgctcgtcagctgattgaagataaggagattggcctggattatccaggtaggctcaatgtaatcaggaagggcctttaaagtgagagagggaggcagaagaggaagtcagagcgatgtgctgtgaaatctactaccgtttgctggttttgaaaatggagaaaaagagtgaggaactgagaaacatggatggccttgggaacgtggaaaagacacatactaacaaaaggccacatgaggacacagtgagaagctggaagtctacaacccagaagagagccctcaacagaacctaaccatgctggtaccctgatctcagacatccagcctccagaagagtgaaaaaatataattcttatttctaagcaacctggtctatggtatttcattatggcagcccaagctaagacagatccctatcctattcaccatgctgcagagccacatgagcctcccttttgttcctcaagctcatcaaatacctcctagccttagaacttgctattccctctaaccagaattctcttccaggtctttccatcctgtaagtcttgtcctttagatcgaaattcacatgtgacctcccctgagaatggtcctctggaaaactatctcaaaagaggtgttcccagttactctctaccttaccccaggttattatctttcccacccacttttgcatatgtgtatcattgcttggatatgtgtgatatggtagggttaggtcctaccaaatccgtgttactgtatcccgggggatacactcaggagagaccgtggcaggatgctagggggggtccccagcggctcggtagggaaccatcaaatcagttgcagggtccggggcaaaatc

SEQ ID NO: 725248 - DNA, 196 bp, Homo sapiens
actgcacgaagtgcccacaagtgttcttaaagctgacccctcgaagagctgcagtgagtaattacagcaaacatcaatcacatggaccccgggggaactaactcctagggggcccagcccacagagtgtgctcttgcctacagattacagaagtacgctacagagcagagtggtcatcctcatctccacttcgtgg

SEQ ID NO: 725249 - DNA, 369 bp, Homo sapiens
acatgaggaaagtagctagcacatatcgggacacacaataactacgacaccacactgggattagataccccataatgcttagccctagacctcccctagttaaatcagtccaacactgcatcgccagtaatactacgtagccgaccagattaaccactcaaaggcagctgggggtgcttcatatcccgctagaggagcctgttctgtactcgataaaccccgatcaaactcaccacctcttgctcagcctatataccgccatcttcagcaacccctgatgacggctacaacagtaagcgcaaaggtacccacgtaaccgaccgttaggtcaaggtgtcgcccctgaggtggcaagaaatgggcctaact

SEQ ID NO: 725250 - DNA, 316 bp, Homo sapiens
  misc_feature (24)..(24): n is a, c, g, or t
tgagacagaatatcactctgttgncccaggctggagtgctgtggtgcccatctcagctcactgaaaccacctcctcccagtttcaatcagttcttgtgccttaacctcccaagtggctggaattgaaggcaagtaccgccaccatgcccagataatttttgtattatttttgtgtttttagtagagatggggttttgccatgttggccaggctggtctcgaactcctggcctcaggtgaattgccgacctcagcttcccagagtgctgggattataggcatgagccaccacacagtagtgaaacttgacagataat

SEQ ID NO: 725251 - DNA, 600 bp, Homo sapiens
taatgcaagtgtcctctggaatgcttacagatcatggcggaaggccaggcaggagccgtacatgccacatggcaaaaagcaggaacaagagggatagagaggatagtgtggtgagtgggtgtaggcacacttttaaatgccagataccatgagaactcactatcatgacgatagcaggcaatggcatgaggggtccgatcccatgatcgaaatacgcgcctccaggcacccaacctccgagcttagaggattacaattggatcaagagatttggagcagggacaaataatccggcaccatataggaactcaccacccttggctacgtactatgtgagtccaaaagccgggatgcatctctaagtcgggctcatggtatcgttcatcgggcaaagcttgcaggactcagccttagctcatgttgtgctcgagatgcagactttgttttggagaattaactttccctgttgtgaagtctgaggcagatggtaaattgaagtgccctgccctcccctcaccaaacaataggcatgagacctcagctgggaggtcccagccctctctggaccttggatcttaacagaagcagcacgggctacag

SEQ ID NO: 725252 - DNA, 310 bp, Homo sapiens
cacacccctgccctgaacaggaggcgtctccagcaatggcctgcaggccccacgtgaggagtcaccccccagtgcgccatctgcggtcccccatgaaccaccatgcatgggtggccctgaggagagttgtatacatgttattctataagatacagacaatgactaagataatgaagactcacataaaagcataagaacacagacaataaggagagagacgagaacacgactacaaaggaacaagatcagaaatagaacgaagcacgcgagagcaacactagtatcgcagaatatatcacacccacacaag

SEQ ID NO: 725253 - DNA, 933 bp, Homo sapiens
ggcacgaggtgcccccggcggcacggcgctggggaggcgatggcgccggccgcgtccaggctgcgggccgaagccgggctcggggcgctgccgcggcgggcgctcgcccagtacttgctcttcctgcggctctacccggtgctcaccaaggcggccaccagtggcattttgtcagcacttgggaacttcctggcccagcatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcactgccttcaggtggtgctgccccagaaacttaaaatttagtcgaggcagtttcaattgttactgtggaccgaattaggatcacaataaacgataatgcaggttcttcaaaaaaaaa

SEQ ID NO: 725254 - DNA, 1515 bp, Homo sapiens
gacaatccatcctcgtatatggagctgcggtgcgtgacggataacagtcgagagcgcagccccctcgcccgattgatttatgtcgtgagctgacgctttattcagtgcagtcgtgaaaaactttgactcaatcattttgcacaggatgagcttgagacgggctgctccactgtacttcgttggctgagaaagttgacgcacgcgggtcgtgggttgcgtacgcgtgttgggggcgctggcgagggtgtcagcgtcctgatgtgccctcactctcgtgtccagttgtgccacctctaccctgccttgcggttgccagcactgcgcgatgcggcttcgctattcccccttgacaaaggcgcccggagtaaatggtcctcgagcaagtgctccaattatctgggatcgcgtatacgcaggctactgtatagtcgagcatcgactcagtaagctaagcgcaggaggtgcaggacgccgccgttcatgccaagatcttcgctatctggccagagctagctgtcggaacggattcgacgcggcaaacactcgagggagcacgacgcaggaagaaactcttgagacggtatcctcgcatctcgtgcataggataccaatggccaaaaatgcagcccagaaatagttcgggcaagccatatctagagaaagagctggaattggagtcccggcagcgtgcgatatcccagagcgaagccatagcacgattccagtttcttaacaccaatccactcttataaccaattcccatagatacccctctagcagggcttgttaaccctaggtcaggtgcccagacacaacggcaaggattaaaccataccatagcacaacccttgtgggctttggtcatggcccggagcgcggaccaggcatggccgtgctgaacaacacgaggagacactccagaggagggaccaaagggtgccccaacatagcaaccgagagatcagaaaataggacgagaaagacacatgcattgtcgcttttgtgtacgtccagccccttagccactgtcatggcctttgtcctccatcaactccacgggaacatcccgacccccgaaagttaacactcgtgattcttgatgccacacaaccttatcccgggtgacgctggacactactggaaacacgggacccgatgattcactgatctcttacaatatcagaaatggggacacctctgctacacatcacggtcgttgacccctacgttaaacaacatttttggccggaaactgaggtaaactcgtaatggcacaccacactaactaagcaggcgcccgcgacattcacagtcccgagaccccactttcagtcacctcatctttgtgcagttgcgacgcgcattcgccccctcttcccccggcaaccaataaatagcgcgtctagtatacaccatatacacccaaaaaattccaccgaaaccgtcttgcgaaccttatgaacgcaacgaggactgctatctttaggatcacaaaatatatgatacccatcaaca

SEQ ID NO: 725255 - DNA, 84 bp, Homo sapiens
  misc_feature (27)..(27): n is a, c, g, or t
ctcagtgttaaagtatttattaatggnaagtcaacttaatgttttgaaataaatatatgactctgtttaatgcaaaaaaaaaaa

SEQ ID NO: 725256 - DNA, 768 bp, Homo sapiens
  misc_feature (83)..(83): n is a, c, g, or t
  misc_feature (125)..(125): n is a, c, g, or t
  misc_feature (153)..(153): n is a, c, g, or t
  misc_feature (158)..(158): n is a, c, g, or t
  misc_feature (252)..(252): n is a, c, g, or t
ctccaagttgtcccgcgaaggaattttgggcccaggacagacatctactgcccagcatgagcaggctgctgtctggccatctnactgatcattttccatcttgctggtctgctccttagagtcgnagtgctgagtacacatgtgtgctgtctncgtanacacagaacaaaatccaatagtcagtttaaaaaccatcacgatagggtctgggtgcccggaattcagttctgatgggcagtgagactgttcacnacccgccttccctcctttggaggggaaagacgcctcagccttcgccgccaagatgagggggggcttctggccggcgctgaggatgaactggcgggtgtggacgccactacagttcatcaacatcaactacgtccctctgaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcactgccttcaggtggtgctgccccagaaacttaaaatttagtcgaggcagtttcaattgttactgtggaccgaattaggatcacaataaacgataatgcaggttcttcaaaaaaaaa

SEQ ID NO: 725257 - DNA, 1068 bp, Homo sapiens
ggcacgaggtgcccccggcggcacggcgctggggaggcgatggcgccggccgcgtccaggctgcgggccgaagccgggctcggggcgctgccgcggcgggcgctcgcccagtacttgctcttcctgcggctctacccggtgctcaccaaggcggccaccagtggcattttgtcagcacttgggaacttcctggcccagcatgattgagaagaagcggaaaaaagaaaactctagaagtctggatgtcggtgggcctctgagatatgccgtttacgggttcttcttcacagggccgctgagtcacttcttctacttcttcatggaacattggatccctcctgaggtccccctggcagggctcaggaggcttctcctggaccgcctcgtctttgcaccggccttcctcatgttgttcttcctcatcatgaactttctggaggggaaagacgcctcagccttcgccgccaagatgagggggggcttctggccggcgctgaggatgaactggcgggtgtggacgccactacagttcatcaacatcaactacgtccctctgaagccaggtccccaggaccactcccacactgggaggatggggtgcagcaccccctgcagcatggcaggatacccccagatgctacaggaggaggcctggcagagcctgcaggggccacgtgcttccctcccccagaagttccgggtgctcttcgccaacctggcagctctgttctggtatgcctacctggcctccttggggaagtgacgaccgctgggagaacatcaggtgcactgtggacgtgggtctgggggtctcacccgcccagcgagagcagaaccaatccagtcaggatgtcactgactctaaatcaggtgattcaagatgcccaaaaatgatggatagagaaacagaaatctctgaatgtcagaaccctgtcttttaaaaaggcagtcactgccttcaggtggtgctgccccagaaacttaaaatttagtcgaggcagtttcaattgttactgtggaccgaattaggatcacaataaacgataatgcaggttcttcaaaaaaaaa

SEQ ID NO: 725258 - DNA, 261 bp, Homo sapiens
acgtatatgtaaccatgttggtgggagagattttggtttttaatgtggtgttcgatggagtaaagtttcttttggggtttttttgtttcaaccaaaaaaggcccccaaaatttaagcggttcctgaattttaatttttaatccctttccaaaccaaaccccgcccttttgggccccgggggaaggcacattttcttaaacgttttccgggtttttctcccaaaaggggttttttttttggggtttttgtcccctccttcaa

SEQ ID NO: 725259 - DNA, 192 bp, Homo sapiens
gacgaggaccgcgagcaatgcctgtgtccactgtgctgcctcctccgctgcttctggctgctgctgggggtggaggtttgaagcagtcccgttgcccgccgcaggcttggaagtcagctcttcccatggttccctctgcccgtgttaaccccaggctcgggattcaagtacatcttgtgcccaaccagaagc

SEQ ID NO: 725260 - DNA, 582 bp, Homo sapiens
  misc_feature (504)..(504): n is a, c, g, or t
cacagtcatgatttgtcacccaggctgccgtgcggtggcacgattgccacttactgcgaacaatgactggtggatagacgcgattgtactgccttaccctgatgcgtagctggaactgtacgcacgcacacaatcgcccagctagatctagaattggaagtatggacggggttttactatgttggactggctggatgagaactaccgacctgagacggatccgactgccttggcgcttccatagtgctgagactaccggcatgagccaccgtgcccagctgcccctgagtatgacacaataattaagcattcttgacatggaaataggagaagaaacgtcatgaatataagtcggattcgttggcggcctttgacagaaaagtattagaacgactacaatgcttacgctgaaggaacctgatcgattaaaataataattatctagccctacggatatgtgctttttgtgagacggatgctaacttaccttgctactgctgcaangcaactcgtgcccaatttccgttgtccgggggaggcactaattgcacaatcgtccggcatccccagcggaactcacaa

SEQ ID NO: 725261 - DNA, 118 bp, Homo sapiens
gagatccatgcattgtggcgcaatggatcccgattgtattcagtggaatccatgcagtgtgatgaatgcattgattccagtgcagcctggtaaaatgcatcagacctgctcttacctg

SEQ ID NO: 725262 - DNA, 453 bp, Homo sapiens
  misc_feature (21)..(21): n is a, c, g, or t
  misc_feature (445)..(445): n is a, c, g, or t
  misc_feature (448)..(448): n is a, c, g, or t
  misc_feature (450)..(451): n is a, c, g, or t
aaggacaaaaatgtttgttgncctccccaaaatccctatgttgaaaacccctaaccccccaaaccgataatgttgggagcctagagactttgggaagtaattaggtcatgaggttagagcacctcatgaattaaattagtgcccttaaaaaaggaccccagaggcccaggagtggtggctcacacctgtaatcccagcactttgggaagccgaggtgggcagatcacttgaggtcaggagtttgagactagcctggccaacatggcaaaaccctatttctactaaaaatacaaaaattagccagatgtggtggcacgtgcctttaattccagctactcaggaggctgaggcatgagaatttcttgaacccaggagatggaggttgcaggaagccaagatggcaccactgcactccagcctgggtgataaagcaagaccctgtctnaangnnta

SEQ ID NO: 725263 - DNA, 1834 bp, Homo sapiens
  misc_feature (84)..(84): n is a, c, g, or t
ggtggtcgcgcatgattctcaagatgctaggccgaggaacaccgcgaggtcgtacaggtccacgcactgctcggcgttcagggnccgggcactaataacacaaggtgcgcttgcgcggtcaagactgcttctctagcgcagagaccactgctggacctcgaactgaccgtggggcgcaccgagcaggctgtctactacgtggcacgctgcgaaacgggcgacggggagactggcagcttggtctcgtgttcctggccgcggagccagaacggcgggccttgatgcttgcgccatgcgaagacttcccatgaaaagttatcgcgaagcgaattatcatctgggaagcgaactggcacgaatgcgacactggagcggtgactacgactgcgtagacatgcgtacatcgcggccagtggccttggccttgtgatggtgtgcagtggtccactcatatcccaagttaaaggcacttgctcgcattgcgctaggtaaggcattctcgtacaggacattccctttgacccgggcaacatgcacatgtcatacatattcttatccgtacactcaatagcataggcacgagggagggacacagagggccagtatcgccaggccagtagccttaagggcctaggcaatggcaatagccatttcagcaatcgattccggcaacaagctggtggcgcggttgactggagtttcagcctttcccgggtgaagtgttctcaattcacacaccacatggacctaggcgggagtcgaacaatgggcgaacgcattgtctgagggccctcgtagaggggcctattcgtgcccgatgggtagtccctgaaagggatcccctggggaaccccaaccaggggtttggaagccaatccataccggcgtagtggaagtaaagggccataggatatagccccttccggggcctacggttggcacctgtccggcgacaccaaggccttcctaagccttccccagagcaaaaaggaagggcttgctgcgcacggggtgcatttcccctgccaccttatcccaccaagtcctcccccacttcggcacgtcgccatgcaaggcgtttcccaccccgcggattccctacaggggaatcattccctagtctgttgggcttgcccccccggactgtctgtggcccttattctgttgaggaaccccctcacgtgtatgggaagcccccgactggtgcacccctggtctcgcgtttgtttgcgccgggcccccctttcctttcgctcgggagacacgggtcaacccggtcctctgggcacccccttctgggacagcacttcttcgacctggtttcccatttgggcctgcgcttgcctttgcgggcccggtacggatttaaactactacgggggaacacgggtgtggctgccgcatcccttccgcaaaatgttccgtgcgcccacaggtggcggcgacaacatgtgttttgttccaactgccaggggcctctgtgacacgcataacggggtgccacgctttggttggcccccgcgacgcactgaccaggttgcgaaacaccacccgatcgactgtgtgctcccacaaccgcgcccaacacaaggacgcaggcacacgcacgtcgacgtcctccggggacatccacccctccagcagcgacgccaccatcgcagcgaatgagcgaagcagcgaccacaagccagagactcaccgaccgcgcacacacacagtcggagggcagacagtactcgaccaacacgacaacgagatcgcaccacagcggccaataatacccaactagcaggtcgctaatcagagcgacaagaaccacacagccgcagagcag

SEQ ID NO: 725264 - DNA, 428 bp, Homo sapiens
cttattagtagctctgggctcaagtgatcctcctgcctcagccttttacgtagccaggactgcagatgagtgccactatgcccagctaatttattttgtttgttttagagatgggatcttactgtattgcccaggctgatctcgaactcctaggctcaagggatcctcttggcctcccaaattgctgagattaaaggaaggagccactgtacctgtacccagcccatcacccaatttcagtagttgtcaactcatggtcatttttgttttcgtttgttctatttttgggaaagggattcgccttctgtgtggcccggggggtactgccggggtgtgatctgggctcattgaaccttttgcccccgggttccaggtgattctcttgcctcagcctccctagtcactagcttaacgggcgcccgccatcc

SEQ ID NO: 725265 - DNA, 147 bp, Homo sapiens
accctgctgctactgtatgagccgcgccaggcccagcgcgtggcccatgcagatgtcttcgcacctgtcaagcccatgtgcagactggagcgcgtttcccggtgccggtgccatgggtcagtgtgcagacagccgcaccctcaccac

SEQ ID NO: 725266 - DNA, 630 bp, Homo sapiens
  misc_feature (512)..(512): n is a, c, g, or t
tgtattttcagcacagcaatccaggactaaggttatgtccaagttcatggctatgaaacagaattttaatgttggacctttgcttcataagtgtagtattttaactgactgaggtaatgcaactaagaattatacatggcctctctgaaaaaatactcttatctgtggttggtaatagtgaacagttgaaagcaacttgaatatccaataacaagagttgggttaaataaatcagagtatattcatgtaatggaatactaaaacatggtatagaaatataggcattaatatgaaaatgtgttcacaccatattatcaagttaaaaagtaataggtatgtatgattccattttgggctttatttttctaccttattaaggtataattgaagtacaatgaactgcacatatttaaagtgtatagttggatacatttggacatccacagacacatgtgatgtcatcacagttgagatgatgaacattccattagcaacccccacccccgaagttntcctgtgtctctttgtaatccattaatccatctttccttccatcctcatctccagggcaacactgatctgtctcctgtcactaggaattagactgtttttctaagaatttctaaggtg

SEQ ID NO: 725267 - DNA, 177 bp, Homo sapiens
tataggtgtctagttttggacatatcttttttgaggggagctaccattcaacccacttatagagggcacactctttaaaatgattaggtattattaatctggtatatataaatcaaactataagtctaccatgagcaacaattggtagtatctcccatgttgcctgcgaacctatga

SEQ ID NO: 725268 - DNA, 1246 bp, Homo sapiens
  misc_feature (741)..(741): n is a, c, g, or t
  misc_feature (749)..(749): n is a, c, g, or t
  misc_feature (970)..(970): n is a, c, g, or t
ggtcctggtttatcacctggttctgtgtccgcccgctctctctcttggcctgaatggttttggctgtcccgggtcagaaccacgttgggtctggctaaaaaggctcgttggccaccgctgtgtttgcgcttataccagggtccaccctttgtcctggccgggccctccggtttctgattttgtcctctgaacgcttttcccgctcctgtctccgtcctgattatgccccccctatgatccaagggggccgtcccacaaaatgttggtccaacaagggccccttttatgtgtgaaccgacccgagggacttaattgctgcaatgccccgttgcgtgccgtgaatcgagaaggcgcaccaatctttgggtcctggaattctccccagaacctggtttctcttggaggcacccctgggtccacaaactgttcaatcaaggccaacatgaaccccccgggtgcatcaagaaggacccctggcaagtcccaacccccccctcccaaagggtgacacttgggccaaacaacccgtccgcgtggccttgtaactgcacgctcccacgaactcctgagtactgggccaccacaccacaggtcacaacgtggtcccctggagggaaattaaaatgccccggtgaaatatcgtaggtcacccgtcgtgtaataatatgacccaccccaaaatctcgtcacaaggtgccacacaaagagacccctctgtgcacacataacacacactcgtgnggagaccncacgagaaatggtgttccctgaagaaatggattctctgggtacaccttgaatggtcccacggtccttttgccacgctgtgttttgtgctcgatatggtttcccacatggaatacacacacggtgtaatgcgccccgggctcgtttctcacctgcttaatgtttcttcgggaatttctgggaagccacccacactctaatccgttctccacatttctgcttntgggcgaacccacgcgcccgagaaagccccaagaactttcactgagaactacactaggtctttaccacttgagcctaagatcacaatctgaaactattcttagcgcccgtccacgggagctctgctttcctagaaaggcactctttcgccacagtggaattcgcctccaaaggttgagggcccccacattggaagatgaaaaattgcactcccttggtgtagaccaataacccggtccccttggtgttgttgccctataataaacactgttttctt

SEQ ID NO: 725269 - DNA, 243 bp, Homo sapiens
cctgctgctgttgtctgtgcatgggaatgctagctacttcgcacatgatttatatcctgagattgctactgtgcttatcaccttaagaagctttgcgctctgagacaatgaggttctctagatgtaggatcaggtcatctgcaaacgaagataatttgactacctttatctctattagaactactctttatttcttcctctgccctgattatcctggccaaggccttctgatactatattgaa

SEQ ID NO: 725270 - DNA, 328 bp, Homo sapiens
  misc_feature (104)..(104): n is a, c, g, or t
gggggggggggggggaccccgggaaatatttttttccttgggggggaggggttttttttttttccccgcccccccccttcccctttgccggggtgggggttttnaccccccgggggtggggggggacccccccggggttttcccccccctttttaaggggggggttttgggggtttttttccccccccggggtccgggtttccccccgggtttttttggtttttttttcccgggggggggtttttttttggttggggggctttgggtccccttttttgggggggcccttttttttccccggggggggggtttttttttttccccccca

SEQ ID NO: 725271 - DNA, 118 bp, Homo sapiens
catgcagcagcaggtctgtaaagtccacagtattctgaagtgctgcggggatagaacccggctctagggcttcaggagggatctctcagttggcattagcactgtgctgaagctgcca

SEQ ID NO: 725272 - DNA, 553 bp, Homo sapiens
tgacatttgtcgtgcatcagggagaaatgcatgggacacacagtcctccactccactcccatctctgctcatcctcccgttcgcttcaggcactcttagcattgtttgtttacccatttctgatactacatacatccatgctgaagatttgccatattactattttggaaacattgagtgatagaactcctagaaaatttgcaaagaaatgttgacatagcgtgtatatcaaaaatctcagattctagtgttgaaaaagtagacactatagctattgactattacttataacctgactgccatagaaaaaaataagtgtattcatgacaagatttacattctggatacataaataaaagaaaaaagggcaacattttacggagtaagtcatggtagtcattagatgatattacatgaacaagttcttaatatgaaaatacttcaacaggaagtaaaggtcatggcttagctgaaggaaatgctccaaaaattggactgtgtaaagcatcagtacaataatacgctgtgtatgtatgtgtatataaaatgagag

SEQ ID NO: 725273 - DNA, 201 bp, Homo sapiens
ctacgtccatgtgttactagcactctacataaacttggggcactttacagacttcaaggcacatttgaagctgcagaaatgttagaagaagctggtatgagtgtctcgtagacagggtcgtgagaatgttcacgaacagaggttggcagaagtgctcaaggaccctgagaacatggctaagcgcaagagccgtgagagtct

SEQ ID NO: 725274 - DNA, 105 bp, Homo sapiens
ctcagagagactcagaagaaagattgcagccctcagaatgcacgttatgaggaaggcagaatgtggtgtccgtaattcctccgtgtcccttctccccctctgcaa

SEQ ID NO: 725275 - DNA, 258 bp, Homo sapiens
aggtcgtatctacaggatcccccgttatagcacgtggtccgcattttatagatgagatagctgagcgctaccgggagaaggatctggcccaagattgtattcttagaccgctacatcttatgactctgtttcctggcttgctttgacttttgggggagttctgttccttctgggtttgcctgcttcacgtcttatgcatcgcacatcgccattttattatcttgtaacggcctttttgactacttttttatcttgtgt

SEQ ID NO: 725276 - DNA, 125 bp, Homo sapiens
aactcgaggatccccaggcgcttgttggcgtcccaagagtcccagtcaggacacaggccgggcacagttgtccaccagtgcgccagtgccctgccgctctgccgtcccggctgaagttggtgatg

SEQ ID NO: 725277 - DNA, 344 bp, Homo sapiens
  misc_feature (13)..(13): n is a, c, g, or t
cagaaatttaaanaatctttcgaatttatgaaaatttaaaaaatctttcaaatttatgaaaatagggacatagcttacccaagattcctgggatgcagctaaaacagtgtcaagaagaaagtgtatatcactaaacgcattcatcaaaaagtcagacctcaagttaattaatttggtacataaaggaactagaaaaccaaccaacctcaaagcttgcagaagcaagtaacttaaattggagaacttaatgaaattgagatgcaaaaatctatacaaaagatgaataaaaccaagagtagcttctgtgaaatagttaaacaagattgatagactgctagctagat

SEQ ID NO: 725278 - DNA, 238 bp, Homo sapiens
acaggcctgtaatccacagcgtactcaggaggccagaggagggcagatcacttgaggtcgcgagtttggagaccagcctggccaaaacgacaaaacaccttctctactgaaaatacaaaaatgaaccaggcatagatggtacatgcctgtaaatcccagaccaccgagaaggctgaagtgggagaatagcttgaacccaggatggggaggttgcagtgagtcaaagaccaagccatag

SEQ ID NO: 725279 - DNA, 818 bp, Homo sapiens
tccttcgttataggagccaggcctacaccccagcaaccatgtccaatgggacctgcagttggtatatgatcttgtgcaccacctactcttgtgtggtgtgttttccagcacggaaaagtcgagataatatgccaatgatcagggaaaccgaaccactccaatgctatgtcgcctttactggacactgaacgtgttgatcggtgatgcctgcaaagaatcaatgttgcaatgaaccccaccaacacagttttttgatgccaaactgtctgattggacgcagattattgatgatgctgttgtccagtcttgatatgaaacattggacctttatggtggtgaattgatgctggcaggcccaaggtccaagtagaatacaaggtgagagaccaaaatgcttctatccagaggaggtgtctaactatggttcttgacaaagatgacaggaaattgcagaagcctaccttgtggacgactgttaccaactgctgtggtcacagtgcccagctataataataatgacctctcaggcgtcaaggactaacaaaagatgctggcactattgctggtctccaatgtacttagaattaatacatgagaccaacatggctggcggcaaaaagctaacgggataaaccacaagggtggagccgaaagaaacgtggccatcctgcactgggagggggcaccaggtgagaatcaaacaaaagaaaggaaacccagcggcaccccacaatggaaacccccgcgagagacagagaacacagcgacacaaagccaaaacagaaaaagagaaaggaagaagaacaaccacgcaaggc

SEQ ID NO: 725280 - DNA, 375 bp, Homo sapiens
  misc_feature (18)..(18): n is a, c, g, or t
  misc_feature (25)..(25): n is a, c, g, or t
  misc_feature (28)..(28): n is a, c, g, or t
  misc_feature (83)..(83): n is a, c, g, or t
  misc_feature (86)..(86): n is a, c, g, or t
  misc_feature (99)..(99): n is a, c, g, or t
  misc_feature (124)..(124): n is a, c, g, or t
  misc_feature (156)..(156): n is a, c, g, or t
  misc_feature (208)..(208): n is a, c, g, or t
  misc_feature (226)..(226): n is a, c, g, or t
  misc_feature (271)..(271): n is a, c, g, or t
ccagggttaggaaccgtngcattgntgngccccaaggctgttgacccaggtgcgtaagccaagccaacacgtgtgaggcgtcnagngcaccctgctgcngaataacgagggatcactgctggcntactctggttacggggacacgtgacgcccggntcaccgcgtgccatagccagtaacatctgggccgcctacgaccggaacgganaccaagcgtttaatgaanacaatctcaaattcatcctcatggactgcatggagggccgtgtanccatcacccgagtggccaaccttctgcttgtgtatgtatgccaaggataccggtgggcttttggaatgctcaaggccaaaggccaggctttggttgcaggtacc

SEQ ID NO: 725281 - DNA, 220 bp, Homo sapiens
  misc_feature (92)..(92): n is a, c, g, or t
  misc_feature (183)..(183): n is a, c, g, or t
acgagtgagactctgctcccaaaataaatagtaataaatagcccagataagaagccctataataaacttactgaatgttgggaatatcactnggataaacattctggcctttgttcttaggttttcccatggcctttcctgatctagacaacatgaagcctagctttctcccattatcctacnagccatacttgtgactttaataacaaatacccccgag

SEQ ID NO: 725282 - DNA, 361 bp, Homo sapiens
tagctgttctagaggatcccagctcaggcgagctgcgagtgggcgaggttcttggcagtgtcagcaggtcatgcccaggccaccaacgtggttcctcccccaggaacgcgtgtccttgtacagctgctgcaggcgggagctgagctcactgatcacagttggtttgtcgtcttcaggcccagggagcccccggctctccacggggtccccccatagcttggaccttctctggaagaggtagcgagggcgggcaggcccggctggcagaggccagcccggcagaggcggcgtgctgctgctgggccatgagctcgctgtccgaggactgcttcagcaggctcgcccctgagttgggtaccga

SEQ ID NO: 725283 - DNA, 320 bp, Homo sapiens
ttaaagctcccctctgacatccggactgtttcttctcaaataacaaatactatcctccatctcagtcatatacctatcatctctccctcactaaaacgtaagacagtaaccacgtccgcggtgatgtctcacggacgataaatcgagaacggatcagaggtctatcctagatgtaggtggatttccccccctgtggtgaacaggaaaagttggcgccagtcctttcatgtgattaaggatgacatggatggagcgtggtggagggtagtgtgagaaaaagaatgtatatatttgtgtgtgcccgtaagacataaccgcgg

SEQ ID NO: 725284 - DNA, 741 bp, Homo sapiens
gtgggctctatgcttgtgctgtgcgtaactcagtccaccggcaaggtaaagctccaaatccatcatagtcaaagtctctgaactggagtgattacccatgaattctactgtaggttcccccgaagttccgatgtttcatcacgccatggagagtcgacagaaccagcgaagaggcactcgtgttgccagaagcccgtatacaccgtgggaggctggagcaacgtcgatggtaaatttgcatgggagaaatccgttgttacctggacatgtgagccagctcaggaactcatcgcaaaatgttgcggactagccattaactaagcgagacttatctcaatactgtaaaccgaggtatatagtacagtgtgatgacttcggcattgtggagcagttttgccaagggatgtcgagagacatagagctccccatcatagataaggctcccagcccatcttgagctgtccttgcgtcatgcgctgcctcatttcagcgttggacaggataatgcaagtcagtgagaagtttcactagtgtagatagacttctggagggtaacgaacagagtgtctggatatgtggatcatcaatcgtcgaaaacttgtacgtaactatctcagggtgaaatgtgggtctctcctatcttgcagtacatgggctctccatatagtaatatgatcgacagagatattgctgtgtgtttgcagagaagatggtttctataaagagtaggaaagtgaaata

SEQ ID NO: 725285 - DNA, 467 bp, Homo sapiens
gcctttttcttgtgtaaaaggaaagtattaatatatgttcaagaaaataacatacataaatgaaagcaagatgtttattcactcacacatagcttttcagaaataagactaaatgtgtcataataaaaattctggcatgtatctaatcagtgatattttgcacttgtggtagttaaaaaaaagatgtcacatagctattttacagctatagatgtgatctggtttgataaacatttattattttctttccactctattgccataactaaggacaaagttgtcacatagaacttggagagatgggcttttattatctctgagcatctattctaagtgttgcatgcttggccaattggtcagcatggctctagaggcagtaacataagccattttcataaccatctcctttcataacaggaaaggaattggaaaagggagagtttgtttgcccttaaagtaaaaaaaaa

SEQ ID NO: 725286 - DNA, 383 bp, Homo sapiens
  misc_feature (168)..(168): n is a, c, g, or t
ttccggacaaccgtgcgcttagtaagatggggcgcgcgggggagaagggctgccccgggccctctggttctcggtcccccggcccaaggaccgggttccccggcttcccccccccgggcggcccaactgcgccggctccccccagggaaaccctggtactccgggggntcgccgggcttctctcctggcctccggtcccgccagacacctcgagctccttaagtagctcggtccttgacgtccctctgggcccttcccgcgtctatcgcctgagtccccgggcccctctagccctctgttcccgtcccactcttttgttcctccctagagccccgccgccctcagggctgacagtgtggacggcgggagtctcctcgctcccc

SEQ ID NO: 725287 - DNA, 803 bp, Homo sapiens
  misc_feature (520)..(520): n is a, c, g, or t
  misc_feature (558)..(559): n is a, c, g, or t
cttcactgcagaaacagtatctcacttggccatggctgtggatggaacatctttaaaaagtctctcctataaatttatggcccctggctagcactctccatcacaggtatagggccaaagttcatattatttacatgttcaaaagaactgcaaactgtgacttttaattgcaagcatatctggagctatagtgcccccaggcctctggtagaaagaaatgtatgtccttgcaggaggaacccccaacccaggcctcaaggaattccagccagcaggatccctagactataagctcatagtggaaaatcacagcacacacaagagaaggggcctcagaagttatggccaaaagaagcacacctgcaaagactcagatgttagaataggaaatgcaaatatgtttaatgtgtttgaagaaacaaaggagaagctaaaaagcataaataagcaagagagtatcagaggctaagcagataataaatgaaccaaatagaacctctaaaaatgaaaaatgtaatanttgaaattcaaaacttaatggaagtaatcttgatcccnncctcacaccccatagaaaattaactcaatgaatcatagacccaaacattgaaattcacaactatgaaacataggaaacaaagttttgtgactattgggttaagttaaacattcttagatatgacaccaaaaatagagcctataaaggaaaaacaatggcaagtcatacttttattaaaattaaaccttcttgctattgtgaaaaccattgtttagagaatgacaaagacagttaccaggagaca

SEQ ID NO: 725288 - DNA, 371 bp, Homo sapiens
tacagacatatataaatagtaagaacagtacaaagcttataactaaaatagagagatggagcaggagaaagggagagaacgcacatacgggaacgagtactcaaactaatgctcagaaccggtgtacagtgccatagaaaccactttcccaaatggaggcgcctttccttccctggggatcgtggcagagggagtgaccgccaccgccaccatgcctgctgcactccctctccgtcccactttccatttctcattcttttatcatcagcatggcatcttggacatccggcaattatcactcatccacctcatcgttctttcatcaagtagatagttaaatcattaaagacaacaggagtcatcaggggtca

SEQ ID NO: 725289 - DNA, 381 bp, Homo sapiens
gaagccctggaagaaaccagaggcttctggaggaaaaaggaccctgtacccctgttcaaggtctacgtagaggagctggtccagcggcttcaggagcaggttctgtccaggcccgcagtggtgcagaagagagccggtgaccacgcctgagcactgggctcagcctcccctgtgggcagtgggcgaaccccacttggcatgtgccgagcacacagttcctgtggtagacttttcagagaacccttctgtgccaggactcgtggaagcctggagcggagcagatgcctgtccaagctggtcaagtccttctagttcttgggctgaaataagtaacagtctgaggcagcctgcgccacagtaaagtgtgttggtttgcttgga

SEQ ID NO: 725290 - DNA, 659 bp, Homo sapiens
gcactgaagaaagcaggacgtgagtcttaaggacatggattggtagaggtgaatgaagcttttgctccccagtacttggactgttgagaggagttcggatcttgacataagtaaaaccaatgtgaatggaggagccatagcttggggtcacccacgtgggaaggatctaggatcgaatgaattactgtcacgaccttggttcacggaatttaaggcgtcgaggtggaaaatatgccgttggatcagcttgtcatgtgaggtggcctaaggtattgcgtgtcgatcatttcatgagcactagcctgaagagaccagatgagctcaactgtgatcccatccttacatctacttggccatggtccaacgagttaaatagcaagtgaccttcaggagcagctgccacaactgggccatgccctgccattgaaacagtgattgagtctgatcaagccatggtgacacatagagaatgcatcgatgcagtgaagtaggagcccatgcgtagaaggtacattctctcgagattcgaacgcagtgaacactatgagtgtatttctgagctgaaaactcaagtataggaagacattaacaagaaatcgtattcttggccaagtaaccaccacttcgtgccttagagtggatatgattatgggggaatc

SEQ ID NO: 725291 - DNA, 901 bp, Homo sapiens
gtttgggcacctgtatttccagctactcgggaggctgaggcaggagaatctcttgaactcaggaggcagaggttgcagtgacccgagatcgcaccattgcactccagcctgggcaacagagcgagactccgtctgaaaaaaaaaaaaaggagaaggctgccgggctctgctcaggtgacgggtctgaaaggcggctctgagaaatagctggtcctccgggccaagagcgggcctgggccccggggcagccacacagcagggttctggtgtttcaggatgaagactccggggaaggttgacagcgacgtgggctgacgacgtgcctggtggcccaggagaccgtgcaggtcattcctgggcagcaagctggctcgggaggatcaacacccgggccccccaactctggcccagatgtataatttcaccgagtttcactggtgagcctcaacgagctgggagacaggcatggagaagacccttgccacccagggactggccgccttgcgccctgacatccggcgggcatgggagaatgggcaacatgggatctgggccagccaggagaaggagcggctggaggagaagcagagagattcacggagggagcgggccaatggaggaggcagagtggcagacgaggtggttctacccagggtattaacccctacactgggacccccgacgtggttgtatgcggggatcacttgacgacggatttctccgaatggccaggtttttactgggggccctggatgcgcctggggcccggaaccgctacgttgataaggttggcattctccgagtggccgtggtagccctgtcacgggcacccaatttttacgatggtccgggagaaggtaccctggtaggggttcccatacggtcgtgcgaccatcctgtg

SEQ ID NO: 725292 - DNA, 1237 bp, Homo sapiens
  misc_feature (1237)..(1237): n is a, c, g, or t
cagacactcatccgcgagcagatcgcctgaaggcgtccgagcaccgtcagaccgtcttggagtccatcaggacggctggcaccttgctttgggcgaaggattccgctgccttcgctgacagaccgggcacaaagctgacagccacggtgcgctgggctgacgctgctggctgctcgcgcggctctactcagccaagaactgcgacagcccgtcactggccgccttcactcgaggctcggctggggaagccgtccctagctgacgggcagacgtcccgcatcacggctgctgcgcaggcggctgcggccaccccactccacggtcacgccggcggcctcctcagctcgaccccaggacgtgcctggcagggctgtagtgcttacgtcccagccttgcacacgcacggcgtgccgccgacatcgccactagcaaccaggaacacccaacgacacgaaccgggggcctgtaccaggcaccatcctgctgtattgggccaccaggccaccgcgcaccgacgcctgtttgcccacggacacctcgcccttgccactcaggcatggacctacgcccatcatgcccggccgggcacgctggccccccatggcgccgcgaacggcgtgcccgccattgcccacgctcttcgactgggccaattaccagccggcgcggcctccttgctcttcatggcatgaagccagacgcccttccttcggaagcgagccattgagcgcagattaagcaaggaacttcagagccacattgaaggcttcttgtacacatggggccaacacagcacaaatcatgctggtcctgggccagcatttggcttgcacaatttgaatggggccctaaaacaggcccgctatgacttgaagggctccacttggaaactggccgacacacgagagagcgaacccgcccctggatagagcactgcggctttttacgagcagcgggtgtatataagccggcctccaaaaacagaacaaggggcccttagacggcgcccatattaacaccgacaggaagatccagagccgatccgcagcagagcagagtacgttgcgagaagacgcgcagcgacgtagtcgacgagcagttccacaaatagagccacacgagacaatagcaactctgctacactacaccccaagacacgaagcagcggaggacggcctactacacacagaagcatctacattagcacatagaatcaagacatagcgagtcgcaagtn

SEQ ID NO: 725293 - DNA, 210 bp, Homo sapiens
cccggaggcttggatggccggaaggctagagattatgaaagagatttgggagacaacacaattcaagataatgtccctcctatacttacattaagaggctgtgatggttggcatgaagaagttagacatgagtcatttagaatacacactgaggggggccattcaacgcctccgggccattcaatgcctccgggccatcaacgcctcctg

SEQ ID NO: 725294 - DNA, 735 bp, Homo sapiens
tggcttggtgttctcctctctccgccatgccgtgtgctcgcccactgatatcggtgtactccgaacaaggggtgaacgcacatctgccagaaaattgtcacttggcctatctgctattcaaggctcccaaatacggaccgagctatgggctgaacacttgggtccacacacacaactctttgtccgccaagatacacaaccaggatcacgccttaatggcttagtacatcgttgaaattacaggcaggctccattcagaactaacttagctggaggctcctgtggggggtaactgggccagaaagttttgtcgcgcctccgaattttcccccaagaaaagttcccggaagggcatggcctatggcgggcacctttccacgctcgacattcttggggcccccagattgaatgtgccaatttgaggggcacaaaccctctattgtattatctcgaataggtcatgtcccccggcaactattgtttcgaggcacacccaacactcccaatcacacttccctgttggggcgttcccgcgatatggctccatattccggtataagacacgtcttgcacacccataccgaaacgtctccgaaaagaaaacagcactgcacttagcggtgcccgaagatcgctttgtgttgtacgttgggcgcccacagtgggcactttggtcccccattctaagccccccctataaccccgaacgacgagcatgtggcagcataccaaatg

SEQ ID NO: 725295 - DNA, 131 bp, Homo sapiens
ctgaaactccagtttttatatgtgctacggcggggctgaaggatctgctcagcgtcttccaggcctaccagctacccgctgatgactacaccagtctgatgcctgttggtgacccccaatccatcacaata

SEQ ID NO: 725296 - DNA, 519 bp, Homo sapiens
cgcggagttcaagatgatgtatacggtgtggtgtgtcatagctgtgtcttgtattgaggtatgtcctttaatactactttattgagttttaacatgaagctatgttgaattttatcaaaagccttttctgcagctactgagatgatcacgtggtttttgtctttagttctgtttatgtgtttaatccatcttgaattgattttagtagaaggtgtgaggaagggatccagtttcagctttctacatatggctagccagttttctcagcaccatttattaaatagggaatcctttccccattgcttgtttttctcaggttagtcaaagatcagatagttgtagatatgcagcgttatttgtgagggctctgttctgttccattgatctatatctctgttttggtaccagtaccatgctgttttggttactgtagccttgtagtgtagtttgaagtcaggtagtgtgatgcctccagctttgttcttttggcttaggattgacttggtgatgcgggctctt

SEQ ID NO: 725297 - DNA, 391 bp, Homo sapiens
gctcacatttttagttttaagtatgcctgcctatgcttcataatactagatactataagaaagaaattactggaattctgttcctaataaatatggtgaggagttctgtaagctttggacttccacataatgctaactaaaggaataattttgttatagtatctattaaaattccttcctcgagagactgtcagtgcgcatatgggttaaacacgaagtgcaagtcagccgggcatggtggcgcatgcctgtagtctcagctacttgggaggccaagacgggaggattgcttgggtccgggagttcaaggatgcagtgacctatgatcatgccactatactcgagcctgagtgacagggtgagaccttgtctcaaaaaaaaattaaaaaaa

SEQ ID NO: 725298 - DNA, 449 bp, Homo sapiens
  misc_feature (4)..(4): n is a, c, g, or t
  misc_feature (122)..(122): n is a, c, g, or t
  misc_feature (206)..(206): n is a, c, g, or t
  misc_feature (211)..(211): n is a, c, g, or t
  misc_feature (214)..(214): n is a, c, g, or t
  misc_feature (253)..(254): n is a, c, g, or t
  misc_feature (260)..(261): n is a, c, g, or t
  misc_feature (263)..(263): n is a, c, g, or t
  misc_feature (268)..(269): n is a, c, g, or t
  misc_feature (271)..(271): n is a, c, g, or t
  misc_feature (275)..(275): n is a, c, g, or t
  misc_feature (278)..(278): n is a, c, g, or t
  misc_feature (292)..(292): n is a, c, g, or t
  misc_feature (297)..(297): n is a, c, g, or t
  misc_feature (303)..(303): n is a, c, g, or t
  misc_feature (306)..(306): n is a, c, g, or t
  misc_feature (315)..(315): n is a, c, g, or t
  misc_feature (318)..(318): n is a, c, g, or t
  misc_feature (322)..(322): n is a, c, g, or t
  misc_feature (341)..(342): n is a, c, g, or t
  misc_feature (360)..(360): n is a, c, g, or t
  misc_feature (369)..(370): n is a, c, g, or t
  misc_feature (436)..(436): n is a, c, g, or t
aaangattgcagaatttattctgaaattacttaaaattactgtatgcataaacttacaaaaacatatgctataccaaggcagagaaaagaaaaaaagtgaagtggctacaaacgtccctggngcatcacctgctcacctaggaaccaggagtactggatactgttccgttactggtaacctatctggatgtaaaggttcataagtnacaangcntttcttgtttaaaaaaaaaaaaaagtctgtcctttacannccaaanntnaaacnncnacanatnctctttgggctttnagggncactangtnactccattnggntganaccaactaagatacaattnnggggatcataatcttttnatgaaattnnagcagaaaactgtccaggaaaatcagacttcaaagttggtgcaacttagctgatctcatgaaaatnctttggaatcttc

SEQ ID NO: 725299 - DNA, 84 bp, Homo sapiens
gttaaggattggaaaagtctaattttatttttagaaaaaagggaaataaatttgtttttgcttgattaaaaaagctttttccta

SEQ ID NO: 725300 - DNA, 731 bp, Homo sapiens
actgccgtttcctcatctgtggcgcactgactgactggtctgctggtctgctgcagtcctgaggctgcacctggctgctacttctgtgtgtgcacctgagtgacctgcctgtcctgcttcgctgcagacggtgtcccccgccgagaagtggatgctgtgcacatctgccatgcaccctcagtgtcaacatcttacatgctgtcaccctgtaatgctgctactgcgcaccttgagctgctgctgtgcctgtgccgactgagatctgcctgttgtgacctgctgactgtgccctgtgtgtgctgtcgactcgcttcatcaccctcgccttccatgtgaccatgctgctacatgcgtgcatgacctgcctgaccacctgcttcctgctgccactgactgtggctgcctgtgctggctgctgcccctgatgcctgtgccagctgtgctacacagcttgtgcatgttcctgctcctgtgcaatggttggccttcctgctgacttgctgagggcctgttacctggctgcctgtctgtgtggcccatgctggcactgctcaatggctgggcaagtgccaccaatgtgtgtgtgcaatggacgatgctcttttgctctggagcatgatgctagcgcccagtgtctgtgcttgcagtgctggcctactgagacggaactgtgtccacgcgccagggtatggacctgtcttgccaatcaggacgaggaagacctgacagga

SEQ ID NO: 725301 - DNA, 293 bp, Homo sapiens
tctgttccgcacttaacacgtattaccctgcattgtacaccatatgaaacatcctatcatcagtatgctcatccatttctctaacagcagtaatattaataatttacatgatttgataagccttcgcttcgaatcgcacatgtcctaatagtagaagaaccctccataaacctggagtgactatatggatgccgcccaccctacctgggttaggtctacctggcaggtagacctaaattaatctgcatgaaaagacaaatcacgatggttggggggaaaacttataccaaaga

SEQ ID NO: 725302 - DNA, 244 bp, Homo sapiens
tatcccccccctcacaggatactcaattcatagatatagcgccgtctagtgatccacattcgattccctggagctacttggcatcacgcttcttgtctcccgctatcaaccttgagatctctccgggggttgccgatagactgtgaccgcctcccaggcgctgtccaggtcaaatttgcggaactctcgggccaactccaccggctctcgccatcaccccgcttcacttcatcatcattcacgt

SEQ ID NO: 725303 - DNA, 135 bp, Homo sapiens
agaagagcggggtcggggccggctgaccaggaacctgggcgagcagcggcgggggcccagggattctgaggaagatttccattaggtaattttgtttattcagttcagcgaaattagggaaaaatggatttggaa

SEQ ID NO: 725304 - DNA, 366 bp, Homo sapiens
  misc_feature (148)..(148): n is a, c, g, or t
  misc_feature (338)..(338): n is a, c, g, or t
  misc_feature (363)..(363): n is a, c, g, or t
ttcttgctctgttgcccaggctagagtgcagaccatagctcactgcagtcttgaccttccgggctcaagtgatacttctgtctcggcctcctgagtaactggaaacacaggtgtatgccaccatgccctgctaatttttttaattttnatttttgtagagacaagttctccccatgttgcctaggctagtctcgaactcctggggctcaagggatcttcctgtctcaacctccgtaagtgttggggattacaggtgtggggcttaccatgccttaaccttgtttatttatggaaggatgggggtctttgctatgttggcacaggctgggccttcaaantcctggggcttctagttaattcctnttt

SEQ ID NO: 725305 - DNA, 525 bp, Homo sapiens
gatctcacccactggtgctgctggtcctgagaagaggatggagaagaagacggagcagcagcggcggcgggagaaagctgctcgcaagctgcgggtgcagcaggctgcactgagggcagcccggcttcagcaccaagaacttttcaggctgcgtgggatcaatgcccaggtggcccgaaggctggcagaactggcacgccggagggagcagcggcgcatacggcgactggcagaggctgacaagccccgaaggctgggacggctcaagtaccaggctcctgacattgatgtgcagctcagctctgagttgtctggctcactcaggacactgaagccagaaggtcacattctccgagacaggttcaagagcttccagaagagaaatatgattgagccccgagaacgagccaagttcaagcgcaaatacaaagtgaagctggtggagaagcgggcctaccgtgagattcagttgtagctgtgcagatgtcggagccccgcccctcaataaagttctgtgaccaaaaa

SEQ ID NO: 725306 - DNA, 981 bp, Homo sapiens
  misc_feature (5)..(5): n is a, c, g, or t
  misc_feature (507)..(507): n is a, c, g, or t
  misc_feature (981)..(981): n is a, c, g, or t
ggcgnatttttgtggcatccggcgtcgttcgtccaacggggagggcgacgcgtctactaaacagaggacagaaggagccgttatttttacatcttccctcggcggccggcgtggcgcgggagccggccgcgtctgcgcggcgccgattgagatagcgcgagaacgaacacacgagtcttagcccgagcgggcgagctccacgcggagatgccgttagtggcgttggtgcgcagggtgccgagttgtggtaggggcggggcgttcctcgtgtcgtcttcccttcttgcagtttttgttttctttatattatttaataatcttatctagtgttatattatttctgtggtctctaacgcttttgatttattcatgtttaatgtgatttttggttgttctgggtgcggtcgttgttgcgtcggtggtactgctgtgcttacacatcacatctccttctctcatactagacacctccgagcgccgcttcgtagactcatcacactgtcgcgnaccgcagtcttaccggcggtcagcaagacaggtaaactaaactcgacactcgacctcttatccaatctgcactcaatcgcctactcactactcataatgattgatgaatcacgcactcaacatatgatcacccaacaccgaacctctttacctgtcactgccgcaacactatcacaatctatagtaccacattgctagatatgtcgtgcctcgcactggcgttcactcactgcacgtcggctctcgattcccgtcatcgcggtgcgctagcactctatcttatcttgtattaatgtctgcactctcttgtttgctccctattgtatagtagagtccgcgctgcgcggcgcgtcgatcgggtgaagtgtaggtggtgagcgacatgtttctgttctgccgtgtatctatatgtagccacttctgaagtcgatatggtcacgggagcccagcgggtctcgccgcagcgcagcggcn

SEQ ID NO: 725307 - DNA, 197 bp, Homo sapiens
  misc_feature (1)..(1): n is a, c, g, or t
ngggacgctgaaagcgtccactgcacgcacagcctccactgcacgcccagcctccactgcacgcccagcctccactgcacgcccagcctccactgcacgcccagcctccccatgtagctaggcattacatgtgtgctgtgacactatgcccagctgactttaattttttttttttgggaggcggggggtgcaggggt

SEQ ID NO: 725308 - DNA, 324 bp, Homo sapiens
gacaatcttgcacacacgaagaacagtgtaaattaaaaccaaaccaaaggctgggtgtggcggctatgctgtaatcccagcactttgggaggctgaggtgggcagattgcttgagattaggagtttgagcctgggcaacatagtgaaaccctgtctttataaaaaatacaaaaattagccagacatagtggtgcacatctgtagttccagctactcaggaggctgaggtaggaggattgcttgagccagggaggtggaggttgcagtgagctgaaattgcaccactgcactccatcctgggtgacagaacaagaccctgtctca

SEQ ID NO: 725309 - DNA, 450 bp, Homo sapiens
ccccccagtactgctgggttgaaccttggtcgtgagctggctgcgtgccgttgggtacgaataccagcatctcataatctggtcacttccagatatggaagagtatacaattgaatatattatgtcactatttcgtcttctctttatagtatcgtatcgtatgactgggacaggttgcctttcccgaccctgctacgctggctggtgcccgcacaatacctccactgtcatggtttgtcactgcatggtccgtcggggttgtggtcaccggcgcagaggacatgcacacggccacgctacgctactgttaccaagaggtgacttcagtcactttattatgtcaataggttacacatctaccttctgaatattatcacatacaatgacttataatgtgactacctgcgtatcagcaagccaagtacagtcaaggttgctacgggggtaccg

SEQ ID NO: 725310 - DNA, 161 bp, Homo sapiens
gggaatgtcaaaacgagaggatcactgtagcccaggcgttagagaccagcctggcgacatcgtgagacttcgcctctataaaaaaatagaattagccagctgtggtggtgcacacctgatagatcccaggctacttgaggggtctgacggtgagatggact

SEQ ID NO: 725311 - DNA, 248 bp, Homo sapiens
gggagcatctgaagcgcgaaccgcagctggtggagggcgcgatcgaggagagcctgcgtttcgacccgccggtgcttggccatttccgcaccagcctgcaacccaccagtctgcacggcgaagccttgccgaaccgggccaagctgatgttctccatggtgggggccaaccgcgatccggacctgttccctgatcccgacgtgttcaaggtggatcgtccggcgaacgaggcccgtaagcacctgtcc

SEQ ID NO: 725312 - DNA, 776 bp, Homo sapiens
  misc_feature (533)..(533): n is a, c, g, or t
agcggattggtccgaccgatcccgcctccctccggatcgccgttccgggtgcactcggactcggtccgaaattgcagagctctgtggtaagcttagcgccgtcgtcgatctcgccattcagatcgtccagtcgattgatatatctaccgggtaccgtctatcgagcgcatgcatgaccatagttctccgcacatctacaagatcctgaggatatacgcctgaaccgggttgtcgccgtggaggtggaggggaagatggtcgggaggacgatgaaggtcacagttgtagtgactcagctcattggtggatatgctcgtcctgctgaagagacccgagggcgatagtgtaccccaaataggcacaagtaatcactggtgtctattttgtcttttaaccatcaccttgcgagtgaagacatagttttcctcaacatagaagcctactagactgtactagtctacaagattgacatagataatcactcatacacgtggaaacttggaatgaacacgagagccagaaaggagtaaaanccttttaatggacaggggtctgcaagaacaaatcgagggacatccttgattaactttacagagaaacttaccagatatctgttgatgggtgaataatatgacatggcagatggcatggttggctctaattgggcactaccgctgagtgatggtgtagacgcccatatatgattctctgtatggatggtgtaggtaagatggaaatggtgttaagggaatgtggcatgtatgtgttgtgatcga

SEQ ID NO: 725313 - DNA, 164 bp, Homo sapiens
  misc_feature (73)..(73): n is a, c, g, or t
  misc_feature (88)..(88): n is a, c, g, or t
gcggctgcaggcggccttggccaggccggcgccggggggctgcagccaagaagcgtttcgttttcaagacccngggaaaggatgcttnttcgtctaccaaagtagacgcggctccttgcatccccccgcagttgaaagcatacagggctccccgctgcccaaga

SEQ ID NO: 725314 - DNA, 103 bp, Homo sapiens
  misc_feature (79)..(79): n is a, c, g, or t
  misc_feature (87)..(87): n is a, c, g, or t
taactttcattcagtttcgttgaaactgttcgtttctttacagatttaacctttacatatttcgtttgaaatgctttgngagagatntgaccctcccttcatt

SEQ ID NO: 725315 - DNA, 1549 bp, Homo sapiens
ggatgttgtccgcgcgactttccggcttcaaccagggcttggacgagaaccctgtgcgctctttaccataatccgtgccgtggtggcgttatcacatggcctcaggccatctctgtagcgggaccactcgcgtagcacttgaggacggacgcccgagctggtctagaggcgtcgccctccatcgccgatcggcgccctgtctctctgttaaggtgctgtcgagcagtcgcacagaggcggagatatgacacgtcgcaagcgatggcagcaccatgcgtaaccccaccctaggcgcaccgtccaacagtggcttgttgagtccaagtccagcttcaaggactccacataactcgcgcattggtcccttaagccgtcccttcacatgagcggtattggaacacatcgttcccaagtgggttctctcaccttgacctattcggaaccttggcgcactagaacttgattgtgcctattggccacacgccactaggtttctaggcttgaacactcacttttctcttgtttagcgaccagcaaaaatagctttgcactcgttaatgataagctagccgaggcacacactatcgcgcctcgggaaggaaataggccttgcgattgccccaaggaatttgccgggggaagaaaccaggagggctaggggtagagttgcacgggagggtaggcttcgctctcttccacgatccattacctccattgtggacaaaaaatcctcaaccaacttgtagttttggagttcggaaccgtggcgcgcaaggcacgcccgcgagcccttggcagactttggccgacacttcgaggtacacggtggctttgcccaatgttatcaactccccttttttggcggtatcgcgaggagacaccaggtaggattgtaactcattaccaagtcctgcgataccctaacgcttggggcgaacacactgtgtgccaccccaagaaagcccttcgcgagcgccaaacgttcgtagcactgaggaaagacaaatttgcagcacgccgcagccagaggtatagtggatggggtagaaccctcgtttcccaattgtttggaatcgaacgacgcaaattatataaccccctttgcaataattcgaacgccatggggttgaagactagtgagcccatgtctcaagcacgcaaaagtttagggagtttgaacggcacaccaagggttgaaagcgccatagaaggttgtgcgccagcccaccacgatagttgcgttgaaggtcggcccctctggtaacaatttcttgggtccatttgttgtccggggacacgtaactcctttcgtttgaggaaagtcaaggtaccagcgaccgcttgtggggaacgcaccacggtggcactacagatggaaagaagcatcgttaagaggccctttgtggtgaccgttaaatttttaccccgccacattagagctcgctcctggagcgctgtaacagattacgccctggtggctgtccaccccaaaagggccagggcctggcattgcgcaattgttaatggggggcttacccctataaacgga

SEQ ID NO: 725316 - DNA, 1053 bp, Homo sapiens
gagccctactgttctagtcctaccacgaggatattacctctcatccagcaccttccccttagtgagcgtactccggggcaccgcttggaccaaagagcaaggcagaatgtgagattctgatgatggtgggcctgcctgctgctggcaagaccacactgggccatacaaacatgcagcctccaacccttccaagcaagtacaacatcctgggtaccaatgccatcatggataagatgcgcggtgatgggcctacaccggcagcggaactatgctggccgctgggcatgtcctgatccaccaggccacccagatgcctcaaccgcctcatccagattgctgcccgccacgcaacacgcaactatatcctacatcacacaactgctcctactgcgactcacccacagcacgaaaaatgacaccatctgaacgcttccagcgcaaagctatagctaactcgctcccacctgacgagcgacctaacaagaccgaccaataaagccgaaccgacgaggacagggaaggcatgtcccacactcatgcggctcttagaaaatgaaagcccaaacctacacattgcccacactgtcgaacggacctcccctggcatgcagagtacactgtccactcgacgccattgcaacggccacgaacgaccgacacgcctacctgaaggcaatacaaccaggaaggccacaacggcatagaacacaacccccccatgaaaacgcagtcctgcgacaaccgaaggtcctacgtgcgcctaacagacgcgacaggcgacaaggaaatcgcaatcccacaagacacacacacacaacagacccacctagaagcaacacagggccgccaccacgaaccccagacacaatctaccctctgacagacacacttcccaaccaattaccaatcatactcatcctttcttcatattccacaacacacatcacataaaacatacatactaataccacaaacaatacctaccaccacccaccaacctcaactaactcacctcaactatccctcctactcctcgctatcacactcacataa

SEQ ID NO: 725317 - DNA, 794 bp, Homo sapiens
ggtgtggagttgccttgacctgcagctccgccaccgcggacccgccttctgccctcagcagcagactgctctgtcccgcccgggcagctctgcgaggcagcggctggagagggaaccatggggactgtgcacgcccggagtttggagcctcttccatcaagtggacctgatgttcggaggattacggagaatgaagctgaatatgttgaagtttgagcctgaagctaaacaggaaattcttgaaaacaaagatgtggtatgtatcaaccatgttcatttctgatggacttggaaggactaaagatcgatatcatcgatctgtgaaattgcgcagatgtttgtcaaggccgaaaaacctcaagtgacggtacatgcgcgaaatctcatgaagcccgtgaaaaattgctccgtcttgcgaattatgagaacaagtgagatgttttgatggacacattgtcaaggtgattgacgcacttccaaatgggttagacgttacctttgaagtaactgaatcgaggagattaacgggcagcttataacaccatggttgggaacaatgaaggcagtatggtcacttggcctcaagcttcctaaactcattcgttgggtcgttgcagaatgaggtgaccatatcagcagttcccttatggaacaaagagaaacattcgatatggacttgtaccttctatcaacaccacgtgcccggcaaacttcgaagcgaaatttctcttgtaaacttatataaagttcctggacaggtaccctttggcagctcactgccgggaagacggaca

SEQ ID NO: 725318 - DNA, 201 bp, Homo sapiens
agcagctgttcagggctatagggacaattgattcagggtcttgacagaggactatttgtcctgcccctagtggcccgagatgtgggctcaggagtgacaggtcggtctgtggaggtgggaggctggagctcaggtgctgcgggcacaactgtttcaggagtcttgacagaggaccgattttttcttcccctagtggtccga

SEQ ID NO: 725319 - DNA, 458 bp, Homo sapiens
  misc_feature (220)..(220): n is a, c, g, or t
  misc_feature (274)..(274): n is a, c, g, or t
  misc_feature (387)..(387): n is a, c, g, or t
  misc_feature (392)..(392): n is a, c, g, or t
  misc_feature (403)..(404): n is a, c, g, or t
atgcgcgacgcttccctccatattttcttttaccctggaggccgggaccgccaagaaatgtttcctctccagatccactattaactgaaaattcccgtgctctgaatacttgttttttttttatttttaaaaagggacctgaatttctattaaaggatttcctttattaactcctgctgaagaatttacatattggcaggttggaaagtaagccctgtangaaagaaatcggacttgtttttcatcatcaacatgacggtctgatgatgggtgnatgagtttcctgttgacacccatgtcacatttactgaattactgttgagaccacagggtagacccagcttatacaattcttttgtcttctttctgcttcacagatcattcatnatcanacacggggtannaaatgagggagcgaaacttgtgtaagctaattttcactgttgctggaagcggaa

SEQ ID NO: 725320 - DNA, 106 bp, Homo sapiens
aacatttacatgaggaagaaatgcgaggcttgctcatcgtaggaatgttttaccacatgcctatgttacatattgattacagaataactaatattaaacaagaaag

SEQ ID NO: 725321 - DNA, 210 bp, Homo sapiens
taggaacctattatccggtggcaggtaggcgcctgtgagactgggttgcctctgctgtcgtagaaactttctctcttggtgtgcctagattgatcggtataaggctcactctcccgccccccaaagtgtttgatcgttggaacgagaacagggccatgtccggagtgtatgacaaacatcgggatcctgggacacactttgaaaatgcac

SEQ ID NO: 725322 - DNA, 178 bp, Homo sapiens
ttcgagctcggcaccccttaagtgccctcatcgcgagtcttggctgtgacgaccctgatttttcagtgggacgacgacctggcggcggacgatcctcggcggtgctggcccttatcagcgaggaaaggaacgacattgtcctgactcgacgaccactgtccttgcgtcaccatgctgg

SEQ ID NO: 725323 - DNA, 778 bp, Homo sapiens
  misc_feature (476)..(477): n is a, c, g, or t
acctgtcccaatgggaagcggctggacagcggcacatgcgtgcctgtgccctctcgaacgccccccccagatgctccccgtgcctggaacctgtaacctgcatgtgcttcagacggtggcagcatgtttcctcatatgcacggatggcagccgcaaggtgccgcgtgcctagacctcgcgcttacacggtgctgacgaagctgctgaacgtgtgaccatgtgcatggtgtagctagctggtcgcaaagtggtgggctaccttgtgctgtcctcgcgcacctctgtgcatggcccacggtgctcgtgtgcccgcacgggcgttcacgggtgccccaatatgcggccgcgagcaaggatgtgtgctgtggcgtatctttggtgccacacagagcatgcacactgtcgagcatgttcaatcgctatggtgctagtaccatgcaccctatggttgctcgtgaatgcgcgtaactcctgtnncttccgtaggtgcttgacctgctagcgcaatgtaaccggtgcaagctgcgtcgtgagtcgtactatgtcgagcaatcttttgtgcagcgatgcgcatgaatagagctgcgtgtataggcgtctccgaactaattgaccgcgtagcactttgccgtacgtttgaagcggcatcggacgagttgtgatggtcgaacgaagctgtcagctcggctgtactcgaaagtggcgccctagtgatgtgtctaacgagagcaagagctagggtgatatgtcagcgtgcgaagtggcacggtatttgccg

SEQ ID NO: 725324 - DNA, 146 bp, Homo sapiens
aggagagtcagcggctgcatcctgtcccaggggccctggacacttggacctgagaatgtctacttgcctgctggctctgcttgagtggaaccccacaggctaacagagacagcccgaggacccacctggatgactatgtgaccact

SEQ ID NO: 725325 - DNA, 1653 bp, Homo sapiens
ctggtgctggcatgttgctttgctcttagtttcttacatccatattgtctactgttgtttctctccctgctgtcttctttgttacactttcttcatcttaagtgtgcttcatagtggttgtgttaactcccccaccttgtccacttttttcgtccttcttttaatatgtaatataaattcgtgtcacaactatgccttatatagatagttgtttcatgttttacttataactgtgacaaatgggtgtttctacgtgtgttctaacaattattacgctttcttctctgcccccccctctatgtgtaaacactcgtttcccagctatatggcttcccacatagtcctgttttccaagccttgtccctgttgtgtgtcctactcacccggatgggtatcaatctgcttgttcttttgaactttgttattgccaattgcgtgcaacgcttttcgggctcttcgtaataaaattctctgtcggctgacgtttttttcctgcaagttattaaccctccggtctgtgtgccccaatctgatctgttgcttcataccactccgagattaatatcggccgaggaaacccacgctattaaatctttctgggtacataaaattcatacttgtctgggtggaagcccatcttcgagataaatgtggcacagaatatggttacgctgaggcctcaaattagctttgctgttatagaatctgttggtgctttaacgtatttttattggtgttctgggctcttttgggagccttaaaactcggtggtgtgttcctatccttacgtaaacttttgttaatttcacttgggagacctctctgccaaatacttttttttaagttacttatattcgcctcggtccaatgttttgggccctctttaaattagtcttatgcactctcggttagaaagattacattgttattagtttacggaaaattcgcaagtcatacgaacaattgctctttctttcccgtttgctattattcggcctaagtacctatttttctcttaagcacctattgcgggtagtgttcctgttgcttttgttctagtcgtagttgatgtgtttagaactccggtacatctggggagtttttaacaataacatattcttggtggtcaattattattgtccgagtaaataacattatgggtggtttaaccgtatgatagaaatatcagaaaggaattgtacacgtgaaaagtttttcctagcgacacccctatataaccagtaaatctcagtattaataacatctactgttctggttctgtctaagacgagataataactcatagaagtactacgtcttgtattaactgctgtaagcatgctgtcttgtaaaccagcagttcttcgacaagctgatgttgtcttttgagatagttgtgctatctgttcaagtactgtgactctttgtttctggaaaagtgagtaaaggccatgagacgttggtgcgaacaatcaagtgttccagctattatagatattaagtttgtaatgtgagcatcacaatgtgtagtgtaaaaatacttttataccagtctggaacttgggaaaatccagggaatcttgaaacactagattataatgagcgccgtaaaccgcaattactgtcataaagtatcacctctcccgccccccc

SEQ ID NO: 725326 - DNA, 244 bp, Homo sapiens
tagagacagagtcttaactctgtcacccaggctggagtgcagtggcatgaacatgacctactataacctcaaactcctcagtgcatatgatcctgccacctcagcttcccaagtatctgagtctacaggcacatgccactacacccagctaattttttaaaactttttgtggagaagggatctcactatattgcccaggccaatctcaaactcctggcctcaagaatcctcccttcttggtctc

SEQ ID NO: 725327 - DNA, 358 bp, Homo sapiens
ccgagtttcggcgccaggtcggtcatggcctgggagttgatgtcggactcacgaatcggcgtcaggcccacgatggttttcttcagcgacacggttttcgaggtcacgaactgcgcgtacagccaagccgccagtttctgcttctcgggcgtcgacttgaggaaggtccaggaacctacgtcctgataccccttcttcatgcccttttcccaataaggcccaacgggtgatggcgccatgcgccacttcggcgtgccatcggcgttgaccaccggcaggcccggcttggtcatgtcggcggtaaacgcggtgtaccagaagatctgctgggcgatgttgccctgggacggcacggggc

SEQ ID NO: 725328 - DNA, 922 bp, Homo sapiens
agtgcgtgagaggagacatctgtgcgctatgcatcgttcgccggagctgatttatcatatctgcgcatgtctctctgggttgcccgtttttttaattgccacgcggtttccccccctgttttgcctcaatcgggattgccaactctgtggggcccccacattgggttgccttttgccccaccccgttgccggtgtccgcgtattccccccgtgggggccccctccccctctggacttggttccgggggttccaaaaccaacacttctttggtttaatttcgcccccatattctgtttgtcaatgctcagacccatttttcgcgccatgccctgcatatcttctggtttctacggcttttctcataatctgaatcacaggatgtcgtgcccagcgttttctcccggcattcaagaacccccctcatcaagagtatcgggtttaaccccctcgagccgcctctaggtctcctcgcccgtggaagttaacatcacgccctggcccctctctggatctttcacgcttcgtgggtgttcccccggcaggggaccctcctctttttaggagacctctccgagggtacccccccttctcccaaaatagtgggagacgtcaacccttccacaataaagatgggggaccccccccggcatccgccaccgcgagtggtggggcccccaagaatggaggctggccacgtaattctttgcgatagcgatctctcctctctagcacggagatagaagcgccgttgagtgcgctcccggaagttttcaagggggccccttcatacgtatatacggtcttaggccctagaaacgaggtcgctccctccggaccaaatgcgcggcgctttctatcaatgggtgttccaccaacccgtgggcccaaagaggaaaaaaagttttcgaacacacaaaaaca

SEQ ID NO: 725329 - DNA, 657 bp, Homo sapiens
  misc_feature (583)..(583): n is a, c, g, or t
  misc_feature (627)..(627): n is a, c, g, or t
  misc_feature (650)..(650): n is a, c, g, or t
cagaaacccataaacttgtctaagaccaccgaagttgtccaaaggcctgataagtcacaaagaacgtttttagagcgcctccaggaggcttatcggatttacaccccttttgacccggcagctcccgaaaatagccgtgctcttaatttagcatttgtggctcaggcagccccggatattgaaaagaaactccaaaaactagaaagatttgctagaataaatatcagtcagcttttagaaatagcccaaaaagtttttgacaatcaaaagtttaataaacaaaaacaagcaacacaggcagctgaaaaggccgctgataaagcattcaaaagacaaacaaaaatcttagtggcagctatccaagaagtacagaatgaaatagcccattaatttagcattaactgaagcccctgctttagccttccctaatatctccatgccaaggagttgctaaagacgtgcttactcagactcttagaccctaaagacgcccagtggcctatttatctaagaggctagatcctgtggcctgtagatggccaagttgtctgcgagccgtagccgctacagcaagcctggcccnaagagatgataagttactcttagctcaaatctacccttacagcntctcatgccgtagaccttagtcntgcttct

SEQ ID NO: 725330 - DNA, 171 bp, Homo sapiens
ataactctctctttgaaagtattctgaatttcctaatgagtgtaactgttagcacgtgtaatttgtttccaactgttggttgaagttgtttctcaatccccccggccatgtgcagtagtaactttaatttgcagtcacacagaataaaacaggaactttaatttgtggtca

SEQ ID NO: 725331 - DNA, 597 bp, Homo sapiens
  misc_feature (3)..(3): n is a, c, g, or t
  misc_feature (89)..(89): n is a, c, g, or t
  misc_feature (130)..(130): n is a, c, g, or t
tgngaatctccccacgtaggaggaaagttcggccacagaggacagcagcagataatcgccttgtgcagcagagcactcactagtcgcgngtcatcgtgacgcgtagagcgcagaaacagcgtgcttttanattaaaccgcgtgggcgtaactctcccagtactcagcgaataattccagacggaacaccttaagttgcacactgctcattctggaccaagcacttgcacatcaactttctccgcctgacttcctccacagacatatttctgtagccgctctggaacactcaatcactccactgggagcggtcctagacatgccttaaaaaatgacgccagcattgttgcatacctggtcaaaaggaggaccattctgacaatctggtgtatgccaagtgttaatcagtggcatctccacgagcgcgtctggtgtttggagagtgttaatatttcccgggtctacctttgtagagatcaagcacagctttacaagccaatttttttgaccaaggagtcattttatttggcgccccctttgcatcgcgttaccacggcggttgccatttatggttattttgttggacttttccttgggt

SEQ ID NO: 725332 - DNA, 515 bp, Homo sapiens
  misc_feature (7)..(7): n is a, c, g, or t
  misc_feature (12)..(12): n is a, c, g, or t
  misc_feature (59)..(59): n is a, c, g, or t
  misc_feature (357)..(357): n is a, c, g, or t
aaccccnccccngccctgtgaagggtcccctggcctccccacttgcccctggtgccccnaaggtccagaggtccccctgagcccctccccccagaatccagatgggtccccctgcctccctgaccagcccccagacaatccgtgagccccagtaaccccctttttccttataaattaaaaagaaaagaaaaccaagtgtaagcaagggatatgaagaagagaaccccttgtacactgttggtgaaaatgaaaatcagtgcaacccactatggaaaatagtatggaggcacctcaaaaaatttaaatcagaaataccatacgatccagcaatcctacttctggatatatattcaaagnagttgaaatcagggtcttgaagagagatctgcacttttacatttattgcagcattattcacaataggcaagatatggaatcaacttcagtgtccatcaatgaataaatggacaacgaaattgtgatattaaaaaaagtatatacttatggtatatgaa

SEQ ID NO: 725333 - DNA, 143 bp, Homo sapiens
  misc_feature (143)..(143): n is a, c, g, or t
gggccgggaccatgtgcgcgttccgggacgactggcgctgttgcgggctccaatgcacgagtttttcgccagggacatcgacggggcacatggtgtaacctgggacaagtaccgcgggtcttcgtgttgcatcgtccaccaan

SEQ ID NO: 725334 - DNA, 132 bp, Homo sapiens
tgtgaaatagcatgaccgatcccatccgcattatgcacccccgccctagggcccgtcctaggaatggattaggggattgtcgctttgtaatgtgctggttctcttttttttcttacccctactaatgcccta

SEQ ID NO: 725335 - DNA, 746 bp, Homo sapiens
tggcaccaaaggcgtatcctagctttattaaagggcccgcgccgcagagtcaatataaaaacacaaaaagtcccatcagttaaataacaaataaaaaaccccaaaaggtggaaaacgtgagggggcaggggaagagaccccggggccaggggcacgaggagcccggctcagtggcaccaggccgtggccgcagggccccccggatatggctggtgtggctacgaggtttgggggggcaagcgattggtgcctggtggggacgccaccggttctcctggggctcggggaccggtcacttcttctgggggtggtggctcagtttctggcatgcccgggatctggtccagcaggccagaaatgaagggcctctggggggtttggtaacagtcaaccagcagctccttgaccctgggcagcccggggcatcgtcactctccatgtccaggagctcatccaggtcaatctccagttcggggatctcctcttccgggcagtcgtaaaggcgcgtgagctggctccaggatccactcctctaggtggaggcgcttccgtagctcctggcgggcatacttgacgggtgaccttccctgtggggcctcactggggccctcatcgtccgccccgccgcgggccctctcctgcgggccacgggggggctctgaacagtagacgcgtggtcctgggccgccagtgccggccgggggctggggacgcaacgccggcccccgggtgcagtgtccgcatgg

SEQ ID NO: 725336 - DNA, 497 bp, Homo sapiens
gacagtacaaatagtatcgtagatatccaaggagaaataatcatagagtaaactattctggggtgatccagataactatgtgtatactatactctctgcaggcatgtatgtagtagtatactatctatctcatctctccagactaataataaagctgatgtatcttcacaacagcatatctattgttcatacaggtcaaaagccttatacacttcactaaagccacctctaccaagcagatgaagtaataaatatctttcatttaatgttgggtgatctttgaactgtgaattatcttcattgtttattcttttcagctcacgtatgtgaagatttctgactctttccaaacgttcaagttctgcctggatttctgcctcttccttatagagatgtcctagtctaagtttgaaaatttcttcctgtacatgatattctgccaaagtcaacagttgtggtaaatttggtctaacaaagggatcatactctgctccata

SEQ ID NO: 725337 - DNA, 678 bp, Homo sapiens
aatgtttcaagtggcctgatttgacaaggcagagaatggaacagtgatattgtttggctctgtccccacccaaatctcatcttgaattcccatgtgttgcgagaggaacccaaagggaggtaattgaatcatgagggcaggtcttgcccctgctgttctcataacagtgaataagtctcacgagatctgatggtttgaaaaaggagagtttccctgcactagttctcttctcttgcctgcctcgacatgagatgtgcctttcatgtgccgtgactgtgaggcctccccagccatgtgaaaccgtaagtccatcaaacctctttcttttgtaaattgcccagtctgggtatgactttatcagcagtgtgaaaatggactaatacagacaaattggtaacagtaaagtggggtgtcgatgaaaagacacctgaaatgtggaagcatactttggaactgggtaacaggcagaatttggaacagttggagggctcagaagaagacaggcaactgtggcgaattttgaaacttcctagcagaccttgtagaatagctttgcccaaatgctgtccaggctgaggtgtctcgctggcctgaggacttgttgggcactgcccagatgcatctatgtttcgcacagagacgtggtttgcctgtctaattgtgacttcgcctcggctt

SEQ ID NO: 725338 - DNA, 797 bp, Homo sapiens
  misc_feature (18)..(18): n is a, c, g, or t
  misc_feature (36)..(36): n is a, c, g, or t
  misc_feature (46)..(46): n is a, c, g, or t
  misc_feature (61)..(61): n is a, c, g, or t
  misc_feature (67)..(67): n is a, c, g, or t
  misc_feature (72)..(72): n is a, c, g, or t
  misc_feature (74)..(74): n is a, c, g, or t
  misc_feature (82)..(82): n is a, c, g, or t
  misc_feature (141)..(141): n is a, c, g, or t
  misc_feature (228)..(228): n is a, c, g, or t
  misc_feature (788)..(788): n is a, c, g, or t
aagcctatctaatcaatnctattattaaagaaagtnaagcggtatnaataatttcaatagntcgctnaatananaatcactnaaactctatttatacatacctattcaaataatttcctagagtatattctttaaaattcntttatagcagtacactaacaaagaaaaagtttcctgtgtctttgctgttatcaaatgtaaaaaagccccttaaatatcaacagtttncaacaatgtatacatacacatatattttaaatgcaagttacttaaatgtaggtttacatccacagagacattttaatacctgctacgtactctatagcacttctatataatatatattgattaatttcaagtactttaataggtttttaaagttcattcaatttttttcttgaaatttgccttctttatttataaaaagtacctttgttctccaaaatattatttaaaatataatggtgttttgcagatggggaagagtatagtatgccttagtataggcgtgccttgaagatattgcaggtttggtccagaccactgcaataaagcaaatgttgcgataaagcaaatcacgcaaacgttttggtttcccagtgcatataagttatgttgacactatactgtactctggtaagtgtacaatggcatgaagtctaagaaacaatgtatataccttaattaaaaatactttattgctaaaaaatcataatgatcatttgagccttcagcaagataatctttttgatgggtggaggctcttgttttgatgttgatggctgctnactggtcag

SEQ ID NO: 725339 - DNA, 811 bp, Homo sapiens
gtcttcccctactccctctcggctccttgtggcccaaaggcctaaccggggtccggggtctgcctagggatcttccccgttgccccttggggcggatggtggggaagaagaagagaggtgagtgggtagtgagagcatcggggttcctggaggccagatgtccatccccatcttgacttgtggaaccagaatgtgaagttgggatgatgaagaagaaagcaaatggactatacagagattcatcaggaatacaaagaactagtggaaaaggtgtagaaggttacctcaaagaatgtgaattcagtgaagatcaatttacaagaagcatgcatttctcctctgtgaaagacccatacatcacaggccatttgtgaaacttgtgtgtgcagcaagaaagatttaactatcttaaaaggcaatggattgctccagaaaaaccttggaaattgcggttgcaaggcatttccgaataattcaacgagagaagtgctgtattaccctgagtgttaaacggaatgggtctgattgtgggtcagggacttggaacacgaaggagatgaaaattctgagggaagttcttaagaaaatcaaaggaggattgtgagcaggaagacggaaggaggaggaaaaaccagttatcagggggtaaaaagaagagcaaagtggtccaagtggaagttggactatggaatattccaggggtgtgaactttgggaccacttcgagtaagggttggatacgcataacttgtgggaaatgagggtgaatttcctccaaaggggaattgggttaggggttgggacaaatcttt

SEQ ID NO: 725340 - DNA, 743 bp, Homo sapiens
  misc_feature (18)..(18): n is a, c, g, or t
  misc_feature (36)..(36): n is a, c, g, or t
  misc_feature (46)..(46): n is a, c, g, or t
  misc_feature (61)..(61): n is a, c, g, or t
  misc_feature (67)..(67): n is a, c, g, or t
  misc_feature (72)..(72): n is a, c, g, or t
  misc_feature (74)..(74): n is a, c, g, or t
  misc_feature (82)..(82): n is a, c, g, or t
  misc_feature (141)..(141): n is a, c, g, or t
  misc_feature (228)..(228): n is a, c, g, or t
  misc_feature (734)..(734): n is a, c, g, or t
aagcctatctaatcaatnctattattaaagaaagtnaagcggtatnaataatttcaatagntcgctnaatananaatcactnaaactctatttatacatacctattcaaataatttcctagagtatattctttaaaattcntttatagcagtacactaacaaagaaaaagtttcctgtgtctttgctgttatcaaatgtaaaaaagccccttaaatatcaacagtttncaacaatgtatacatacactaatacctgctacgtactctatagcacttctatataatatatattgattaatttcaagtactttaataggtttttaaagttcattcaatttttttcttgaaatttgccttctttatttataaaaagtacctttgttctccaaaatattatttaaaatataatggtgttttgcagatggggaagagtatagtatgccttagtataggcgtgccttgaagatattgcaggtttggtccagaccactgcaataaagcaaatgttgcgataaagcaaatcacgcaaacgttttggtttcccagtgcatataagttatgttgacactatactgtactctggtaagtgtacaatggcatgaagtctaagaaacaatgtatataccttaattaaaaatactttattgctaaaaaatcataatgatcatttgagccttcagcaagataatctttttgatgggtggaggctcttgttttgatgttgatggctgctnactggtcag

SEQ ID NO: 725341 - DNA, 1434 bp, Homo sapiens
  misc_feature (1295)..(1295): n is a, c, g, or t
gcggaatcaggccgtagcgtctggcggagccgatctgcggtgagccgctccgggttgcccccaacccacgtgcgcctcagtggtgccggccgagggcagtggctcgcggttgcgtgggctcgctgccgtttgatctaagttgctggcgtgggctgctgcgaagcggacgccctaggattcgcgtgtccaagacgggcaatcacagcagtaagcgtgagcgagggggggtaagcgtgcgggcgcatagagactagcgaacgagtccctgtgcgttgtgccccagacctcttcctccgcagcagccggcacttttattctccacttctcccaatagactctcgccggtagactgcggggaaaagataaccgggcattccttatccacaatgactgaagctgaactttccattccatatactcttcttggagcggcgagggtagaaggcccaataattccctcagaagggaaacggtgcgttgcttgaagcgcatgtaatagcgcaaaaagtgacgggaatacaacgtcttgtgagcttaagaggcttcaaatccaggaagggtttaactttgagttgaggactacccagttgttcccttgaaaagggctttacaaggaggcaaacggcgagatggtaactccaaaacgaatagaaaattgaactcccaaaaagttcacatcccaacgtcctcggaggttctttacaatttgggaaacaacccttccaaaagcagacatgcctccatgtgttgaaaggtgacacattccacgacaattgttggggcacgaacccatacattttcctcattaaacgataattggtgcccagatggattgcaacccgaatgcttgctgttatcattgatggacaaccagaagggggactttattgatcccttttgaggattcccagacataactttccccaaattgataaagagcgcccgaatggtgaccgcggtgagtgcacagatcgtggtttgactttgagtgcgagataacgaacaattggtgctggcgtgggcggtattgcctgttggtacccgagggtggtgaacaatcagagcccgcattgtgtgaaaccattttctacacccaactgatggctctggcgcaagatatcccccttaaacgacccttgatacgagaaaacaccaaaagagagagcccataaaatgcaagtaggaacaagagcaattccttgcacatatattatcacaaggtgtgtgattataacaactcgtattgtaacgataatttgagactttcaactataccgtagggatcacgcaagctnttcttatacgagcaacacaaggacatccattttcggaacattacacgggtctggtcctcaatactgtgatatcacccacgatgcgccaagactatccccgaaggtacagagtttcccttgtgatcaagaataataccgc

SEQ ID NO: 725342 - DNA, 121 bp, Homo sapiens
tgctgcgtcgttctagaggataccctgtctgtctaggctggaggtgcagtactcctctcaaaatgaatgaatgaatgaaagaaggagagggaaaggaagctcctctctcttctattcccag

SEQ ID NO: 725343 - DNA, 1056 bp, Homo sapiens
  misc_feature (419)..(419): n is a, c, g, or t
tgtctttcatataactagtgtcgaattgcattgtatcgccgtacacatgcgaggtcactttcgaggtctcgatatcttgatctcgggtgtacactggagcttctacgtgtgcgagcatgctcgactatatgctcactcattgagcataggttcgtactaccatgcgaaagtatgtgtatgtcatattactcgacctgattgcgcttctatatctgcatgcggcacgaaagacaccatttattctacaggtgcactcagcacgatacaaccaggacccactatcaggaaacatctcgtctctggggtgataactccataattataaattagctgtcagtaactgtttttatatatactgtacaacggtgtaatctttgtactgtaagcacatgtattacactgtgtaccagacactagantgctcatgaggtcacgcgattcataaggggacgagggcgagtgtgacccgcaaaatctggaaaatacatcacacacggcaattaaacatacacacacgtacgcatagatactggaaacttgctaaaactactttttgaatacttagggtacgtgctatacagagtagataattgacgttaatactgatagcaacatggatatacgattctatttagaatgactatattacgaaaaacgcgattataactttcgctgaacaaacatgtactcattgatcaagggattcaaattgagcgttttaactagtgtaaaatacgtacacctcacaaatgtggcatacccgtatgtaattgtgtcagaaagttacatcaccatatcaaagcgactattgcccgaacgtgcgattcttacgtgcttcctaaaatcttgtgtcggtatgttcaaccgaaggggagcccaggggatttatccaagaattgagtatttttgggagctatctatatttccttatttcatcttggtttgaatgctgctcccaaattgtttatgcccgcacgttacaccggtctaagtcaatccatggatttggtcttttgcagattaacaaaccgcctttgtcctggatagttttccgga

SEQ ID NO: 725344 - DNA, 154 bp, Homo sapiens
  misc_feature (13)..(13): n is a, c, g, or t
  misc_feature (73)..(73): n is a, c, g, or t
  misc_feature (103)..(103): n is a, c, g, or t
  misc_feature (130)..(130): n is a, c, g, or t
taaaatgaaaatncaggctgggtgtggttgtaatcccagccggggaggggctgcagacagcagggggagaggnctgcttcttattttttcctttctccttagnctttccctccctttaaaggcttctaantattaaattgaaatacatgagaat

SEQ ID NO: 725345 - DNA, 931 bp, Homo sapiens
  misc_feature (824)..(824): n is a, c, g, or t
tctcagcaaaggattttatgggggggtcacctggtgggcacaggttaaagaaggccgaagtgctgtgttcgggggggggggggggaccaaaaaccccggccctgccctcttgcttacataggctctcccgcctaaaagcgcaccaaaaaatgccgtacggagatccggagtaggtagtactgaggaagaagctgagctcaaggggggccatatccacgccactggcgtgagggcatgtgggtcaataagatggtactaggagaagcaagatctcacggtaccacacgggagcatccacctccagaaacttccgatgtttctcccattacagccaggggtgattgcgggcagtgacatatggtcaagagacggctggcggatccgagaatggtctctctcacacaacaggagagtgtattgggtgcccatctcttaaagaatagaaagaatacccagggggcatcttctcatggaaggagattagtatattagtgagcccccccgagggcgctacaactactatcaaaactactctactcgaggaggagggaggcagcacgtgaggagggataaaccaaacaaggaggcggaggcaatttccaacatcgagtgcgcccctttgttgggccaagtgaggaaccagatacccaatttctagtggtgctctcagaaatttcaacaattctcgaggtgctccaacaacgaaccaaatatgtgtggtgtttgcgctccccccaaggaaaagcgccgcgggtcttccatggcgaatatatcgaccaggaactaggtctaagaagaggtgggttccggtggggacaccaccnctcttgtggtggacaatataacagctgttgggttgagtggggccccaacagagcacagacccatagtactcgcccaattgtgtggtgcttggcgaaccaagcgtgtg

SEQ ID NO: 725346 - DNA, 490 bp, Homo sapiens
  misc_feature (100)..(100): n is a, c, g, or t
attaccgttttctgtgaatcgaactgttctgcgttaatgctttattattgttcaccgtccaattaatgctaaatcgaattttggcaaaggcgtacagaancgaacagtaaccatttttggattagataacccgaatagtctgattgttgtttgagttgatagtgtcgtcacattgaccgtaactagcgtatcattaatgatttctgacacttgaccgtggttgcttggtctgtcttcacctttagtaatcttacgcaacgtaatctgtttgttcaaaatcatatcaaccaccacttaccatgagttggtttgtagaagtcgtcaccgtttttataggcgttaatttctgctaagtaaggtgtgaagtcgtcttcattgaacgtcatacttaaaccgtcctgtgtaggtgacttcataccctcattaccaatacgggcatatcaggcgccaacaccattagttaaaatgtactgaagcttgtcagggactg

SEQ ID NO: 725347 - DNA, 117 bp, Homo sapiens
ccgtgggagggggacacactgcatagctttgtaatagggagccactacatggcaatacgcaagcgcacgaaccatggggccactctttaactttaaaataataaccctgtctgctgt

SEQ ID NO: 725348 - DNA, 942 bp, Homo sapiens
gcctcagcgggtggccgtccgagcgccgagaggtgaggtgtgcccccgacctcacctgtcagaggggccgttccgggtctcgaacccgggaccttccggaagatgtgggctgccagtgcccagcctgcgtgcgattcctcccagagtatcctctgtcctgttcctgtgctgtagatgcatgagtagcaacgttccgcccataacgatcgtgcgtacttccacacaggactcgattctcagatgtgctggccgccatgctcaggaaacatggagccctggtaacttctagaaccgggggacttgcaggtccactgtggtgggtcggacgcctgttcctcatgggcaagacaggggttgtacccgggcctggatgtggtcatgtggccccgtatgtgaagacaaggagcttggatgcccttcgcttccttgcagccctagtacgtaatcgggcctcacagttcatgcagagcattgatgcgcgcagatgccggtctgagacccgcgcaaggatgtcaaagggaagatgtcccaggaatagagggtctcagttcaaagggggtaggtcccccagggccacccacaagggaccaaggctgcgaacctttgcgtatggggaccctttcgtttgtcgagaaaggggctccaacggcagaccttcccgtcttactccttccgcagagttgtatgacattcgccaagaggcacacctggtgcctttggaatgggggtacattggaccacaaatcacgttcgccttggtcgaagccgcgcgggaacacccattcatagagtggggcaaagtggccccgtgtttcggccacccactagttcggcccttggaagttcccgccatattggaacgttgcgaattgccggagtttcacaatcgccagggggaagtcttggtgccggcccccacgcggttttgaatcgtggggagaa

SEQ ID NO: 725349 - DNA, 156 bp, Homo sapiens
aatatgtcataaccatgttgtaaagtaaaacataacagagtcatggcaaagcagacatcaccaccatacatcatcaccatcatcatcactatcaacaccaccaccatcagcagcatcatcaccatcatcatcatcaccaccaccatcatcaacatc

SEQ ID NO: 725350 - DNA, 347 bp, Homo sapiens
gagagagagagagagagagagagagagagagagagagagagagcccgagagagctccctctatggagtccaggtgtttcacaggaggacgggcattatcaggtaccactggccaacttatcattctatttttcagtaagattgtaatttccgttacacacaaccctgttatgtttgtacgaaacacgttccttaaagctcactggctttccttcggttccagcttcggtctgcattgcattacacacatgagctcgaggtgagcaacgggcacttagtgaagcgtctggtcacgcctggttgatgactgtagagcattgtttcataggcttttctctgtcctgctgg

SEQ ID NO: 725351 - DNA, 81 bp, Homo sapiens
ggctgtgtgtgtcctttgccaaattaaaaagtcttactgaatgcggtgcatccaggaaacaggcccaggtttggactggta

SEQ ID NO: 725352 - DNA, 340 bp, Homo sapiens
ctgtggtaatatcaacctaaggtcagttgtgcaggtggtaatagtcattaaacaagattgttgtaggttagagcaagggcagatgtcttaaagaaatcgtgaaagtatgtagcagtgggcagttcagcagagaaggggctctgcacaagaggccagggctggaggagagttttatagggtcctgcgtgatagggtgctacgtgtggaatgaggtcattgtgcccgcaggttgtttgtgattagctgtttctaacaattgttcatacaatcattgtccattattgttctcaacttggggctctccccaagctggggacccttccttattgttgctaccaca

SEQ ID NO: 725353 - DNA, 133 bp, Homo sapiens
acataaacaatgtagagtagtgttatatgtaactttctatctgtaaccttagttttgaggtttatcaacagttaccatgctcacagctctagtcattttcatcattgcatagtattccaactgaatttatata

SEQ ID NO: 725354 - DNA, 181 bp, Homo sapiens
  misc_feature (31)..(31): n is a, c, g, or t
caaaaatttttaaaaaaaagggccgggggcntttttttttttcccggggcccccctttttgttttttaaaaaaacccccctttgggaaagggggggggggccccttttttttttcccccccggggaaaaaaacccgggttttttaaggggggccccccccattaccccttgggccccggga

SEQ ID NO: 725355 - DNA, 596 bp, Homo sapiens
tggattcccgtcgtaacttacagggaagacttttcatcaatgttccgagtagcgccatgtgactgttccgtgcaatactgagaggatggatggatagtcctctacatgttccgttgacagccagggaaactccacttaggtgtggtcaaccgaatcgttgtactctcgcagaatggtaatcaggtaacacttcggtataaaacgagaaacaatgtcgatgcgtgccacttcgtactcagttccaattaaacaagtcccttcacaaagaacgggaacccctttgtgcggacaacgaaaaagcctttccttcagggacttagcggcacaagacattgatcacgcgttagtgccccaacaagttcggtgttttgggcgccgcaaaatcttgggcgaagcaaaaattcccgccgctggtgtcgtattgtggaaactgtcgttaccaagcaacaggggtctgacaacagtcaagttcctgttacccccaaagcgagaaacaacttcaaccttgggggcccaccaagacaagccagcgcgtcactggcatgaccacgtctggaacagaggatttccggggacatctgtcactagcagtcacc

SEQ ID NO: 725356 - DNA, 176 bp, Homo sapiens
ctcgagctcggtcccgaacaccaggctaaggagatcgtcgccacccgcgttcccaagctgccagccccattttgtcggcaactacattcagagcttccgccccaagccccgtcctgctggtcttgaggactctgctgaggtgtctgctgagactggccttggcaagctgcagcgtg

SEQ ID NO: 725357 - DNA, 203 bp, Homo sapiens
aacgaccggcatggatagaggtggtctgccactgatagctgacacggcggctcgaggagggggcctgcatgtttgcagcacttactaaggaggcgagagacggcgccgaataaggccaattcatagtgcatcaggtggtctgcaggcccaggcgaggctgtcgccactggcggcgctctttaagatagtgctgagcagagtcc

SEQ ID NO: 725358 - DNA, 135 bp, Homo sapiens
  misc_feature (94)..(94): n is a, c, g, or t
ttgggttgtagctttggtggtggctttgctggtggtgatgggcttctggtggtgcagtgataaggtgtgaccatgcagaacctcaactgaccgnctgtgctcctaccgtggacaatggtgctgtgctcgtgtgag

SEQ ID NO: 725359 - DNA, 492 bp, Homo sapiens
aaagagcaagagggcgtagggaatgtaagatcttatatctcctgacctcgtatcgctgagagcttaccttatgatcttcgtcccgtcacctgcaaatatatagcttgagtagcagatgaggcaggacatcataacgccctccatattaactgagttccgtgaatagacaggatccagaaaataaacccatctgtttgatgcagagactaagaacattagattgagaaacttgaggtctcctgctgtaagcagccatcagccagcatcagccagatcccctaggaatctgcatcagaacaaactacctattcttatcatctctccactgggcctggtcatctgtgagcagggttcccaggcaggtgattgtcacagggcggcagatcagaacagacagactagttccagaccaggatcaattcctggtgtctgctctggtcttggtggccccactctgggccctgggggaatggacctgcccggggaggaaga

SEQ ID NO: 725360 - DNA, 388 bp, Homo sapiens
cccggtattgctattaaaactaatctgatatatttcgtacagttactgccggttgcaaatctccggtaagcagtagcatggaagagatgagcgctgcctggtgaaatctccggaacatgatagatgttaacgccaagcaggattttttagccctatattctctgctaagatcatgtattatcgttgtacagatgatgattttatacccttctaggtatttgtcccgtatggtctagggtgtacgcccagtcattggcggggtacaactagttcctagagaatgctttgagagacacgaggcagctggatacgcttggcacctattcctatggcatgcccgtgactccctgggatagtggtctagtgtcatcctgtccggtgaaatcgt

SEQ ID NO: 725361 - DNA, 115 bp, Homo sapiens
ggccgcgcgctgtactgcttccgatatgtgccacagagcagcaacgagaagtggacagagccgcggctctacacgcttgggtagcgggataagtcactgttttctttatttcttt

SEQ ID NO: 725362 - DNA, 274 bp, Homo sapiens
  misc_feature (71)..(71): n is a, c, g, or t
  misc_feature (126)..(126): n is a, c, g, or t
  misc_feature (238)..(238): n is a, c, g, or t
  misc_feature (253)..(253): n is a, c, g, or t
  misc_feature (262)..(262): n is a, c, g, or t
ttgtacccatttcacaaagaagaagcaaacaaattaagtggcttgctcaaggtcatgcagttagtaaatgncaaaacagggacttgaaccaaaccctctactctaaaaaccgcgtcctaaatttcnacactaaagcttcctcatcaggttacccacaagtgggtcccatccaccatccaggtgtgcttggatgttctccaccctcaaggtgtaccctgtgaaaagtttggaagcactnctttataataaaatnaaataaacnacttccaaaaaa

SEQ ID NO: 725363 - DNA, 186 bp, Homo sapiens
gttgagttgtataagtggtttgcatattctaagagattaagcccttgtccattgcatcatttgaaactattttctcccattctgtaagttgtctttttggtttctttttggtttcctttgctgtgtgaaagcttgtcagtttgatgaggtcccattggtttatttttgcttttatttctgttgcct

SEQ ID NO: 725364 - DNA, 379 bp, Homo sapiens
gcagtgagtggaacaaagatccatgccaacggacgacatctgcggacaggcgagaaggccgtggtacgtctccgctgacctgaaacaccctgagtaccttaaggtgggcgccacactgcagttccgggaggggtgtcagcaagggcatcggccatgtcactgatgtacaagccataacagcaggagaagcctcaggcgaaaatgggcttctgaatccttcaggctgtgggcagttctatcgctgtccctacaatatataaagtgactactggccatgctgccgctgccgttgcagggtgctgtgtgtcaatagggcaagggagacaggggtgcagtctgtcacttgatccgctcgccagatttctgtagagggtgccat

SEQ ID NO: 725365 - DNA, 336 bp, Homo sapiens
  misc_feature (327)..(327): n is a, c, g, or t
aagctttcggctagtcgggacaattttaaaagaaacctttcagggccaggtgcagtggatcattcctgtcatcccagcactttgggaggccgaggtgggtggattacctgaggtcgggagtttgagaccagcctgaccaacatggagaaaccccatctttactaaaaatacaaaattagccaggcgtggtggcacacacctgttattccagctacttggaaggctgaggcaggagaattgcttgtaccggggagggcagaggtttgcagtgagccgagattgcgccactgcactccagcctgggtgatgagcaaactccatttccanaaaaaaaaa

SEQ ID NO: 725366 - DNA, 82 bp, Homo sapiens
gatcggggaggggcaggggtggcacacgatgctacgcaaaacagccacatctaacagttgaaataaacagacagcaaaatgg

SEQ ID NO: 725367 - DNA, 109 bp, Homo sapiens
catcgccacattgacctcctgccagcatctctatgggattgcagagaacacactggccccagctacctgaccatgaacaccacatatcagcaaacttcttcctccacct

SEQ ID NO: 725368 - DNA, 634 bp, Homo sapiens
cggtgggtgtcatcaaaaggtcgaggcggaggctgcttaatcctacaaggtcaccaagtctgcccagaaagctcacacggctgaatgaatattatccctaatacctgtcaccccacttcttaatcagcagacggaagaacgggctaagaactgttcgtttcaattgaccatttaagggaggagcaaaagactggttaatgataacaatgcatagtaaaaccttcagaaggaaaggagactgttttgtggaccactttggttttcttttttgcgtgtggcagttctaaggtattagtttttaaactcagctctttttaacgctaacaccttggccaaatttttgtcacagaattctgggacccattaaaaaagttaactgagaaaaaaaaaaataatactttaccaatcccgttattattaatactgcctagttaccgaaatcctggccggcccccaactacccaatcgagtttaagacacaaaaaagatttttcctcccaataccaattttcggggccccctaaccacctctcccccttttgtatgcattcatatccgttcaagtggcaggacctctcacaacccccgcaccaggtaaatccctcggcgattcccacataaattgcccaccacc

SEQ ID NO: 725369 - DNA, 175 bp, Homo sapiens
accggtccgcactgccgctatctgggcattttccgcgccgaatgggcggattactatcggctgaaacgcgtggcgccaaaaactttgctggcagagctgcaggatcagggggagatttcgccggtgcgggtagaggggctggaagggcagttctatgtgcatggctcactgacgg

SEQ ID NO: 725370 - DNA, 1375 bp, Homo sapiens
  misc_feature (244)..(244): n is a, c, g, or t
  misc_feature (1375)..(1375): n is a, c, g, or t
gtgcagagagttgcgttggtgttgggccggaggtaacaacgtcggtgacatggactcatcggagcgtgtgtgattctgatctcgccgctatttctttaaccctagatctcgaagactgcatcgtgacttcctgtccactctgtgcactgtacagcgtttatgatatgcgcacatcttggaagcccatggcaaccagacggacattgcgaacggcgctttatgagtctacctgatgcgcaccacntccgatacgttgatgtggcgttgcctacgtaaatcactcgaaaccggccttttgcctcttagcttcgaacttctcgcatagattcccccgtacgactgcaggctgattgccagttccgagcaaggctacgactggcatagacaccactactgttgtgctgcccgtgctactgacgttggaacttgttcgatactggtgacaaaacattgacagtacgtaaaatcgtgggcaccagccgtacccatctttggcggggtcagtacagtcctcctctgaatggattgatttaatcgttaagcggagtgagttccctttcccaactctcagtctgcaaacgtattcttccgaataggaaatgcgcagtaaaagactctcttcctacgcccacgtccagtgcaagcaaggatccccctatttcctacgtacgtagtactgtgaacgacaccgacggacggaatgagtttcggacttcgttctggcggggacggaagaaaatgtacagtcaaatgccctgtacccccgatatgcacttgtacttcctaccggggtccctacgttaagcttccgattctccatacggttttcacacagttgagagacggggaaatacctaggaaacgtaacaagcgtttcttggccaccatggacgaaaacggttgcggtgcttacccaggcgcagcacagtttgaacctttttcccaattcttgttgcacctaaggtgtacggttactatgttagcccgggacaattatttcccacaaggtcttatttgctttttaagcaagcaccttttcccatacacaccgtcatatgcggatggccaactatattcttaaaagcatttaggtggatataacagcgtcgtttttccgaaacattcccatcggtcttccctccctttcttatatggcaaacttacacaggtgtggcaccaactaattagggggtgtgtgcaacttcttcctgccttccctctgtgggctttttcggagacaattggggaactctcccatgtaacccgcatgggggtcgacttgggttaaatttaacccccaagggaaaattcggtgcgccgcgttttttttacccacattggtttcccccttattagaggctaaacagtcttgccn

SEQ ID NO: 725371 - DNA, 1523 bp, Homo sapiens
agcgggggggaaatgttttcatactttttcaacaatacggttctttattgttgaactgtacatctaccccagcccctcaaaaaaaaaactgtttacatagaaattcctacacacgctttgcgctatatgtccactttcacaacatctttgctggctgacgcaacttctctttcccccgactattctcccttcatgctcaaccgctcagaaccaaactctcagggcaactttacttctctctgcgcagctgcgctgcctcccagtccctctttacaacactcgctccactgcacacactgctctcttacacacacaactactgcgcacgcgcagtgcactgccactaccactgctccggcctccaagccttccacgccgccttccgcaacacctctctctactgcgcacacacgactctctctcttctacacccctctaccccagcgcaacactcaccttcaacctcacctggtctctaacgcttgcaaacttccgaccctataactcttccaaccctctctacgcttctacttgcacaccctgctcgactcacacttgcgcctactcaccctgctcatactcaattccctttcaaaaccctgtgcgcacttctctactgcgcataacacccccccctctttctcagccttctccatatgcgcacgcaaccccaaaacacaactccccgccgcggatacctacgctactaacaactaacgacttcacacggcaccgcccacccccaccacctgcccacaccacttgcgtcacagctaacttctcttcactctctcgctcgcactcctctatggaagaccaacttcccaaccgacaagcttcgaatccacacagcccaaaagtggactcgtaacgacactcacggcgcaccgccaaggccacagtgcctctggccaatcttcacaacccaccacacgccctgagctctcaactcgcccgtcggcgccacgtgacaagcggcgcccccgcggaaccgccgcgccacgcccacccggacgctaaccgcccaaatgcccacatatacctcagacatgcgaagctgcacaacagacatcggctcacgccactacccacatctgcagcacgaaccgctgtacacaacgcgccatgccggaccacccgcactcgcccactcctcgcatgtcccaacgcctcgcgcaacccgccccccgacaccccctacctccccgccacccctccgcaacacgcggcgactcccacagggaccaccacagtgcgcgacgactgcaaccacgagccacacacagcgcacctcagcgacgacccacacccgtagccgcatccacacacacccctcgacgcgaccagtcgccccagcccactgtgccaccaaccggacaagcgagcacacagccgctcaaacacacacgataccacgacagcccacgacacgcccacccggcggtgacacaccacaccgccaccaccacagaagcaccgacgagaccacacagccacccaccaccggaggactactacaacgg

SEQ ID NO: 725372 - DNA, 410 bp, Homo sapiens
taattcgcggatcagtgaaagtgagcctggcgcacttctttgcgctgacctaaagctgacatactactggcttatgtggccacaattctaccgttcatttctgtgactgctttagtggcttcttctgggtaggagaaatatacaaaatcaaaccctttgactagcgatccaccctccataataacctttgcactagtgattgtaccaaatggagaaaactctttccggagacgttcatcatcaataccatcatcaagatttttcacataaagattaacaccctggtatctggtgatcctatcttgtttcatctgttcaaatttgcgcttaagttccgtctgccgttccacctttttctgagctcgaccaacataaatttgttttccattgagctcctttccgttcatctc

SEQ ID NO: 725373 - DNA, 135 bp, Homo sapiens
atcagctcggtaccgatctcctgatctcgtgatcacctgacctcagccccccaaagtgcggattacaggcgtgagccaccgcgcccagcctcttcatctaactttctaatgaattactacttgtttccaaataag

SEQ ID NO: 725374 - DNA, 392 bp, Homo sapiens
  misc_feature (259)..(259): n is a, c, g, or t
  misc_feature (281)..(281): n is a, c, g, or t
  misc_feature (376)..(376): n is a, c, g, or t
  misc_feature (386)..(386): n is a, c, g, or t
aaagagagaattttaaagctggatgtccagggagacatcacacgtcggcaggttccgtgatgccccccaagccgcaaaaccaacaagtttttattagtgattttcaaaaggtgagggagtgtacgaatagggtgtgggtcacagagatcacatgcttcacaaggtaataaaatatcacaaggcaaatggaggcaggcaagatcacaggaccacaggaccggggcgaaattaaaattgctaatgaagtttcgggcgcgcntgtcattgataactcttatcangagaaagggtttgagagcagacaaccctctgaccaacatggcgccccgtttctactataaccagttagctggggcgttgtggcacatccctgtgnatccagctantcgggg

SEQ ID NO: 725375 - DNA, 211 bp, Homo sapiens
gttgacgtgcagtggcaacggtctcgcgctccctgtcactccacctcctgcagttcaagcgattctcctgcttcagtcctcccaagtagctgggattacgggcatgcaccaccacgccccgctaactttttgtgtttttagtatgggcagagttggccgggacaggtttttctagctgtgtctcggaagatgaagtcgaatcctctgtcta

SEQ ID NO: 725376 - DNA, 201 bp, Homo sapiens
  misc_feature (68)..(68): n is a, c, g, or t
agctggttaagtgtgttttttaaattttggttattgtatttaagttctaaaatttccacatggtcatncttcggttatgtcatgcaagctggttaatgtgtttttttaaattttggttattgtatttttaagttctaaaatttccacatggtcattcttcgtatcttctacttctttgctgagactttctgttttcctgtt

SEQ ID NO: 725377 - DNA, 885 bp, Homo sapiens
cgtgcaagtgccaaatgtctcaaatggcgagaagattcgtttctgaaaagaggacaagagacattcctggagagcgcctgccaactgagctcccccggttatattccgcctggatccccgattcctttctgggatttttctccccagaagggggttacttccccacatcccagaatgtgggccactcttagggtgttcataacaaccgggggggtccaccagggtctctaacggtaccttcttcctgaagtggtttgcccaacacagctgggccccctggaggggaatacacgcatttccccactcactcgtgggggacggcctgccgtggcacagaaattttcttggcggcaaccctcccacgagcgctatgttagaacctccgcgcctaatggggcccggagcccccaatgtgggtaggcacccctcctttggaaaagcgagaattacaaatagaacaaaggcagtgagttaatgacattttttgaacaagtcccctggcccttttatataagagaaaagtgttcttgacgccccatggtcaccacgtaccggaggatgcactcccgcccgtctttgtgcacccacaaggcactttttgataaccacgcacctgttccacacataaaagaccaccttcctctctcacgtggtgtcgccaaattcgaccttgtcacacccctcctttgttattttctggcaacgaccttatcttcactgataaaaatcaccacatccttgacgaagagtcatctctccctggttaataccatcagtcattctccgaaaaatcgtgtgggaaccccctcgcgccgtgagaaccctccttctatcgcgccccaccactgtccacacccagccccccctttttttcgccccacagca

SEQ ID NO: 725378 - DNA, 161 bp, Homo sapiens
ttcccgaacatcatccattgtcatatcataccactcaccaacccatgcaaaagcctgtctatgtccaatcagcagaatgtcttcgaccacctttgtgacagattgttccactctggtctgaagcccccagacctcaaacttcacagtcaccagcttggtag

SEQ ID NO: 725379 - DNA, 222 bp, Homo sapiens
cgactgctctgctgggtctctccaccgcaatgcttctaggcggtactatacttagattgcgtttacacccgtttcttgacaaaacctaacttgcgcagaaaacaagatgagattgtgcatggctattagtctgctatatttgttttgttttggttttttttttttttttggtttgattcaggatttaaaaactggaccggtgaaggtgacagccgctcggtg

SEQ ID NO: 725380 - DNA, 456 bp, Homo sapiens
agatactcaatggtgttagtcaccaggaaaacactatttaaaaccatattcatatgcaactacttgcccactcaaatgcattaaataaaaaagggatgaaaataccaaatgttagcaaggatgtgaaatacctgaccctgtcatatgttgctggcaagaattaaaaatagtaccatcggccgggcgcagtggctcactcctgaaattccagcactttgggagccaggtggataacctgaggtcaggagttcgagacgagcctggccaacatgacgaaatcccatctctactaaaaatacaaaaattagctgggcttggtggcaggcttctgtaatccctgccacttggaaggctgcggcaggagaatcgcttgaatccgggagatggaggttgcagtgagctgagatcgcgccactgcattccagcttgggtgacagagcaagaccctgtctcaaa

SEQ ID NO: 725381 - DNA, 411 bp, Homo sapiens
aaggcaaaaaatgtggattaattccggccctgggggtgggggggttttttataaacccaaggtggttggtttaagcccaaaggagatcccctcctgataagctctgtgaaaaaaaaaatgggcctggtgtgtgtaatgcggctggggtatgaaaaccctgaaaaggagatgaaggagtgtgtgtagcatgggggggtgtccaacttaacccctgggctttttctgggggagtgggaaagtgattttgtaaccccccttagaattcctttgggtttgtaatcagattggttttatgatttgtctttggctattcccaaataattgtaaatgctggttttataagccccagtccttttccctttgcttttcccaaatgtattaaattggaattttttaatcctttttatccca

SEQ ID NO: 725382 - DNA, 120 bp, Homo sapiens
taccaagtaagaagtatattggtatcgaatgatgtcactcacgtcagcaaagccaaagagctgaaggaccggcaccgggacttccagacgtgatctcaggagcgtatataatgaagtatg

SEQ ID NO: 725383 - DNA, 133 bp, Homo sapiens
tatccaatgagctggtacccaaccggcgatggctgggcagacttggcgaggcgcgatcagcgtgccaccaccacgtggcgctgggccgccagcaccgcgtcgatgtcgtcggccatgtagcggatctctgcca

SEQ ID NO: 725384 - DNA, 615 bp, Homo sapiens
  misc_feature (120)..(120): n is a, c, g, or t
cagaatcacactcaaaacggggaagttccagcccaactgtaacatcagtgcacatgtatgatggcgcgtggctgcattctctgtgtcccaagaactatctctcccaacttggctgtccanacctcggctggtcaaagtttacggggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgttttttggaatggagcctcgcatcctatacaaccctttacaaggccagaaatgtattgttcaagcaactccatggtcccagtgctcaaagacctgtggaactggtatctccacacgagttaccaatgacaaccctgagtgccgccttgtgaaagaaacccggatttgtgaggtgcggccttgtggacaggcagtgtacagcagcctgaaaaagggcaagaaatgcagcaaggacaagaaatcccccgaaccagtcaggttacttacgctggatgtttgagtgtgattctggcggggtacg

SEQ ID NO: 725385 - DNA, 419 bp, Homo sapiens
  misc_feature (407)..(407): n is a, c, g, or t
ccaagttcctttcccaggaccaaattaatgacaagaacggagagctggacttctccaccttcctgaccatcatgcatatgcaaatcaagcaagaggacccaaagaaagaaatccttctggccatgctgatggcagacaaggagaagaaaggttacatcatggcgtctgagctgcggtcgaaactcatgaaactgggagagaagctcactcacaaggaagtggatgatcttttcaaggaagcaggcattgaaccaaacggccaagtgaaatatgacaccgtttatccagaggatcaccattcctgtgccgagactactaaggggagccaagatcaagagagcagatggagagccttcggggccttgaaaacctagactgattcctttttgtaagggaagttctagagntgacacaaccat

SEQ ID NO: 725386 - DNA, 94 bp, Homo sapiens
  misc_feature (67)..(67): n is a, c, g, or t
gcttttgggaaatgggggtccctttttaaacccctgtaaaaaaggtttttggagcctgaatgtcttnctgtgatcaattaaattttttaaatga

SEQ ID NO: 725387 - DNA, 1128 bp, Homo sapiens
gcaataatcccagccaattcagaaaatctgacgcacgaggattacttgaggccatcactgcgcaatatagcaagaccccatctctataaaaattaccgcagtggctggatgcactgccgtgtatttcccagtcgtacgttctgtgagtgttgagagtgtggatggatcaactttgtcagcccgagaatgttccatgtgctgcaactgagccgattgattactagccagcgggtcgactcacatatgctttgtgtggcacacgtgatgaagccgtgactcgttaaaggagttgagcatgagaacgggcataggtgcccatgtcatgtggcacctgaaagctgttcgatgataacaaacttcttcgttcgttagcatcatatgactcgaagatgagcgaacatcccaatcgtcgagtgtaatgccagcagtatttgggcttaaccacccagtactcacatatcatcaataagggtctctttgagtgcgaggtagttctaaagggcgaccccgtgttgacacccggtggtgattggcacccgggggggggacccctttccatataaggcccacttgttaccgccacgtgaggtgctctttagagagttcacgcgatcaacgcgctgtggcccattgccaagaggtattgaagcgtcccatgtgtctgggcccccccggagatacacacgtattttgacccccttttaccccgccgtttgcacacgcgagagacctctgttgcgcctctaaaataagtcctggtgaagtgaagcgcaccctttgtgggagcccccgaaaaaacgtgtgcgactcgtattctcccacaattttgtgtacaatgtgccccccggggggcaagtttatgacattgctggtggacctttttctacaatttagcgctggctcatttttaacacacggtggacacagctgcgccacatgtggggctttctacacattgggggccgaaaaaaaacacatatacatatgcaccacaagatccaaggaacaaacaaagccagtagctacatactagacacatagggcgacaccaccgcgcggcagccatcacattttgttttgccgtgtgggacccgccgcagaaaaaacacacgtgtgtcagcccgccag

SEQ ID NO: 725388 - DNA, 191 bp, Homo sapiens
gaagcagatctagtggagcagaggaagctgctggacagtgtgccagtgatccgctctaagtctcccatgctgatctcccagcataacgctttctttgctatatgactgtggtggatgctagtgatactgctccgcttcgatcgcggcgaaggcagataaagtggagcagaggaagctgctggaaaagtgtg

SEQ ID NO: 725389 - DNA, 439 bp, Homo sapiens
ccaggaggagctgcttaagatctgggagcccatcttgtgtcagtggagctggatatgagacatacagtcaaaggagattatttttgacctttaaggtttaatgactgccctgctggatttcaggcctgcatagggcctgtagccctttgttttggccaatttctcccttttggaatgggagcatttacccaatgcctgtactcctattgtaccttggaagtaactaacttggttttgattttacaggcacataggcagcagggacttagcttgtttctgatgagactttggccttggatttttgagttaatgctggaatgagttaagactttgggggactgttgggaaggcatgattggttttgaaatgtgaggacatgcaatttgggagggtccaggggaggaatgatatggtttggctctgtgtccccacccaaatc

SEQ ID NO: 725390 - DNA, 579 bp, Homo sapiens
  misc_feature (22)..(23): n is a, c, g, or t
  misc_feature (74)..(74): n is a, c, g, or t
  misc_feature (384)..(384): n is a, c, g, or t
aaatggcggatgacgccggtgnngcgggagggcccggaggacccgggggcccaggattaggaggccgcggcggnttccgcggagggttcggcagcggtcttaggggccgtggtcgtggccgaggccgtggccgtggtcgaggccgcggggctcgtggaggtaaagctgaagacaaggagtggatccccgtcaccaagctgggccgcctggttaaggacatgaagatcaagtccttggaggagatctacctgttctccctgcccattaaggagtctgagatcattgatttcttcctgggtgcatccctaaaggatgaggttctgaaaatcatgccagtgcagaagcagactcgggctggccagcggaccaggttcaaggctttcngtcgctattggggactacaatggtcacgttggtcttggtgttaagtgctccaaggaggttgccactgccatccgaggggccatcatcttggccaagctttccatcgtccctgtgcggagaggctactgggggaacaagattggcaagccccacactgttccatgcaaggtgacaggccgctgtggctctgtgctg

SEQ ID NO: 725391 - DNA, 1032 bp, Homo sapiens
gtttaacgcaatgcagaacggaacccatgatacttgatagatttgtgaaaacttgttcagcctggattattcattacttgtaaatactagtgagaaagcgatattctgcataggagaacaccaaaagtgtggggcatgcgtactgttcccttcagttaatagagcttattggcattatgtgaggtagaatagctactgccagtttgaagttgaaggtggttggatgacatggaagtaatcgaaggccggacagttgaacttcgttggatttgacggggatgtagatgatcagaacgtgttcagctactaaagagtgcagttattcttcaaggaaaagggcgtacatacattagtgccaatagtgtgtatttactgcggtcttgtagggctatccacctgttctcaacaagtcagctaggcctctagcccaaagcctcggcgagctagaactgaacttcagagccactagaagcaggaccctcacctagagcactggtcggtgaccttgcctaccccgagtggcctggtgggcagagtcatggaactgaaacagacttattctcaagctctaggagtctaatggaatttggcttgctcggttttgacttccttgggatcatcagcctttttttcctgtgtctcctattggagtggggatggtctcttctataacttgccttagccttagacttttggaaagccacgttactcattctggtttcacgtgattcccagctggtgaggacattttggctcaagatagggttgtacctaagaccaatgctttttgttttgaatggaaactttggaattatagccaatagaggtaaaagctagaaagtagtaagaacacattgggagaatatgggaacagaaaaagtagatataggagtatgaatatagaaagggaaatatataagaggccaaaagaaatataataaaaataggtgtcccaaaaagattttgagaagaaacaaggtgtggttagaaaaaagacggaaaaaataataaaaagacaaaaaataaaaaaaa

SEQ ID NO: 725392 - DNA, 438 bp, Homo sapiens
  misc_feature (36)..(36): n is a, c, g, or t
taccccccaatggaatcaagcccagtctctctctcntcaaaaaaaaaaaaaatctctcttaagttttatttacctaccttcttaaatagagtatgagtctgatttatactttccctctcattaaaaatattgagtgtttgttgtgtgcaaggtgctgtgctagtaaacaaggagttgtgatgagcatccttaaaatctgtaatacgtattatgaaaaaaaactaaaagttgctgtgagagcttaaaataggattatccttaatctagatggagtccaggtggggctttctgtagcagtaatgttctgactgagataaaagatgagtggtatttaagcagacgaggggggaagaggtgttgctagcagagtcttttataaagaccccttattgtgaaagaagcaggttatactgaagaaactagaagtccagtccagaa

SEQ ID NO: 725393 - DNA, 865 bp, Homo sapiens
  misc_feature (2)..(2): n is a, c, g, or t
cnaataaaaatagtaaaagtaagatagaacgcgatggtagataatatttgtgactatgttcacggattcttccccagttggcacatttcatttattgtatagagcttagtatatcaacaccgtggagccctttaatttcaagcactgtttaagttccgcactctagattccttgtccgaagctcaatttctgatgcataaagtctattcccgtaattacactcttcacacattttggcaacagccttgtaaacttcaccagcagtcccgggtaataatgggtagcgttcccccctcgccataaataacgccctggggttcagccccctccccgaggggtcaacccctatagcccccctatatatgtgattcatggaatctccccctgccaccctcgcgtgcaaattccaggcagtcattctcctaatgtctttatggacaaagccacaagaacagtttgcccgagaacataagtagagaaaacattttcaacagtcactgcctcaatacagaaatatgcctttgttcacccaccaccccccatagattcagataaaacctggttcataaaaagtatgtcccgcagacttttgctcccacagaagaatcgcataccccgccatgtgcacgccatacccagactatgggcttcgggtaacgaaacggagcacagcccaaagcgtgttcgcaccggaccccgggaagccccgatgcttctttaataataaacccacaaggggtacaatcccacacactgctgaaaaatctattctgttgttttaaatctggaagaatcctcactctaacaggcggaaaccgggaacatcttttgtttacgaaaggggcccggaaccaaaaaacatgac

SEQ ID NO: 725394 - DNA, 108 bp, Homo sapiens
catattcggtgcggatattgccagttggtacacgctgacaccacctaccgcgctatcctcgccctgctgaacctgaccggttgccaggtcgtaacggtggcggttggg

SEQ ID NO: 725395 - DNA, 516 bp, Homo sapiens
  misc_feature (169)..(169): n is a, c, g, or t
  misc_feature (513)..(513): n is a, c, g, or t
tgactcctgaggaaaaactacggctagctgctgcagaaggatgctgatacgttgttaccggcttataactacccagaggctgtactgaggcaggggccaactgaagctgcggaggcagcctgcgcagaatgttctgcacacaaaccttgtagaagatgtgtgcatagcnggtccactgctgctgcccctgccctgactcccagccctgcctgaccccacctcaacctgctcaggctctggcgcaaccctggctgccctgccactgcctctgccccagagttggggccttgacagcctggttggaaggggacaccccagccctgcctcaacacctgggggtctccataactaccacaggcaggtgggcaaccccaaagatcccaggactcacagtaccccctgagaacatggacagtatgtgggggtagcaatggagggcaggatggttatcttctcccaggtaaaagccatttaatcctttcagtttgggacggagtaaggccttcctttttngtt

SEQ ID NO: 725396 - DNA, 442 bp, Homo sapiens
gctcggcccttgatgacgaatgtggaagatgcaaacaagtcgtaaagttaaagcttctacagcttctaaataccccattgagtctattgtaggacagataagcctagtattttacttgcctgaagatgttcatgtaggggcaacgcgtagtgaagtgctctttgcttggggtgcaccgcggagctatgtggcgggataatacagatggttctttgttatggctatatgaaggcgttattggtaaagaacaaactattacagaaaatacacaaaactctctattcaaaaagaggagttttcacatgttggtgaacaatacttatactagtgactctttatcaggttctaacagttctgtgggttatgtatggctttcattgaagcacgggaaagtcacgcatttgggaatgattgcgggtcatggactggcctcgttttgcta

SEQ ID NO: 725397 - DNA, 174 bp, Homo sapiens
tgtactggccatagctgattcttgagtatcctggttaccgtgggactcactgacgtactgtattccagatttctcttgagcgcgtttctggagccggcccagaacagagggaagccagacacaccataccgcggcccagacagtaggcagggctggctgctgggtgctaggtca

SEQ ID NO: 725398 - DNA, 1110 bp, Homo sapiens
caggagtatcactgcttgatctgtggctgacactgtatcttctacaacaacaagtcataccacagacaagcctgccgctccttcatttggtgtccttatcaaatctgccattacccattcccacagtggatagcttcaataccgacgaagccgaaaatggctttgggatacaagatgccgagatgtccctgtatgcatgtccagaactctcagaactacgtgtgtcacaagtcacagatatgaatgaacaagaggacggtataactagacacagttgtctgactttgactcaactaacaacgaaagtaagttaccgacacaaagatgacttagtagaaaagtagttgaggaactcagcaggaaacaaatctccttgtggagcccagcttggaagccaaaagagactaaattggtaagagataacgtatgaattatcttacacaggatgcacgtctcacgtattacgataagaggaagactgctagaggcagcaatgacacttaggtgagagctgtagtgcaagtgcccttcaggacaagattgaacagtaggctgcagatgaagggtgaggacagaactctgacttcaatattgcaggaagacgttcattggacgggaaagcatggacaactacgctgcatcaactccagtcagctcccaatggcaaaagaagaagaaaccaaatacgcaccactgcacgacacgacgccacagggcaaggaagacacacgtaccagaccacgggcgactcagcgcactgccacacagcacaaaatcaatgactccaccgtgacttcagaactcaccctgagcaacaaaccatgcaacactggccccacgacaagaaaagaaccaagcgggaaagcacaaagcaacgccaaccgcacccctgagccacactaaatccaaacgggagaatggcacacagaccaatgtgaccagttagccactcccagatgggagcgttagacatccacaccggactacagcccacgacaacaggacaccggaccaaacaccgcaaaacctgacgacacagcgaccagtgacacgtgccagacgcaaagacacaagtaaaagccagcaaagacaccactcggcacgctaaca

SEQ ID NO: 725399 - DNA, 147 bp, Homo sapiens
cccacaatacaaacccctgaccctcctctccagccctgcatctcaccacctcctctatgcgtctgcactagcctagaccatcaatggcttctggtaggcgtcctctacatctctctcccacagtaaccccgtgccccattcggcccc

SEQ ID NO: 725400 - DNA, 348 bp, Homo sapiens
ggcatatacactgcgatctctgcaggcacactcttcacagcgctatgctagcactgatcttttacctgtagtaggcctagaaatatacatgctatctccaattcccgttttaacccaaacaatgaaccctggatacacataaactgccatcaagcatttcctgacgccagcgaccgtatccataatccttctaatagctatgctctttaacaatatactcttcggacaatgaaccataaccaatactaccaatctgtacttatcattaatactcataacgggtatagcgatccctatgacatgcgaactggttagtctcacatgacacctatcccctatctcaatctg

SEQ ID NO: 725401 - DNA, 1673 bp, Homo sapiens
  misc_feature (1344)..(1344): n is a, c, g, or t
ggcgagctacggagatctcgccggatttattgttcaccgtcggatggtctgcagcaacctccgattcctctcctaggcgaactagagccactggctaaaagttcacccatgtcatattctctaagatccgatgccaatggggagatctattgtattcttcgcgggaagtccgctacttgatggaggttgcactctcattcgatctacaaaaaggtcatcattcaagcagacttgcatgttgcaccaagtagtgtgcttcaaacctggtcatactatgaagagcccctagaaagctccgaggatcagatgataatgatctcgactatattgtggtgaacggtgtagttcttcgtcatggacttgtaagaagtcccagtaacacatacatataactaattagacggcctgctcctgggttacagtcagaggaatactggataacgtacatcgatatagcaaacgacgaatagactctgaacgaaatcttgaatggagtccagacgaaatagggctgtagagcataccaagcacacgaaatcaagagtatcatagacgctaagaggctaagccaaaaacaccggcccagtatcacttggcaagcaccagtagatacccccattctggccctggtctactagggctaaacatgtacactagagctagagaccaggcttagaaccagaaaaggggggtggggatccccaccaatatggatataccccagacaccaacgaatcctggcattccgataaccttttagcggcattgggcacaaaccaagtcagtcggacacggtttccacgtacccattcgcaccaacgatacccccagggaccggtttccaaatttggtacaattcacaaagttgcgtcccggatgatgaacctcacaattgagcatagagacagatacgactagcacttggggagcccactagacaacagtagaacgggttaccatatttagcaattgcccatcctgcaccaaggaactaggggatcgcacaagcaacgaggaaccagttttccaaagagggacaaaggcccagcattgccgagcaccatttggagaaacgaccaaggacagcgaatgttgaaccccaggacaggccccatggaagcgcaaactgtgtcgccatccccaaggggcacggaacacagtaattgggggaacacaaggaattgccaaaccagcaaaattgctggagaccgcaatgaacacaggtcccacggatatgagactcaccccagatagtcaagtctccctgtcaacgaaccgtaaccggaaacgggccccttggcaagcctagcacaaacacaagaagtggctgatactatgagcganaaaagacatgtggctggaaacacacaggacatataagagctcggggctcatactcaagaaaactgagcagagcatcagacccacgcaaacctaccgcgaaagcataacccgctcagcgtcacgtacgaaacaaataactgaacacaacagtgaaaactcatataaaacctaacaccacggacatcacaccgaccacagaccaagtgaacaaatatacatagcactgtacacaaaacgtcgcactgaaccacatccacaccagaacacaatgaacataacgaacaaaaccacgtcaaggtagaactaacctagacgaaccacacatggac

SEQ ID NO: 725402 - DNA, 842 bp, Homo sapiens
  misc_feature (765)..(765): n is a, c, g, or t
  misc_feature (785)..(785): n is a, c, g, or t
  misc_feature (825)..(825): n is a, c, g, or t
ccaaaatccaatagggcagtcattgagccttaaagttccaaaatgatctccttagacccgatgtctcacatcgaggccatgctgatggaagaggtgggctcccatggccttgggcagttccaccccctgtggctttgcagggtacagcccccctcatggctgctttcatcatgggctggcattgagtgtctgtggcttttccaggcacacggttgcaaactgtaggtggatctaccattctggggtctggaggatggtggccctcttctcacagctccactaggcagtgccctagtgaagcctctgtgtgggagctccagacccacatttcccttctgtactgccctaacagaggttctccttgagggctctgcgcctgcagcaaacttctacctggacatccagggatttccatacatcctctgaaatctaggcagagctttccaaatctcacttcttgacttttgtacaccaccacatggaagccattagggcttggggcttgcaccctctgaagccatggcctaactggaccttggccccttttagccatggctagagcagccgggatgcagggtaccatgtcccaaggctgcacagtgcaagggggactgggcccaaaccacaaaaccttttttcttcctagtcttccaggcctgtgattggaggggctgctcttaaggtctctgacatgccctggagagattttccccattggcttcgtgaataacattcatcttcttggtatttaagcaaattctgcancaggattgaatttctcccanaaaatgggttttctttggcatcattaggcttcaaattttncaaactttcatggtctg

SEQ ID NO: 725403 - DNA, 240 bp, Homo sapiens
gtaccagctgaaccgttttgtattaaactggccgtctcccggtcactaatgccctcttgtggttatccctaggagcggcccatgacggtccctgtattcttgtgtcctagaagtcaccgcggaggacaaaaccaaggaggagaagccagaagccaaagggtgaggaaggagtctgcctgtgcacatctccctagcataggagcaccagcccctttgtccaccactctgaggaaaggcaca

SEQ ID NO: 725404 - DNA, 155 bp, Homo sapiens
gtgattacagcgctatctacaaagttcttccagcactaaaaaaactagcgtcccaaaatgatgtgtatctgttacacatactctacgccctagccaagctttgctttttcttttatattctctttgtagagaacggaattctggccctctgttcg

SEQ ID NO: 725405 - DNA, 157 bp, Homo sapiens
tactggcatttgtggagaaagttgaacagcagccctttcagtagtttggcatctcagtgcactcaggtagctcctcttctgctaccactggcatcctccgcaggtggcacccagactggactcgagtctcactcctactgcagtattcgtgcatcta

SEQ ID NO: 725406 - DNA, 197 bp, Homo sapiens
ctagacgctgtaactatgtgcatttgatgtagaactactgttacattgcacacgttctttaaaattccaatagcaggaaattgctgtctactggacacgaaattgaaggttctaaattagttccattctggagctggctacatatgggtaaagacctactttttatacgacttcgacatttgactggtgcctggagg

SEQ ID NO: 725407 - DNA, 217 bp, Homo sapiens
gaaaggtttgttaagcatctcttaagtgccatgatgagcataacagccggccgtggtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctactt

SEQ ID NO: 725408 - DNA, 1673 bp, Homo sapiens
ccagcctggccaacatggtgaaactccgtctctgctaaaaatacaaaaatagctgggcgtggtggtgcacatctgtaatcccagttacttgggaggcccagttacttgaggtgggaggatcgcttgagcccaggagtttaagacctgcctgggcaacatagtgagaccccatctctacatccaaataaaataaaataaaataaaaaggtaaaaaaaaaaagagagagagagagcacgataatttttgtaccaggaatgaaaagggagcccaaaaatctaagcagtgagcaggtgctgaaaccaacgtactcacagagcaagccaaacaggattagactttattactggggactgggcttgaacctccgggctgcagcatcagaggctaacagaatggagagtaaaaaggtgggcaaaagacttggggctggaaagcagcagatgggagcagaattgacagaacagcacatggccaggatatccctccccgctaaaatactaggatactgacttagaaaagcagagggtcagggaaatctaaaaaaaaaaagactgacatttctatttaagagacattgcctaaattgctgattaaataaacagatccaaccagatctaaataatattggacatttaattagttttcctattacactgcaggtacagcctcaggaatacttataggcaaaattaaagtgctacttttctatctgcctctctgagttggagtgagttaaatgtgtaacccccacattgtatataataatctcttacaatcttgttcatagtgccacctatggtcacgaccaattagagctggtaagacagctgtactgtttgcttcagccaatgagggtaaatgtactatgttgctaaaactctcagcccatgagtactctcctgagctatcctcagccaggcatgcactgcaagatgggtcatttgtgcttctttggcttaactttctgccattgactttgggttctagggaacagattgaccccaaacatctgacataacctacgtaagtgacagtgttggcttagaataaagaaacaaagactatcatggcatttttttaataaagcaagtgttacagtgacctgttttggggactgccagagattaggtggcagttgccttctagatctagccacaggagaaaaaattaaagagccatatgactgtgaggcagatcctcatcagggaggaggcgcagtgtctttttaaccactttgaagaccaacagccaagacatcttgagctagttgtggtggacagagagttccaaacacctcagccaccaggaaaagggagtggccaggaagaggctgcaggctcaagggcagggattctcccacccacctaaggaacctactgagcatcgaaccactccaacttgccttgggaggaggacttgaatgctaccaaagactgctcgacaggcctgcaaggcaggactacttttgtgagaatttgaagaccatgccgacctgtcatttaaagacacccatctctgcctgagctgtcagatttgccaagttctgggttgtctcataattatttactcagtacaaaataataccagccatgatcctcagtggtaagtagcagaaatcaactgtatttgtttgctaaggctgtgctaataaagtgctgtaaaccatgtgaaa

SEQ ID NO: 725409 - DNA, 858 bp, Homo sapiens
cacaggtgtcgtgaaaactatcccctaacacattccaacttgggataggtaaccgactcatatcaaacacttgtcgtctaggttggatcacgtactattcgggcaagtccaccactactggccatctgatctataaatgcggtggcatcgacaaaataaccattgaaaaaattgtgagaagagaggctgctgagtatggtgaaacgggctccttcaagtatgcctggatcttggataaacttgaaagctgaggcgatgaaacggtaggtagtcaccatgttgcatagtctccctcgtggacagtttgagaccaacaatgtactatgttgaactactcacttgattgcccctagggacacatgagtagctttatcagaatacaacaatgcatttatcacgggaatcactcgtcagggctgagctgctgcctgtcctgcattcgtgtcgtcatgctgggctgttggggtgaactttgaacgctggtatctccaaggaatgggcagacccgataagcatgcccttctgtgcttacacactgggttgtgacagacacacttaatagttcggtgttaacagaaattggattccacttgagccatccctacagccagaagagatatgaggaaatcgctaagtgcattcatgtacttacattacggaaaattgggtaccaacacccgatcatcagcagcatattgtgccaatcctctaggttgcgaactggtgacaacaatgtctggtagccaagggtgtcgtagacagtgccttggtgtcaaccggatggcaaagtcacccgtcaaggatggcaaatgccagtggaaccacggctgcttgaggcatctggactgaaatgcctac

SEQ ID NO: 725410 - DNA, 143 bp, Homo sapiens
agaggtccctcacaacgtattctcaattagaccccctgccattaccccataccaagacgcccctcttcgtttgatccgtcctaatcacagcagtcctacttctcctatctctcccagtccttagctgctggctatcacgtata

SEQ ID NO: 725411 - DNA, 833 bp, Homo sapiens
gctacaaagatgccatggagcagtgccagaattacaatgctcgcctctgtgctgagcgcagcgtgcgcctgcctttcttgtgactcacagaccggagtagcccagagcaattgttacatctggactggaaaagctgacacctgtgggtccatggattggcctcctggacagctgtactcctaccctgccctggctgctggctgtgaaaacacgctggcgatgcccatccccctgaggatccacgactttccttcccatctattaagccagacacagaccagaccctgaagacggacggggctgatctctcagcgatggcagcactttagaggctctgctcgctgcactgaccccctgcagaacgcgaggtgccccggatccccgagttgatgactcgacacgcctgggcgagtttcctgtgaccaacagtcgagcgcgaccgcggatcctagaaccagatgacttcctggactgacctcgactgatgaacgacctctgacacgaacgactcctacccaacgccgtcgggcgaacacgcggcgaccatcccaaagggcctacacggcgtgtcggcgcagaggcccgcaacggaaccgctgtgatgtctttccaatccctgggcagcgactccgggtgcatacgcgcccgtatgccctgctgcaccactagggatgggaaacaccggtacacacagcgaaacccgacccaggggcctcccagcccccccgaccttcatcgccccaactaccacaccatcgcgctacgacaggcacggagcggccgcaccgaaccccacggacaacacacccacccaccacacccccccccccatg

SEQ ID NO: 725412 - DNA, 500 bp, Homo sapiens
  misc_feature (79)..(79): n is a, c, g, or t
  misc_feature (395)..(395): n is a, c, g, or t
cctttggcttgtgacctttattggacccttatcagtggttctgctttttccttttgtcctgttccctcagaagcatgtnatctttgttctgctttttgccttttaaagcctgtgatctttgtacctactcccagttttacaccccctccccttttgaaacccttaataaaacacttgctggtttgaggctcaggtgggcatcacagtcctaccgatatgtgatgtcacccccagcagcccagctgtaaaattcctctctttatactgtctctctttatttctcagctggccagaacttatggaaaatagaaagaactacattgatatattgggggtgggttccctcgatatactgggtttcaatttactgtattagtgtgttctcatacttccgntaaagacataccttgaaactgggtaatttataaggataaaggatataatggacttacacttccacatggctggggaggcctcataatcatggcagaagacaaagg

SEQ ID NO: 725413 - DNA, 831 bp, Homo sapiens
tgacccagcagctctatatgaacttactaatacaatacctcaaatcttaaatatacctctttaactggcctccgattttgaggctgtaaagggcatgtctgtagctctcgagtcgctgtggtacaagtgaacgatagttgtccagtagtagtccttagtggtcgagcggactgtggcgatatcataggaccgtcactcttctttgctgcatgcccgagaatgaaacacacgtgagtccgtgaaccatctccatgtcagtagtcgcctgagtgtaaggtcactcatgtctattcaacggaaggtgcacgaaactgggctacgacgaacaccaggacctggaaagttcggcatctaaccttgctgtacatgcattcaaaatctaagggagatagtctctcgccattttcagaccatactcaatgcataataagcgcatttggagcgtgtcgaacggggcatgtcagtatcttctttgttcggtccttgggcatgaagaggtacactctatggagtgattcttggtgaagtatactcgtaaaaaacgtagagggttcaagtggtcgcattattagtcgctgatctagtagagacgctgtctcaaaacaatatatagaaattggggattgaaagttaaaaaaaattattctgtggtctgttgtgggggaggaaggcctagaagatcagagagtgagtcctgtttgtcggtgcctcactgtctggtactattttggggtagtgaatatgaacccagagtgccttttctgtcaagaatatatgtgatttagtcctaatgtgtgccgggtgtccttggatatattaccctgtgttggg

SEQ ID NO: 725414 - DNA, 110 bp, Homo sapiens
  misc_feature (71)..(71): n is a, c, g, or t
ggggggcttctacttagggggcaggcggacttcgatggcaaccgcagatcagtttttttctctttcacagntagacattcatacaactacttcaaagatatagtcaatag

SEQ ID NO: 725415 - DNA, 513 bp, Homo sapiens
agcggggggtgcggggagccgccgcgcgtcgccgggcggtccaccccgacccccgcagctctaggtgacgcgtctcacaataacagctcgccgtggagccgagctcaggcacagccggaggacgcgaccccgaccagaacactcatagagtgggccagagggacctacatagaagagactgtgaaagcgacttactgcaagacccaggagacaaaggcctgggaggctagacagggctctagcagacactatccaggttggagaggactatgctagtatctccatgcccgagactatgaacatacgattgctcatcggtcaaaagatcatgggagaaacacacatgagagttactcgcgttcacaggaaaagaatggattgtccaaatgtggaaggatgaatacagggattatatacgtgacaatgatggaggtgtcaagaaaagaagatggggcgcatggagcaaaggcgtggagatgtacatcaccatagggatgtagtaaaggtggaaac

SEQ ID NO: 725416 - DNA, 228 bp, Homo sapiens
cctatctctatataaagaaaaacaaaagagatcccatttcatattcatcagtatggtaaaaataaaaaaaaaatctagccaaagccaagtctggatgagatatggagtaccagtaagctaactccccaccggggtatggttcacatagaggactaactacttatggaggacatggaagatacctcaagtttaaatgctttataacccaaggctcagtcaaacggacgg

SEQ ID NO: 725417 - DNA, 110 bp, Homo sapiens
gaggatccctgtgcgtgtgtgtatgtgtgtgctgggcgaggtaggaaacaagagatattgaccatgactcccaggtctctggcctggctggttattgccattagtggaga

SEQ ID NO: 725418 - DNA, 137 bp, Homo sapiens
  misc_feature (127)..(127): n is a, c, g, or t
atagaaatagtagtttccatagagaggtgaaaacaaattcacaaagggacatagtggcattgtctagacactaagagcaacagagttgagagctatgatttctaaactttcacaggggagcattagnacgagctata

SEQ ID NO: 725419 - DNA, 421 bp, Homo sapiens
ctttctgtagcaagggccatgcgaacattacaactatggtttcaaacagtgggcccatcatcgctgttgactagagtactgaacctcccgaagtaccggacaccttgggaaaatgcctaattgatactttaccgatgtgacatggccaggaatgacttccataggaactggttacttcattggacactctgtgctgctgaaattagcctggccaatagcttgagcgaaattgacctcagggaaccctaagtctgcgcagtgtccatgttgacagatggaaccccgtgcttaaccctatgcttccggacagctgacagtttgcgaccaccacatgatggctcatgatggaacatgcagttggactcgggcactttaattccgataccctgcctagattacatttggttccttgggtcccgct

SEQ ID NO: 725420 - DNA, 1155 bp, Homo sapiens
gcccacacgccgggtccggctcatgtgccggtcggacgctcctcgccttcttgcggtgcgatggcctcgctccgggtgtgagcgcgccggcggcccgcgtctccctaggatccctgagtacggtgcaggcggtggctggctctcgcctaccatccttactagcatgggcgcctgtccgtagaatcctcgccacggtaacggtcccgtgtggcatcagtcgccatcttgctccacctagcaggggcactagccatgggtcagaacggggtgtgactggtgaacgagactagtgataacagctgtccgagttatgcatggtaatcattactggggatccaaatggtatccttactcgaatgaatgcgaattgagtgctgaacgtaggcgctcgatatgagtaagacaaggggccctttaaaaggcaatgcccttggccaagatttgacgtggaggctaaattgttgcgaaaaacgtgtgttgtagacaccttgtggcatttaacgcctaattctcgcattgcggcaagaagacatgaatcaaatccttttggaaagactctacccgagaattccagacattttgtcactgaattttggcatccactggagctgcatagattcgcgaaactttcgttgcgtgaataaccccctgcagagagagcattgttaactaccatgtgaacctaatgatagtgcaatatagtgccccccgatacatgtgccttgcaaataaccccgtgttccttacaatccaaagtacctatggctaagttcatgggggtgctgcacgcttgaacgccgacccaagaatgtgacgaagtcctaacagtagccgtgaaattcgggggcttccaaattggagggcttttcccatacagtatccaatatccgtttacaccgattaaatattaaccgaccgattgtgcccccaaatgtagaaccgggtaaacccagtttggaacacggcgcccatacaagcacaagacctttgcataggtaggcaggactatagattgggggcgaaattgggcgatagacacaagtttcccgcacaagacaaggggtggcttcataagggcaacaagcagcaaagagtccgttaaattgaagaaagaaccccttccagatagcccacatggaggaggatcgaaaggaa

SEQ ID NO: 725421 - DNA, 253 bp, Homo sapiens
tccttttgcccccctgaagcccctgtatttgaccttacgtgcccttttacctaggagaatcgggctcctttattaatgatgataattataatgtatctgtcccgcccttttttcctttgcgaagtgctttcccatccctgttagtttctagtttttaccactgtaaggataaaacccgtcatgtggattcctttttaattggtgctattggtatttcctctgttattgctaataaattaaaatggtggtatta

SEQ ID NO: 725422 - DNA, 411 bp, Homo sapiens
gtatcatacatgctgtttggttacatagagcctgtagtatatttagaagtccaggtagtgtgatgccatccagcttgtccctttgctcaggattgcttcagctatatgggctcttttttgattccatatgaattttaggattgtatttactaactttgaaacaatgatgtaggtgtactgatagcagttgcattgaatctaccaattgccttggatagaagagtcattttaacaatattaattcctccaatccatgagcatgggatgtctttccattcgtttgtgtcctcttcgatttgtttcatcagtgctttgtagttttccttgtagagatctctcatcttctgggttaaatttattcctaggttgttgggtttttttttctttttatctattttcttttatcttttt

SEQ ID NO: 725423 - DNA, 344 bp, Homo sapiens
gagatgtcaagagaagagacgagataagtcttgctctttgtcactcaggttggagtgcaatggcacaatctcggctcactgcaacctccgcctcccgggctcaagccattctcctgcctcagcctcccgagtagctgggattacaggcacctgccaccatgcccagctttttttttgtatttttagtagagacaggttttcactattttggccaagctggtctcgaactcctgacctcgtgatctgcccatctcgtctcttctacaagagaagagacgagatgcatggggaaaatatttgcactctaaacatacagagatagaggttgggcttgtggtacttaa

SEQ ID NO: 725424 - DNA, 292 bp, Homo sapiens
caggttccccagatttgtgaaccagccaagcacagtggtggcagggcctagctgctacaaagaaaacatgttttagacaaatactcatgtgtatgggcaaaaaactccaggcctgtatttgtgactaattgtataacaggttattttagtttctgttctgtggaaagtgtaaagcattccaacaaagggttttaatgtagatttttttttttgccccccaagctgttgattgctaaatgtaacagtctgatcgtgccgctgaaaaaatgtcttttttttaatgtgctgtgta

SEQ ID NO: 725425 - DNA, 379 bp, Homo sapiens
  misc_feature (375)..(375): n is a, c, g, or t
gatccacaaaacataccacctcccaaagtattattattggaaaatcgaggaagtgacgcacatttagggaaaaactactcaccttagaaaagtcactgaaatcctttttttttttttttgagatggagttttgctcttgtagcccaggctgggatgcaatggcatggtctcagctcactgtaacctccacctcccggattcaagcaattcttctgcctcagcttcccgactagctgggattacagctgcctgccaccgtgcccagctaatttttgtatttttagtggagagggggtttcaccatgttggccagtctggtctagaactcctgacgtcaggtgatccgcccaccttgggcctcccaaagtgctgggnttag

SEQ ID NO: 725426 - DNA, 442 bp, Homo sapiens
ggagctcggccgtgttagagtaaggcagtacccaacattatacttattgccaatagattgttgtacataatactatctcacttccaaatcaaaccgtatttgctgcggtgataggtgtattacgagttccaacatgaggcgtccggaatagatctcttgtaatagcagagatgaggtttcttccacttcgtcttccaaactgccttgcttacgagaagtgggaattccttcagctaagacatttggtgttgggacataggggctttcatgtgtaaaggaaaaaagaaatagaagaaaagtctgcagggagaagggggaggaccttacacatagcaatctcagctggcacacctaattgccgttttccccttagctcagctgaactgacagtctcttaccttggtgtcagttaagtactgttcccaggtgcctttcaggcact

SEQ ID NO: 725427 - DNA, 581 bp, Homo sapiens
  misc_feature (83)..(83): n is a, c, g, or t
gctgatcgcggagctggccgccgcgtgcgcgccctgcggcagcaactgaacgaggccgcgcgactcccagcgtctacgcggtnggactacggagaccgttgacggcggccggttcatcgtggacggccaggctatgccggtgtccgagggcctggggaccggtacgtgccgccagcgaagatgccggccgtcttgcgagctggctcggccagccttcccggcttcttcgggcctggggccggcctggtcgaggcgccaagtcctggcgcttgtgggcaaggcaacggaacggaaggcccggtggcattaaccatggagcggcccttcagactgctgtgtgttgctgggcccggaactaacgacggtgcggcaagggtaggaaacctttgggaacccaacgggcgaacagcgccgccccgtggggggcggcactattctcttgggaacctcttttccaacacaggggggcaacagaaccttggaaagcaagcccggaagagcccgcccggggggcaaggcaattccgggaaagcgaacggtttcgcattgggttaaccccaaatgggaaccctgggggccgg

SEQ ID NO: 725428 - DNA, 541 bp, Homo sapiens
tgggctctgggtggggtggagagggaggccaaagcagtaggctgtagaggggcggtaaatccaaggggaggatagcagttatggcatgtagtgaggacaagcagtgggtcatcagtgaatggctgtttatgtccctgccagtggtcatggtgagtccttcggaaatgggataaggttttttttacagtcatctcaataggctgaggatcatttagatgtgcacggagatccatgaggagcgggggcatccaggtgggaacatcgtatggactagaaagaacacttgcaccaagtcctagcaccccagcatggcgttggaccaactctgcagaaggaagggtatctcctacagaaccagggtctcgctttctttcctaaggtagtttggtcctgcaaagtggctcaaaaggattctgcttaggacggtccagggtaagaaagttacatggtagcagaccgcttaaggtagtagcagccatttctcgaacctccagtggttcgtcctccaaaagacttataaccagccacctgatatctttaa

SEQ ID NO: 725429 - DNA, 780 bp, Homo sapiens
  misc_feature (405)..(405): n is a, c, g, or t
  misc_feature (408)..(408): n is a, c, g, or t
  misc_feature (411)..(411): n is a, c, g, or t
  misc_feature (422)..(422): n is a, c, g, or t
  misc_feature (432)..(432): n is a, c, g, or t
  misc_feature (435)..(435): n is a, c, g, or t
  misc_feature (484)..(484): n is a, c, g, or t
  misc_feature (507)..(507): n is a, c, g, or t
gccgggagtcgctgggtgcgtggggctgcctcgccgcgtctcgccacgggctctgccagcagacagccttggacacacaggcacaagggctggagcccagagatgagagtgcccaagggagatgtgagccgtggctgggctgcccgctaacctgtctgctgaagccccagaagcgggccctcaggccaggcctaccctgcctcctggcccagcatgcgcctgtcggtgcggagggtgctgctggcagccggcttgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctntgncanggccatgccgntcatcttcgnggntggcgtgcctcgcagtggcaccacgttgatgcgcgccatgctggacgcncaccccgaggtgcgctgcggcanggagacccgcatcatcccgcgcgtgctggccatgcgccaggcctggtccaagtctggccgtgagaagctgcggctggatgaggcggcggtgacggatgacgtgctggactccagcgtgcaagtcttcatcttggaggttattgccaaggcccgagagcctgcctccgtgctggttatcaaggaccgatctacttctcagaactcggtataccttgtaagacttgatcccgatctccaaacttctgcttgaaattcctaaaccgacatactctc

SEQ ID NO: 725430 - DNA, 932 bp, Homo sapiens
tgtcgggcgacgggaggtggctcccgcgaggtgagtccctatcgctgtgaaggcgggaggcaaaacgagggtcaggttaggatggctgatggggatactcaccggctgaaggccgactgtgattccgcctacccccacaaggcgattttgacccccgtagggtctgctctagagggactcaggccccgaagctgtcccagtggaggtccccgctgcatccaccacccaagtctgtgcctcatggagtcgcatgtttagcagccctgccgaggcggctgctgcagcgagtagaccggtggtgccatgtgactgcttactcctcttccggacctggactggaggtgtactgaggctggagcgagtctgctggatttgtcctgcgacctgggggtgtgaacggagggttcttggccccccggtttctggccaggttccctagacgccaggctaactttgggggaatgattgcctaaggtttgtggccttagtaggggctaggcacggactagcgagcgaggacggaacatggggtgtccagaaagtattggtttccaatatagctatgtgggtatgaaacggaccagaggagcccccttttacaacacccccagcgttgcgcgtgtggtcccctcaacaggtgcgtgcggacgcgcccgtattggcaccactacttggcccaggcctgcggaacttggattggccccccgacaccttatcaacagcggggcgcggtgccgcgccagtaacacgcatcagtactattcaggggtccctcgtcaactgtcccatgataagccaacagagcaaccgcgtagcgcgccgcccctattgctacgagacaaacagcagaccgcgccgctacattctatccccagcaagcgtgggagggctacaggaaatactcgcgagattccgccacaacagctctttta

SEQ ID NO: 725431 - DNA, 502 bp, Homo sapiens
tcagtatgaaaattgatatcaatgaagtacgagatagtaatactgaaggatccatatcttcaggatgtgccaaaggcacccgggaagtctgcttatctaggattgataccaataccagcttcaattgtttataaaaggttaggatctgagttttttcacatatgtcttaggtacaacgtggtttaggtttaataggtagaggcactttatggttgcgttcatggtcatgacagtttggggtactatgaataggatactcatttccttccaaatctaatctatatctggaacggtcactaggtgttggaagcaactgtacatcatccccaattggactataaggaggtggtgcttctgtgtcatcatctgaatcagggtagttattatagggaaaacagtctctgggagatggtagaaaaacatcttcactttgatgggttgattcccttgtattatcagacaaataagaattatctatcatatttattttctctagaacatc

SEQ ID NO: 725432 - DNA, 135 bp, Homo sapiens
ttcgtggcagcagggtttacaacatttgacctgatttcaagaatgagcattgatgacattagaagaattggagtcatacttattggacaccagagacgaatagtcagcagcatacagactttacgtttacacatg

SEQ ID NO: 725433 - DNA, 945 bp, Homo sapiens
gtaaatatcagatagctcagaaatatctaaggcactgacacttcagacattacagtaaatcagaatgctgagtataaaaaataatccagaactaaagttgttagataaattatttgtgtataactttaaaaggtgtagaaaattttttgaaaagttataattacattgaaagtatactttttccttaaaaaatacagattatttgcaacatgaataatgtaattcaactctcaaaattcaaaactcttcttgttttcttcatttctattgtattcaacttgtgactaattgttgcatcagagataggagaatttttttttattagttgggcattatgatcttttttatggaagggtaaggacattaaaatgtaacacacataaaaatctaagtggagaggctcttttgttaatataagtgacacatgaggtgggtgttcagggtaatattctgcattatagtgacaaaaaagcattttaaattttagttaaaattagtaaattattttactaatgtacttttatgtaataaaatgtacgtcttaaaattttaagttatgtgtgaacttaatattattaagattttatttaacatttataaaactgattttaataagttagtatgccattaatttagctatctaactttactcactggtgtacgcaaaagatggtacatactattggtaactaatggacaaacattgttatatcctttgagtgattaactgaagaggtacgatgtctaatggtaatatatatgtagttaggtaaatgaatatggggacatgagggatattatgcaatagagaattggataaaatagggaaaagtcggaaggagtaagatgagataaaggataaagaaaaagatagagaagtgaagaaagaggaaaaagaaagaggtgaaaaaaaaaggaagcattcatttattttaattttattgg

SEQ ID NO: 725434 - DNA, 590 bp, Homo sapiens
  misc_feature (118)..(118): n is a, c, g, or t
ttttcccgggcgttggtttaccttggtgataaacgccctttccccttttccccccacggttcaatttcaactcccctggtggaatattaggatcctggtgttttcccattttcaagcnactgattcctcctctatcttgaggcaagcagtagatgatagaacaaaataatctaaaggaaatatagtgatgatcattttgtatttctatagtattgtttctccctttttaattctcatggacaaaaagcaaatcaaagagtacttcaagtaagcagaaaagctgatgagactatcaagacaactttaaaaaaattgtaagctcatgtttataaagggaacaaaagaattttcttaatttgaatggtactcgtagcattgaaggcaattggaaaagcttttgtcctcttaagaactgttaaagatatcctagctaattttgtttcatttttcagattacactagatgtgttggctgatatgggtcatgaagagttgaaagaaataggcatcaatgcatatgggcaccgccacaaattaatcaaaggagtagaaagactcttaggtggacaacaaggtaagctattcaaaaaa

SEQ ID NO: 725435 - DNA, 213 bp, Homo sapiens
tgtcagtggtattatggccgccatcatgcgagtagtttctggtgctgttagaccagtacactcctattttcgtcaagcatcatcctgtgtctgtttcagcgtgcacaccagtctggttgttatggaccaggaactcctttctctctgtcagaagccttgcctacgggagtaatattccgcggtatttaagtccctattgcaaagtcagccgca

SEQ ID NO: 725436 - DNA, 695 bp, Homo sapiens
ttttgcaagtgcgctttcctcgctctctttcagtaggcgggcgtattttatacacgggcctgcctcgcgttctggcctgcttccattgcgggggcttctgcactcgagcactcgtggtgttctccccgcgcgtgtttggtggtgggtctcggcccacaaaaacacgcttgttctcggtggccacacaccaacttcttgtgggggcgacacacattgaatgctgctccttgtccgtgacggacggctcccctcgtctagcaaaacaacacgtggtcgggtgccgaagacgagcctccggcgtcggcacatttccttctgcatatgtggggcgccaaaactcctctccttgcaaatgagtgcccacatatatgcggataattttttctactgcgcagtgtattcccccccgcatatctgtgtacaacacgatagatgacatattttcttgtagtatatacagggagggagttataaaggtgcggagcccccgggctgttcttggcagcttcaattattcttgtgcgcctgtcctttctatttttaattcccccccgtcaacgtctatatatttgtacctgttttagagtaatacccacttttcttccttgggtatataatacgaaaccaaatctcgcgaccaaaatttcccaaacatattacagtcgtgtaataaaacaacccactcaatagtcaaa

SEQ ID NO: 725437 - DNA, 693 bp, Homo sapiens
  misc_feature (340)..(340): n is a, c, g, or t
cttgatgcgcccctctgttattcacatcggtgcgacagcccgttacatatccgctgcgcaagtttatctcctctgtcgcgctcgagtatttccggcaacagccgatggctgagtgaggcaaaacttaggtctctctaataccatttctatttctacagttctatgcaatctctctatattggtaccaatgagaccctggccttcgagcttactttcgcgggagctttctgagaaggtttcccactgtttacttcccttttatgatacactagttgacaaggcaagataggcattatcacacaagacatacaaaaaatatcctgctttgctactattatgncatgtgtctgctaaaggacggcaaattggttcacaccttcatgtaagttcttttagctttagggggttgtaaagctactcttattacgatatagaatggcagagttctctcgactttaacaacgggcctgagtttcgtattattactgattatgaacgaattacgagtaccaatgtcattaattgatttttcttgttaatcagaattcctattcctgtacctttcctctaacttctcagatttgtaacttcttcttcttgggagctgagctagtgcttttaggagaacagataaatgtggtctcaagccagccctagagactgcttaattgtcgtatggtgtcattctgtccc

SEQ ID NO: 725438 - DNA, 314 bp, Homo sapiens
  misc_feature (19)..(19): n is a, c, g, or t
actacattgaataaaatanaaagcaaaggccctgaggtaggaataagctgggagtgtttgaggtacaattagagttgtggagaggagctgtgtgatatgaaatgatgtggatgatatttaacgaggccaggacatgttgtgctttttagggcacagtaaggagtccgttttattccaagtggaatggcatccactgaattgtactaagtgcatgacttgactttataggttaacggacgtttgtcctgacttctgtatagggacatagacttgtaggtggacaagaagtgcagactggacgtctgggtaccgag

SEQ ID NO: 725439 - DNA, 343 bp, Homo sapiens
atggaacgaacatatcatgcgattcaaaacaccagtgacagagataatcactaaagtttcccaaaagaaaaaaagtaacctgaatacccagaaactggagcagacatgccttagactttaataccaatactgtgtattagaagatagtaaaaacaaccttttaaattactggctgtggaattatattttatagtacttcaggccaaaatattatatcggcataaatatatttttaagattattgccaaaacttggaaaacagattggcccacctatctccagggaagcctaggtaagagggaccaccaatttcatcacaaattgatgcagtaaagccccagga

SEQ ID NO: 725440 - DNA, 119 bp, Homo sapiens
tcatccccaagccatccttgtgtcatccttgagtgatgaacactgcgttccagaaatgaggaagaggagagtgaagagatggacagaccacagatccattaaagtgtttgcacttcaga

SEQ ID NO: 725441 - DNA, 110 bp, Homo sapiens
ttataacgcacaaaagagagctgaccccagtggtagcagtgggtggtgaattgcccagcctctatacccccatcttacagccatcacagccagtggtgggtggagagcgg

SEQ ID NO: 725442 - DNA, 1339 bp, Homo sapiens
ggacacaacacatagacgcacacactcaggaggaaaagaaaataacaaaggcagaagaagaacacccctgaccgactcccagaccggaccaaaaagacaaaacacatagacgcacacactcaggacggaaacagaaaaaacaaaggcagaagcagacagacgaagacataaaaacccaaccaagcaagaagacaacaaggtaaagacgcgacgtatccaaactctcggagacagcacaaggaccgacaaaggacatggaagaggccaagggacacaccgacacaaacacacaccaacgggaagaccccaggagaacaaggcacgatcttccataaaaaataattacaatcaaccatcatccgaactgcatgatcggagacaaggaaccagacagcccaggacagacaccgccacagaaacacacacggcaggcacaatgggacaacatgacaagaaaaaaaacaagagatgacgccacaaagccatagggaaaccatagaaacaccaagaggacccagaccaggcgcagcgaacaaaccccaaagacagaaggcaccaaaactccgtccaccaaggagaccacaaatgatgaacctacatgtcacgggaaaaaaaagaaaccaagaaacccaaaaacaagacacccacaaaaacaagaagagcaaaaacaaaacacaaacaggacaagacgaacaaacacgagaagaccaccaaagcggataaaaacaacagagacacaggaacacaagcacaaaaagaaaaaaaagaaaacacaacaaatagaacacaaagactagaagagacacaaaaaaaaaaatagaatgaaaacaagagaaacagcaacaggaccacctagaaccaaacacaaaacaaacaaaagaaaagaaaaaacagaacgaaccaaaaaaaacaaagaaaggacacaatcaaagagagacaccagaaaataaccaaagggaacacaaacacccacgaagacacaagccaaagcaagcaggcacaccaaacaaaaaaccgacagaagaccaacaaaaaaacacacgaagaccaccacaagaggagaaagaaagaacaaacagaaaaacaccagaacaaaaaacaaagaaaaaccaagaaaaaagaaacagacaaaacagaaagaaagcaaaacaagaagagaaggagacaagaggaaccgcaaaaaaaaaaaaaagaaccaaaagagaataaaaacaaaaagaagaaggagaaggagaacacacacaaagcagaccagagaacacaaaagaacaaagagacacaggagcgggagaaagacagagagaagaggagacaaaacaggaaaaaaggaaaccacaag

SEQ ID NO: 725443 - DNA, 128 bp, Homo sapiens
ttgactcttccagcttttaaagaatgcttgtaattacatgggctctcctagatactccaggataatcttgttttcaacggtcagactgatgagcagagcattacatttatatctggcactcttaattc

SEQ ID NO: 725444 - DNA, 421 bp, Homo sapiens
ctagaggatctcgtggtcgatcactgtactatatgcctgttttcaactacctgagcaattgtggtatttttttaatctactttttttttttaagaggtgagggtctggctatattgctcaggctgacatcaaactccttggactcaagcactctttctgcctcagcctcctcagtagctgggtattatggtatgtgtacatatttacttttagagacagggtctcgttctgttgtccaggctggactacagtggtataatcatggctcactgcagcctccaacacctgggctcaagcaatcctcccacctcagcctcctgagtagctagggactacaggcgtgtgccaccatgcctaatcttttttttttttttttggagagggagtctcgctctgtcacccgggcgggagttcggtgttc

SEQ ID NO: 725445 - DNA, 342 bp, Homo sapiens
  misc_feature (129)..(129): n is a, c, g, or t
  misc_feature (295)..(295): n is a, c, g, or t
  misc_feature (304)..(304): n is a, c, g, or t
  misc_feature (332)..(332): n is a, c, g, or t
  misc_feature (337)..(337): n is a, c, g, or t
tgagacagggtctcaccctgtcacccaggctggagtgcagtggtgccatcagggttcacaggagcctcaacctcctgggctaaagccatcctcccgcctcagcctcccaagtagctgggactacaggtntgtaccaccatgcccagctaattgttttccagagacaaggtctcactatgttgcccaggctggtcttgaactcctgagctcaagtgaccttcccaaagtgctgggattacaggtgtgagccctgcacctgggccctggtttaataagaaccagagccacaaccctntcagagttnacccagtggagccccagttacctgcctnaattntgtag

SEQ ID NO: 725446 - DNA, 258 bp, Homo sapiens
gtgacctcgcgacgtgtatcccagaattaagtataaaacctttttttaaaaaaattatactttaagttctgggatacatgtgcagaatgtgcaggtttgttacataggtgtacatgtgccatggtggtttgctgcacccatcaacctgtcacctacattaggtatttctctaaatgctgggtcaaatggtatttctggttctagatccttgaggaatggccacactgtcttccacaatggttgaactaatttagcctc

SEQ ID NO: 725447 - DNA, 240 bp, Homo sapiens
gggggggggggttttttggttccaggggggttttccaaaagggggcgggggtggccattccggtccccccaagggggggggggtttaaaggggttttgggggaaaatttttaaggggggtttaaaatttccaaatggggggttaatttagggggggggatttgggggggggaaaaaatccccctcccccccccccggggggccctttgggaagggggttttaaaaatttttttttaccca

SEQ ID NO: 725448 - DNA, 246 bp, Homo sapiens
gagtctgtgtatattctgaatacaagtctttatcaggtacatgattgtaagtatattctcccattccatggctagtcttctacttttcttaataggccgggcgcggtggctcacagctgtaatcccagcacttagggaggccaaggcaggtggaccacctgaggtcaggagttctggaccagcttggccaacctggcgaaaccctgtctctactaaaaatacagaaattagctgggtgtggtggcg

SEQ ID NO: 725449 - DNA, 262 bp, Homo sapiens
  misc_feature (71)..(71): n is a, c, g, or t
  misc_feature (181)..(181): n is a, c, g, or t
  misc_feature (249)..(249): n is a, c, g, or t
gaagctgtgtggagtgtgctgtgtacacatctgctttgttccacacacattgcaagttcctgcttgggtgnttatcaggtgccaaagccctgttctcggtgctgggaagtacagcaagtgagcaaaggagacaatattccctgctcacagagattgacaaaactgggcatcctttgagctngacaacacttttccatggaccataggtcacttgtctacactggggtacacttttgtaccagtgtcggnctccactgatgct

SEQ ID NO: 725450 - DNA, 267 bp, Homo sapiens
agtcaggatatgcatgcacacttcccaggcaccgctctgcttttctgtcagctcacaactgctgctcatgcgcacagagtacaggcgagcattcttctgcacaaacttacactgccaaacttctcagcctactaattatactgtggctcctgcgtctcaaactggaatgtctccaagccaatctggggcctatcaaccattgacaggttttacttcacttcctggaagtaccatgacccctcctccaagtgggtctaatccttaagc

SEQ ID NO: 725451 - DNA, 1528 bp, Homo sapiens
tgtggaaaaagtcatggaggccagggggtgggcttgaaaccagtttgggggggttcgattccttccatttttggtctagaatttcatgtactagcgggtttctctcgaagtgtgtgcgtagggtggagaaaagggccatctgtgccgtaaagtgtaaccgtgctagctctccgaaggccctgcgggacctgtgggctgggtgttagacgcgttggtggaacaggggcgtggccggaggacgtggagccagtgcaatcggtgtttgcgctataaattgttcctcgtggcgtgtcttagaggcagagtgcttatcaagcgctgtgaaacccacatcacactgttgcgtatctaatatagaatgttgttctcctattgtggaacgttttttataaaaatgttaagtatatgtggatgttgggaaagaggttctcaaagaaaaccaagacacaggacaggagagcgggtgggagcggttccttcaaacagtatattcgtcgctaagggaggtggccgcaaagacatatctatagcggactatatacccccgcgttttatctcttgggtacacaaagggggacccctctctattcgtggaacgtccgtctttactaaacgacctttacggacctctggggcgccagctctattttctatcccgaagctcgctcgcgacgcatcggggatacacacgcgtgcacataccgtctggaccaacatctgtgtgacgaacggacgacccccctatccgacacccgtcgtgcaggcagcccatctacttgggcgaacacacactctccctgatcacgaacatctttacaaaacaggccgtccacaccggcgcacactatctcccccaccctctcccagacgcgctgacaaacacggggtgttcacaccaactacaacggcgaggccatctctccagtgcaagagctatgggacaacagctttcggcaacccaccgggccacatccggcacctcgtcaactaagccacagacatctcactcccccccccgggacctccgtggcgaaccaaaacaccacaacaacgcgacacacgtgacactcctatccacagcgacaccatagtagcgtaacccatacgcactccaccgaaacgacacacgggacaagcttccaatacaacgggatatagcatttaccacgtagcagctggaatataaagcattctctgtcctaacagagaacatgtgatagtaagtatcaaaagcagtaccgtcaaggagacacaagatcaagtgggggagtactcagcgcgacacaagaaaggcgtcaggaacaaatagacaggaggcaaggctaagcaacacagacagaacgcttcaacaatgcacgatgcaaggagcaaaagccaactcgaagacggacaggcacgaacgctatcagatgagtaccgaggcagcggcgcggaggctagaccgcagcaacggcatgacgacccagactagcaagcatcagagagagcaatgaagtgaaggactgggtgacacagggcgacacccgat

SEQ ID NO: 725452 - DNA, 431 bp, Homo sapiens
gccagccagcccccccccaaggaaacccttgccttccgaccccagggccggtgcccctcgggttacctgcccggcccagggggtggaatcccccccctattggtaccctccaaaacagggcccccccctccgacagggtcctcgctttacctttgacccctccggaggttcccctgccccccaaccggaattaggggttcaaaaggggggggggccctctggggtcccccccactatttaaggcgccaaaaactggcggttttttaaaactccgggccccccccccgcggtttcaaacaccccttttggggccccccggggtagtttcaccgggggcttggggaggggctgggggttggccgggatttaggaagggcccccccccccgtctttgccccgttcccataaacgtgccctcttgggggcgttta

SEQ ID NO: 725453 - DNA, 443 bp, Homo sapiens
ctaggctagtacgagctggggtaatcggccgagggcccatactgggagaggcttctgggtcaaaggaccagtctgctagcagggatcctgtggactggaagcgagtgaggctccacacgggcgttgcagactaccgcagccagtgatctgggcatccaggcacggccatgacccctccgtaggctcttctgggtgtggctgctggttgcaggatacccaaggcggtgaacgaatgggtgacaagtgctgagcctggacacgaatgtgggtgcgaccacactatactctagggcccgcagtgtggagaatcttctatcataggccattctggggcacgtgtgtgtgacatacctgtgtgaccttgactgatgccagcgtcatcttgccgggccctgggcttctagaacgccacccaggcctctggagctgagctgccttcgggc

SEQ ID NO: 725454 - DNA, 218 bp, Homo sapiens
ccccctcatacactgagccgcatacgtgaagttgcagtccgccgcgtctcagttacgcttgggcgtcatcgatgggcctcgcttgtcgtaacctttcgtgccccgaagaacacactaatgtcgctgagccccacgcaaagcacgagaggtagcagcagccgaggacccgggcccatggtgagcggtggcagcgtggctatcggcacggtgcgcagtcc

SEQ ID NO: 725455 - DNA, 512 bp, Homo sapiens
aggctaaatgacattcttatatgatgaaactcatgaactgctatttccttcttccaagtgtggactcccatccagaatttgccttctttttcttgctctccagtgccttttggtagatttttaaattctgttcagaatgtatagctgttatttgcaggaacactgatctgacaggagctatctggccattacaggaagcagaaccttcaaagttccttcttaatcttggctgcttagagtctgccctgcacatgtgtagttcaggtaaactgctttggacacgagcagcttaaccacacaactgaaggaattatcaggtgtgactaattataacaggacttggcatggagtctctgggataataacacatgagaacattatcccacagctgaaatccgtaactggagggctcataaaaaattgttgcataaaacacttaaattttgatttagtacaaatttagattccgtacaaataattcatcaaacttgagttgagcctggaatatatca

SEQ ID NO: 725456 - DNA, 332 bp, Homo sapiens
cgtcacggacatcggagcctgggtcagcgcccagcgaggcagccaggctattggcagaccctcctctagggctgtgcccaccctcgccccaggagcactcactccacctcccacgcctgctcctgggggcccttctctcgctctcatcctgcactgcaaccccccagcccaggccctttatctccccctctgtccaggccacagggatacacggatcggggctagagcccatgcacgcctaaaggagctgctcaaagcatctcctgcttcggccgttcgagtacatgactgcctctctcctcatcctggccctgaccctgcctgtctctctg

SEQ ID NO: 725457 - DNA, 329 bp, Homo sapiens
aataggaaagtggaaggaagggcagatttgatagaatggtgaaggcagccggccatgatggcacccacctgtgatcccagcactttgggaggccgaggcgggcagatcactcgaggtcaagagtttgataccggcctggccaacatagtgaaaccctgtctctactaaaaatccaaaagttagccaggcgtggtagtcgtcccctgttaataccagctactcaggaggttgaggcatgagaattgcttgaacctgggaggtggaggttgcagtgagccaaaattacgccactgcactccagcctgggctactgagtgagactctgtctc

SEQ ID NO: 725458 - DNA, 740 bp, Homo sapiens
ttgagctgcaggttgaatccggggtgccttgtaggattcagcacctatgtgtcggatgacagtggatgacctaaatatcaacgagactacaagactgccccttttgacagccgcttccccaaccacgtaaccagatctataatactgctggcagaacctacctggatcttaccagcctgctgatcacgaaggcaatgacccgctaaaggaggcgatatctctgtgtgtcgacatggtaccagcgatgtagtaccagtccctctgccccacatcctgggtcacagtactgggatgagcaatcggcgcttggaaggtcatcgttatcccggcgaacgagtctgaatctaggctgcatctccctttcctcttgtccatccatcgcttcttccacaggatggtgaagggggaccgtggttaacccaatgatccctagcccaggatccgtagatcatgacttacctgctcaataataatacgcgttcggaagataaacaagtgaaaacggaaacgtggaaaatcacagaccaaaactagtgactctgacgggagccactctatagtctaatataacgccaggcggtcccgaagtccattacgtgagcgcggagaaactcctggagcgaagaggctgcactcaagagggtatccaatggaccaagccaagtgtgtagacacatgtggacaaacgtgtcctacagagaggccaacaggttagagaacggcacatgagaatacggtct

SEQ ID NO: 725459 - DNA, 209 bp, Homo sapiens
tttacttttccgagggttcgaaaatattttaatttatccagaaatatacggttaattccctctatctacacttattaacggggctaaaataccttggaaaaaggtcttgggaaaggtgggggtcatagattccagggccccatggaaggtgtccacggtggcgcaaaaaaggtcttcggtaaaaaagggggggcgggggggtccggagc

SEQ ID NO: 725460 - DNA, 267 bp, Homo sapiens
atgagagacgtgttacttgggctttgctgttctgttgacacggtgtacatggccaagtgagtacagcgtgaacacggtgtgattaaaaaaaagacaaaattaaaaaaagagatggtggcctggtttagtaaaagttttaggtaaaattacaattgatggtataaggaatcattattaaaaattttctgcaaatcataaagctatatcgaggtgttgagcttagccactatgcacatggtaattagttcatggcaacacggtctctca

SEQ ID NO: 725461 - DNA, 149 bp, Homo sapiens
tagaggatctcctgtgctttgggacggcggctcccacatctccacttcgatgggaagacgtacaccttccacgggggactgctactatgtcctaggcaaggggtgaccacgacgattcctaacgctctctctagggcgagctggccccc

SEQ ID NO: 725462 - DNA, 158 bp, Homo sapiens
tcaggcagtggctcatgcctgtgatcccagcactttgctaggctgagatggggggattgctttaggctaggagttcaagaccagcctggtcaacatagcaagactccatctctattttatttaaaaacatttttttaaatctttataaaaaaagaatg

SEQ ID NO: 725463 - DNA, 123 bp, Homo sapiens
ccaaaggggagctggacttccaccagctggctaacagctttcgagagtaaggcctgcagccagcaagggaattaagcgttccctgctacttcctgtgctctggaggctgcagagcttgaaccc

SEQ ID NO: 725464 - DNA, 133 bp, Homo sapiens
  misc_feature (9)..(9): n is a, c, g, or t
  misc_feature (57)..(57): n is a, c, g, or t
gcatctccnattctccacgcgcctcgcagtagccggtcatcattcttgttccactcnattggtgtcactcttcctgaacttcgctttcaagctcttcatgtttagtgcattcagccttccaaagctctagagg

SEQ ID NO: 725465 - DNA, 234 bp, Homo sapiens
  misc_feature (54)..(54): n is a, c, g, or t
  misc_feature (202)..(202): n is a, c, g, or t
cacgctcccctcagactgcgctccagcctgggggcgcccggccgccgccgcctntcgctgccgccacgggcccgtcttcttcctccttcggctcccaggatgaagaaactgagtctcagagaggtgaagtgacttgcccaagatcacagcaattatcacttctccctgggctcccaggccctcctcgcagcagcccccgccntgggccatgtcttcctcagatgaagagacgct

SEQ ID NO: 725466 - DNA, 1141 bp, Homo sapiens
gcactgcaggcgccgggtagggacagcgtattcgctgctgctggatagtcgtgttttcggggatcgaggatactcaccagaaaccgaagaatgccgcaaaccaatcaatgtccgagttaccaccatggatgcagagcctggagtttgcaatccagccaaataccaagtggaaaacagctttctgatcaggtggtcacagactcatcggcctccgggaagtgtggtactttggcctccactatgtggataatcacacaggcattcctacctggctgaagctggcatacagcacaggtgtctgccgcaggcaggtcaggcaaggcagaatcccctccagttcaaggttccagggaccaagttctcaccctgcaagcatgtggctgaggcagctccatcccagggcacatccaaccccagcacaactctttcttccatccgacagtgcacaggcacaggcaatcccttcacgcgcatgcaggatctcactgcacccacctgcagcactgcgctgatggctcatttgcggcgtccttaacgcctcgtggccaggcgccacagtcggcgggcactcaagacacgacaaagcacagttgccaccacagtcctggggttcacctcccaggctactaggaggcagggctcgcatccgctgccagcaagcagctggccatggggaccccaagccgcaccaaacacattgtacccagggggcagccaaggtggggccacgtgcaccagggcactcccaggggtggctggccattggcgtgccaaccacccggttggcggcatgcgctccacaagtatcactggccttcatggttgggaaattcacgtgccaacaatgggctcccagagcaacccttggggacacaatggccattgcggacttcaagctacagtacccgcgcaagtaaacgccaccacacggacaacggggaacacgcccccccaggtgcccccggcagcctgcagatatggcccctgggcgcgcgcacagacactctacgcacgacaacacgccggcggcaagggcaaccgcgagacagactgggcgatcccctgccgccgaaacaccccggcacaccaccccaccacaggaaaccaacgaggacccccgcacccccccccagaacaagag

SEQ ID NO: 725467 - DNA, 321 bp, Homo sapiens
gaaaagttcccttgggcgctggggccaaaagctgttgatttttttaagttggcgggtggcaataaatcgaactgttccccagttagtcaagtatgtttccaccctagcctgatataaaaagggcccctgccgctgaatgaaaaagggatcaaaatcccctttggacataagttaaagtcctaattgggtttggcccgtcctccccttttgttttcggaagattaaatgctacatgggtaagtttgcctaaatagggagctttaacttatgtcaaaatgtttgcacccgtttgtcaataaagtttagtcctttttttatcca

SEQ ID NO: 725468 - DNA, 663 bp, Homo sapiens
  misc_feature (306)..(306): n is a, c, g, or t
  misc_feature (328)..(328): n is a, c, g, or t
  misc_feature (373)..(373): n is a, c, g, or t
  misc_feature (457)..(457): n is a, c, g, or t
  misc_feature (508)..(508): n is a, c, g, or t
  misc_feature (610)..(610): n is a, c, g, or t
  misc_feature (655)..(655): n is a, c, g, or t
agatattgcattgtagcaatgttgagcattttttaatgtaccctttggccatttgcatgtcttcttttgagaaatgtctgtttacatcttttgcccccccccccctttttttttttttgagttgtctctctctgtcactcaggctggagtgcagtggcgtgatctctgctcactgtaacctctgcctactgggttcaagtgattctcctgcttcagcctcctgagtagctgagactacaggtacatgccaccatgctcagctgatttttgtattttttttttttttttgagatggagactcactgngtcacccaggctggagtgcagnggcatgatcttggctcactgcaaccactgcctcccaggttcaagngattcttctgcctcagcctcctgaataactgggattagaggcatgcaccaccacacttggctaatttttgtattttgagtaaanatggggttttaccgtgttggccgggctggtctcaaactcctgacctcaagngatcctcctgccttggcctcccaaagtgctagtattacaggcgtgagctgcgcttggcccttttgcctgttttaaattggattatatatatatatttgctgncaagttgtttgaactctttacatattctgggtactaatcccttgncccttgtc

SEQ ID NO: 725469 - DNA, 503 bp, Homo sapiens
  misc_feature (48)..(48): n is a, c, g, or t
  misc_feature (59)..(59): n is a, c, g, or t
  misc_feature (65)..(65): n is a, c, g, or t
  misc_feature (68)..(68): n is a, c, g, or t
  misc_feature (74)..(74): n is a, c, g, or t
  misc_feature (90)..(90): n is a, c, g, or t
  misc_feature (148)..(148): n is a, c, g, or t
  misc_feature (288)..(288): n is a, c, g, or t
  misc_feature (291)..(291): n is a, c, g, or t
  misc_feature (309)..(309): n is a, c, g, or t
  misc_feature (315)..(315): n is a, c, g, or t
  misc_feature (341)..(341): n is a, c, g, or t
  misc_feature (358)..(358): n is a, c, g, or t
  misc_feature (370)..(370): n is a, c, g, or t
  misc_feature (375)..(375): n is a, c, g, or t
  misc_feature (386)..(387): n is a, c, g, or t
  misc_feature (457)..(457): n is a, c, g, or t
tcaggcgtcgggacagagccttatccaggcttcggcggccggtggcanctctcgatcanctctcncantcgganaggcggctaaggaaangtgccacagcagagacgcgaaggagaggccctagaaccttttcaaagaagaatggaanaaaccatgaagctttctacgatggaagacacattttattacttccttttccttataccatattattcaagggactcagataaacataaagagattcttcagaagtacattgagagaataatcactcggtttgcacctatnctngtcccctacatctggcanaatcancctttcaatcttaaatataaaccttngaaaggaggtgttcctnctcatatgtttngcgtnacaaaattttnngataacatttatgattaattgtttattgtttatgtaataaagcagatcacaaaggaatttccagagttantagcaaggatttaagacaattattgttaattctttttaatataatc

SEQ ID NO: 725470 - DNA, 449 bp, Homo sapiens
tggctcatatgtgtgccatgctatgtctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttttttttctcaggtttgtcaaagatcagatagttgtagatatgcagcgttatttctggggctctgttctgttccattgatctatatctctgttttggtaccggtaccatgctgtcttggtcactgtagccctgtagtatagcttgaagtcaggtagtgtgatgcctccagctttgttcttttggcttaggattgccttggcgatgtgggcacacattatggagggggatcctcta

SEQ ID NO: 725471 - DNA, 174 bp, Homo sapiens
gacgatcaacgccgcgctctcggacttagcgccatttttattggaaacctctgcgccatgagagccaggtggaggaagaagcgaatgctcaggctgaagcgcaaaagaagaaagatgaggcagaggtccaagtaaaccgttagcttgttgcgccgtgggggcgttggatgcagt

SEQ ID NO: 725472 - DNA, 1358 bp, Homo sapiens
cgccggcggctttctagccgctgtcccactggtgttggtctcgcgctttcgtgctgcgagctctctgtgggtgctggcagctgacatgtggtgcgcctcccgtggactccatgggcctgagctctatccccgtacactgggacctagcctctggaggtggtgactcctaagtccaccagcccagatgggcctcagactacctcctccactttgctggttcctgttgcctaacctcgacagtgtcagtgtccccatggcccatgtgcactgatgctgggggtccaagtgtcccatggatggaatgtgatgccttccaatggatgtcttccctgtgtctcccctgaacaccctatgggattgccagtatctatgaggtgcactctgtgccatgtgcttggcccttgcaagcgtggcaatgggcatgatccatatttccagtgcatcccgtgatcagccaggacactcatgctgggatagaacaaggtgctcctgtggcacatgttccccttggagcgtattcttctcaatctcccatttgttggaacccatgctcctcaacgttgagaacaacacgatacgtccaccaggccgcctgattgggccagactcccatggacacagctggcctcatggtgaaccatgtgcttggcccagtgacagcaagccctcatgattccaggctcgccgggaaactgtatctcaatagcaagcgtctattgacgaagggaagcatcagttccgtcagatttactccctcctgtaggggaagaggtcagcgggtgaataagtaggtgcatctccttgtcgattgtccaattatatgatacgtcactcgcaggttgccgatatgtggcatgatgtaagctcactgatcgctgagtcacttccagagtcgctccaggattagtgatgcaacacaatgtgggcatgcgaggtgaattacaggtatgctaagtagtgcgtctgtccttttttcccgtgtttatgagggggggcaggtgtcatctagggtatagcgttatcggaattttggcccggccgcgctattcgtttgtcctaggctgctctacagagttatgtcgcagtagtgcgttaatgacaacacttatccctttggtggtatctacataggacatgtactatctattagcacactagacggtgtgtgcgtacacgcagcccagcgggtaccagaactgcattgcttatttattatccatccaccatgagacttaaattgcgctttgtcgactcggccaaggcgtgggctttcgtgggtacgcacgtgatgtcgggccgtgcttagaggaacttcgtgctcgagacaatgtgatgttcagctcggtgcacggcgtatg

SEQ ID NO: 725473 - DNA, 392 bp, Homo sapiens
  misc_feature (240)..(240): n is a, c, g, or t
tgagaagcttcatgatctgctgtctgctagcttgcgatacaggaaagccagtggtgtagttcagtctgagtcttgaggcctaagaagtgggggagacgatcttgtaagtctcagaccaagggcagcagaaaacagatgattcaactcaagtggccaggcagaaggagtgagttcttcctttttccacctttagtttttttcatgtcctcaacagactgggtgatatcagtcctcattggngaggacagtctgtagatccaaacacccatttcatctgtaaacaccttgacagacacactcacaaataatctttggccaaatatctgagcttctgtgatccagccaagttgacacataaaattaaccatcacatgtccaccccttgccaactt

SEQ ID NO: 725474 - DNA, 277 bp, Homo sapiens
aaacttggtgggggtcccacgggggacaggtccttccaacggttcctttgcacccaacgctgcacgggcacggggggtgggtaatcagcctcccgaaaaccacgcgagttacggtcctgcctgcgaaaaactcccagggcgaccttggggctgaagagtgggcctgcttcggccttttgcttttttgttgtgtggtgaccctcaccaaaggacagcttcatgcttttggacttcccagcctcaaaaactgtaaaaaataaatttttttataagttga

SEQ ID NO: 725475 - DNA, 1141 bp, Homo sapiens
gaaataggtttctgtacagagaagctagaagaagactaccagaggggagtgtggggctaaggaacagtctaaaatttgaagggagttgatcctgttcactgaaaagatgaatgtgtaactgaagtaataattatcaagagatcccaaaggtgtagaatgtcaaaactgttctttaatagaactcatttctttggtagtagaggaaaagataactagagttatgtcagaatgaatagaagaacctagatgaccggttgtctagggccttcagtatcttctaacaacaattacttcctgagactgtccattatcatgaatgaaacaggtatgcttggctaaattgaaaatcttggctgaagttcatagagctctaggattaaaacttgaggtcccaaacttcaggttccttttcccttctttctacatcaggcagtttgagaaacacttggacaggagaggagtccgggaaacaactctgacatagctctggagccttggagcttacgtctgaggaattctctgtgatcaaaacttcaaactctacaatcctgagtagatcattgcactttagacgaagacagctgtgtgactatcctatttctaacagcataagaaactatcaccgcgcatgccagctactttcaagtttgaccaaagtacctatgacagaaaggatacaaaaggacacgagaccatcaaaatcaaaaatacatactggcgaagcgcaacaacaagcaacccaaaaactacgagaaacgcaaggaaacaaaaccaaaagagcagacaaacccaaaccacaccaacacagaccagaagacacaaaaggagtagtgatgcggacactgggaggtcaagtaacgacgcaagggagccaagcgaaaaaacgtcggtcagccagaacacatgaggaaagacatagggaaaggcgcgagcgggacaagcgacagcaccgacacacagacagtataccacgagcgaaggaacagaaacagcaaggagtcacggcaaggagcgaatagagaaaacaaaaaaaaaagaacagagacagccagcactcagacggccaccacacgaatcgcgaagacatgataggagtaaaagtactatcagggcgacactctcagcgtcgagtgtcaggacc

SEQ ID NO: 725476 - DNA, 105 bp, Homo sapiens
acagcatatttatgaacctatcattggctataagggataaatctatccaagagacataagccccaactacttcaaggcactgacacgtcacttcagaattagtaa

SEQ ID NO: 725477 - DNA, 452 bp, Homo sapiens
ggaagtactaagttcagctcctaaggcctacatcaggggagaaaaatcggtggactttacaaataataactgcctcagcaaaataaatccttttttccatggccatagctcactcagactggccccattccattgggcataactctagtctcccagtcccaagaggggacaaatgatacgtggtactagttttgtggagggacagctgaattaattatgagggaaagggccaaaaattgttgccaagtcctgccccagagtagagtagggagtctcacttcctagcccttcatacgttggtacttcccacttccttcttttaattatgaaattctagcaggtgtggtggtgcgcctgtaatctcagctatatgggaggctaaagcagaaggatcacttgagctcaggagttcaagactagcctaggcaacatagtgagacctcatctcaaaa

SEQ ID NO: 725478 - DNA, 964 bp, Homo sapiens
ttgtaacttagtatgtcgatcgcgctgggagcagcatgcctcggtgtagcaaggaataacatcaagatcgttattgtccgtacatttgcgatactgggtctgttctatgatgtctgtagccaactagttcagcaatccagtgcttccacgtgttgctgactgcgcacagaacacacgacgtgaagctccgtgcctgcatggtatctaaatggtggtagtctagtgaattttgctagacgtagctagtggcgtatatgactgaatgctgtctagccatcagagagcatttgacccggtgtattatcacacaatgataaaaaacacgttctcctgaggaggttgcggccatgtgtgttagtgtctcgaaggtcgctatgctcctgattcctcgtatgctcatgctggtgagcctactccattgtcctcatctgaacacctgtcagacaaaacgtgatatggggtactggtacgttgctttagtataatgagtcgatgcattaagtagctgtcatagttatactgtcaagataatgtatgactgtccttatctctgggaagcttctcaccacctcttgcggaagccacaggtctggcaggagaggcccatgtgtctgcacgagcactgtagctcgcgcagatctcgtgcatttgtggtaacctgaattgttgaccaggaatagacatgcataaggctcagggcgtggtacccaggcaacatttttggcgggggatgaaccttgacagacctggggaacccctggtggaagggagcgccgtgctgcggggaatgtgcagctgatggctcaacgccacgcccgggccttgtaaccctccccggttgctgttaacaccgcagggtctacggctttgaacacgcctgttactttccccgggagtttggccgcggtatagaatgtaataacgggcgaaaatcaaacgcccagtctgtaacacaccaactact

SEQ ID NO: 725479 - DNA, 371 bp, Homo sapiens
  misc_feature (15)..(15): n is a, c, g, or t
  misc_feature (50)..(50): n is a, c, g, or t
  misc_feature (158)..(158): n is a, c, g, or t
  misc_feature (198)..(198): n is a, c, g, or t
  misc_feature (212)..(212): n is a, c, g, or t
  misc_feature (256)..(256): n is a, c, g, or t
aaaaatcagctaagnctgaagtgcttcgtgccacataactcaacaggacntgagtttgattgtgatgaaaggagttaaagtttccttgattcttgtcaaattagaactcatgggtttattgtctatttatttgtaggcttttgttttgttttggtgcntgagaattaagcacaggtccttgcacattgcaaaatatcntgccatgacccacnttacccctagtctaccttcctaaagttttaaccatcagaacaancgtggtgagttagaggacaaacataaatgggaatctgcacccttcaatgctgctctgacaaggctgataaaataggaatgacatcttctcaaaagctcacatctcacaatggtat

SEQ ID NO: 725480 - DNA, 157 bp, Homo sapiens
agggagaggactcattgggggtgaggtggtgttgaggccagaggtggtggtggttgagctccaagtggtgcggggggcgggggaaaggtgttcttaagtgtggcaggagcctgatatcttgtgtgtcgaggcagacattacatgtgtcactttcttg

SEQ ID NO: 725481 - DNA, 640 bp, Homo sapiens
ggacgatgctgtacttctcttcgtagtgggcggctcggcctctgcagagatgtgggcagctggtcaggatggccattcgtggctcagcacagcatacgcagcccagactcagactggggaagcataacaggggctggacatggccaggagagcctgtctggtacagttgatctctgagtagtgtgggacgttgctgtcagatgggagaaggagcaggcagtgttcgtggcctggagactcattgccatcatgagatacttacatgcgagtccagagcatgcagctggagtgcccttgtgggtcctgttcgtgagacaacaaagttactcgtgaagggttatccatggcaacgagatacgtatggtgggatgcagagtgtggtgagatgaatacttggagctcgactgttgtcacagtcgtcgcggcgaccattaggaagtccttttgtaccctgtgtgatcctgtcaacaagtggtggaagttcaactgtaccgagacacgttactctcgggatcacctcaagtacgaaacacattggttgccgtgctacagaccgagtacactatctgtcaaacactaccacgtagcagggcatctaatggaggcatggcaaccttagctctcagcatagagggcggcc

SEQ ID NO: 725482 - DNA, 182 bp, Homo sapiens
ctccagctggttataaagactgcgattatgacagagttgcttgtggtgcttgcagctgtcatccagcattttgggaggctgaggcgggaaaattgcttgaggccaggagtttgaggacaccctgggcaatatagcaagaccccatctctacaaaaaaataaaaataaagaaattagccaggc

SEQ ID NO: 725483 - DNA, 556 bp, Homo sapiens
ctggggttcccgggaggcggaagggagatcagccccagctcagccggcggcccttagagacgcgggtccctccgtttggcatcttgcctgctgtccctcacaggctgtggcatcaacaaccttgtcgtcacatcgccgcgcattcgcaggctctgctggtccgtggctagtttcttaaacacccataccgcttaccgctgctgactctttctgttcttcccatactttgatggctggaataggataattactcaatgttttcttcagaagtaaattgtagagtaaataaagaggcggtagctctgtttgagatttcaaggagtcaaagaatttgactattgagatttgtagtgtgccaggtactttcataggtggcgatttaattcatttatttcattgataaaatgttttagtattttagaaattggacgatatgcagatacacgacatacattccagtgaaattagcctcggtcaaataaattcagggttttgaaaaattaattattttaattgattgtgccctatagcattgggagatttacaaacagtgaaa

SEQ ID NO: 725484 - DNA, 266 bp, Homo sapiens
gcacatggttgcatcaacaacataattgactgcacatttaatagagtcaacatataagtcatggagtgtttcaaagaatagtggcaatagaccaggcttgtagtttcacagctgaaaggacagtattgtccatatctcgttggtcagttctggaagtcctttccaaggggatcttacagaaagaaaaggcattttatgaaatataacctaacacataatcttgtaggatgaacaaaagaggcaatacacctggtgattccatgtgc

SEQ ID NO: 725485 - DNA, 281 bp, Homo sapiens
gccccctgttccctgacaagtttcaacaattgtaaatattttttccctaaaaagaaaaacttgggtgggggttgggtgggagggacttgggtctttggggctaggaaagggcctgtgccccccccacccgtggtttttttattttccccaagcccggggccccccttcccccccgcctgtgaaaattggaggttagggcctgaagctcaaagctccccctttttaatagtttttccctttttggataaaggttgaaataaagtgggggggggtttttccca

SEQ ID NO: 725486 - DNA, 425 bp, Homo sapiens
  misc_feature (1)..(1): n is a, c, g, or t
  misc_feature (103)..(103): n is a, c, g, or t
ntaggttacaagagcgaaatagtcaccactactgagtaatctcagtgtctcattcaagttcgcattgcacattgccaccgcgatctaaatgggtgtacagtcntgagtgctgatatattactcaaaggtttgaatttgcagactgtaacaaggcatgctagatctgtgtactctgacaatatccatccacaagaaagtagccaagcgtcagtttccaatggggaggatcattctcatgaaggtactgtaaggctaagtctgtacacttcatttcttgttcattgacagatccagtggtgccaccattgtcatgttcaggttcagagagctcattcagtggtattgcgacatcctcataagccagcctgtcttctcgtcaagcccctcagctttgatcgtgtcaaatcggcatgcggtcgcctggt

SEQ ID NO: 725487 - DNA, 543 bp, Homo sapiens
  misc_feature (82)..(82): n is a, c, g, or t
catactgtcgacagctgtatgcacgagagtagtatctacttcgtgtctacaactgtactatgaggtgtagtatgatgtaganatattcctcactatgtagagagaaggagatgcttcgtgtcacgagtgtgtggcgctatagacacgtcctacctctagaaagagacatcttgtgtagaggcgcgtcttccacagagagtctctgttgtgtatataaagaagagcgctctcacgcatcacacgcatgtctatatctcctctagagcgctcaaaatagtgtcacactctcgtctctacaagatgtgtttagacacatgttcgctatagctctgacaccttagaggtcacattctgtgcacttgcacctgtgtcctctctcacacacacgctctctgtatagtgttacgctcaaaagtgtagctctttctcgtgcttcacagcccagcgttgcaccagactcgtgtgacatctctacacatcttctccttcgtgccagttacttcgtacaagcgccgggagtgacacctactatgcttactagca

SEQ ID NO: 725488 - DNA, 959 bp, Homo sapiens
ccgcccttttttttattttttataaggtttacaattaatttaattgtcatggcaaaaatatattcccacaatctggggattctctcccagtccaaacagttcttggcagaacgatgcccatctggcctgggccaaatcggcagaaatgggaatcatctggactcaacccatcctaacagaatgggccccgggaagataggcataaatgtttaaaactgggcgcattaaaacctggcgctgtgtggaccttggtgacaacctcgggccacggtccatactgggatgggatggcggtgggcccctgggcaccccggcagagagatggcggaatgggcgtacagcgcgcggagaaaatatccccgcgcggcgcacacggctccagagtgctcccacacagaacacttctcgcccgagggcgggctcgcggtaccttgggcgatatctcgcacacggtggccgtggcgacagtgggcacccccgtgcagcgtgacgcccggggacactacgcagaaagaggaaagtgcccacaagacgggaggggacaaacacatctacaccatatacgggggtcacagtgtcaccgcgaaaacactacgcggcgggcatactacaaaatcgccgacacaactcaacaagcaacgcggcgcgctcttcacaaagccaaatcattgcgccgccgcgcagcggaaaaagcaattccccgacaagccccccccaagacgcggaaagacaatttccaacaagaagggcgtccagcataaaatacaccctctgtaaacgcgtggtgtccacccgcggagcaaagaggcagagcaaacaagatgtcgcgggatcgagcacaccaacagtctcctgggccgccccgctgggtacccgcgcacacacaagagaaccatgcggggcaccccccccgcgcgggggagacacagacggtgacccaaccacacaaaataacgaac

SEQ ID NO: 725489 - DNA, 429 bp, Homo sapiens
  misc_feature (415)..(415): n is a, c, g, or t
ctgaagatggaggttcaagcgatcctcctgcctcagcctaccaagtagctggcattacagatgcacaccaccatgcccggctaatttttgcatttttaatggagacaaagtttcaccatgtttgccagggtcgtctcgaactcctgaactcaagtaatctgcccatcatggcctcccaaagtgctgggatcacagacgtgagcccttcgcacctgagattgttcttattactctcatattacaaatgagggaaacaactagtgaaattagtgaaattgttctctttttcttttctttttttttttggggagacagagtctcggctttattcatccggggctgggaatgtggcattgggcccgattttcaggttcattggcaacctccattttttggggtttcaagtggatccttntggccaagtttttt

SEQ ID NO: 725490 - DNA, 276 bp, Homo sapiens
aggcccccggggaggggcagggcctggagcttccccctaaaaacatttttttatactgtgggcttttgggggggccttgggttccaggccctgggacccctttccagggaaacccccgaacctttgtgccaggacccctcctggtcccctgcccctttcctgtttggtttaaaccccccaactggagggggcatggaaaaccgtaaagcccaggaacgggtgggttattttaaagacaaaaacccattaaagtccctttcagacctccggcttcca

SEQ ID NO: 725491 - DNA, 855 bp, Homo sapiens
aaacctggcgttctgtctaacttggatgtctcctactgagcccgatccaggtgaggacgctctccatgtggtcgggttgagctgttgaaagctacgctgattgacgagccatgaggatgccatatttgacgcgcattggcgtacacagcgtcaccgcgagcttcgggaggtcggggtaatgttgatgaggaatccaatgtacccaggcagacttcagggggctctataagcgaggtatgaggtcacacctaatgctcaatctgagtgtgccgagacgtaggtgcgggctttccaagttctaaacttcatacgtggccatggggcacactatgcagacgcgtatgcctagtggggaaacgtacgtgtatggtgcgtacaccacaaatgcgcacggaacaaccattgttcatcgacctggagtagagggaaatttctactaacgagcatcccgaggggcactgggcgcccttgcctttcaggagggcgtagtattgcaaagaggacgatgtcattacattttgggtataagcgggggcagtgacaatttgtttaaaaaggggtaagaatcgaaacaaaccctaggataatacgacacaattgagatttccgaacccccgtttaatcgtggggacggaaactttgtgaagttatataagggggaggcgagccaatccaaatcaaatagggagggcaccgagtgcacaacaagtgtgttggcgacaaatgtgtttgggcacctgctagatatccagatggtttgtacactgtggaactcgttcgatagcagctcccgcaggggccccatacgatggggccccatttgagcctcgaattcgcagcccgtggcgattttcg

SEQ ID NO: 725492 - DNA, 2337 bp, Homo sapiens
  misc_feature (1868)..(1868): n is a, c, g, or t
  misc_feature (1981)..(1981): n is a, c, g, or t
  misc_feature (2044)..(2044): n is a, c, g, or t
  misc_feature (2221)..(2221): n is a, c, g, or t
acatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaagacaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatctncatatctatcagagtatccactgtttattcaacaactactacttgatggtcagacacaaacaaacaagctaggtgctaattaataaagatacgagttttggccgggtgcggtngcacgcctgtaatcccagcactttgggaggccgaggcgggcgaatcacgaggtcaggagttcnagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccngagtgacagagtaagactctgtctcaaaaataaataaataaataaataaataaataaataaataaataaaaaataataatacaagttttcataagcacacttctaaaaaaaaaaaa

SEQ ID NO: 725493 - DNA, 129 bp, Homo sapiens
  misc_feature (24)..(24): n is a, c, g, or t
  misc_feature (36)..(36): n is a, c, g, or t
  misc_feature (115)..(115): n is a, c, g, or t
ctttatgtttgcttgggccttccnccactcttgttncctatgttgataatctaggatttgttgtctcacaatttttccctgatgtttatatgatattcaatgaaataaaatacantgtgacactaaaaa

SEQ ID NO: 725494 - DNA, 2097 bp, Homo sapiens
  misc_feature (1628)..(1628): n is a, c, g, or t
  misc_feature (1741)..(1741): n is a, c, g, or t
  misc_feature (1804)..(1804): n is a, c, g, or t
  misc_feature (1981)..(1981): n is a, c, g, or t
atgtatgaatgtaaggatgagggaagcgaagccagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatctncatatctatcagagtatccactgtttattcaacaactactacttgatggtcagacacaaacaaacaagctaggtgctaattaataaagatacgagttttggccgggtgcggtngcacgcctgtaatcccagcactttgggaggccgaggcgggcgaatcacgaggtcaggagttcnagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccngagtgacagagtaagactctgtctcaaaaataaataaataaataaataaataaataaataaataaataaaaaataataatacaagttttcataagcacacttctaaaaaaaaaaaa

SEQ ID NO: 725495 - DNA, 927 bp, Homo sapiens
ggtcctttgagagtttcccagttctgcaagctgtaaacggacaggtctggacggagtcgtcactctgacagatctccatattgcctggcaggtcctggtccttagtcccttcatgcatgatccagcccatgtgcatctatctcttaacgtcgtttacactgggccaccaggagccagtactcttggatagcagcagcattctaggtgactgaattttggctgagggatacggtctttcagaatggtcatcttatctgtggtgagaccattagcccagtggcgtaaagctggctacccaggacatgcccgtgtatgaggacttgcaagcactcttctgcaggcaccactggatgatgctcaagaaagtgtctgccaagcacgcttcctcgatgccactgttactatcgcactacggagcatggaggcagtcaggctcgattccttattgtccaatagtgaacccatcgtcagagcacacaataaccatgtatgcttaggggacatggaaaactaggagcacccatcctaactgatgatgttagcctgcaggtgttcatggaccatttgaagaagactggtctgtctccagtgcctgttaagctgaggatacaaccaggaaatgcaacggctgtcagattgtgttcaaaatgtctagaaaggcttgataacattcctgttacttttctagcagattttaacagaataactcaaggacatttgtatatgtaactctgggagattagaatgtgattgtgtattcctgtctttgtcctttttcgttgcactatgaaattatagaggtactaaatgttttggtatcttgtagataggtgttactgtgactttttgtatcgtaacttttagaatctaaataaaatcagaggtaatgtagttttggcagcttgtgttaggtgagaatcttaatga

SEQ ID NO: 725496 - DNA, 2475 bp, Homo sapiens
  misc_feature (2006)..(2006): n is a, c, g, or t
  misc_feature (2119)..(2119): n is a, c, g, or t
  misc_feature (2182)..(2182): n is a, c, g, or t
  misc_feature (2359)..(2359): n is a, c, g, or t
acatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaagacaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtgacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatctncatatctatcagagtatccactgtttattcaacaactactacttgatggtcagacacaaacaaacaagctaggtgctaattaataaagatacgagttttggccgggtgcggtngcacgcctgtaatcccagcactttgggaggccgaggcgggcgaatcacgaggtcaggagttcnagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccngagtgacagagtaagactctgtctcaaaaataaataaataaataaataaataaataaataaataaataaaaaataataatacaagttttcataagcacacttctaaaaaaaaaaaa

SEQ ID NO: 725497 - DNA, 120 bp, Homo sapiens
ggttttttcccaggggggatttttttggcccccccgggggcccggaaacaaaatttcccccccccggttaaaatttctgtcccccctagggggggggggggggggaatttttttttttta

SEQ ID NO: 725498 - DNA, 109 bp, Homo sapiens
ttaggaatgccccaccaataaggataatgtgaatatttcagaatccaagaaaattggccactcgtctggtcccgagcatttcagataagagatattctcctcatcctaa

SEQ ID NO: 725499 - DNA, 368 bp, Homo sapiens
aggtgagtggggctggcagatggcgcagcagcaggaagtgggaggaaatgcatctgctgagatagggaggacaccggggccaacgaaacggaagctctcggttaggtcagctgtcctcctgcgtgaacatatgtttgtccagagacaaccacttggctaggaaactatctcccacgatgccagaaagtgctgcggacgcttgtctaacgtaatgggaaaaccgaatgatcagctcacttgtgtcgttagctgggagttttggcacagttgggcaaaaatggaggattgtggtcccaagccatggagtttcagaccatgcaagctcaggccctcctttgcctccctcgatggctcggctcttccctccg

SEQ ID NO: 725500 - DNA, 2225 bp, Homo sapiens
  misc_feature (1756)..(1756): n is a, c, g, or t
  misc_feature (1869)..(1869): n is a, c, g, or t
  misc_feature (1932)..(1932): n is a, c, g, or t
  misc_feature (2109)..(2109): n is a, c, g, or t
acatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaagacaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtgacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatctncatatctatcagagtatccactgtttattcaacaactactacttgatggtcagacacaaacaaacaagctaggtgctaattaataaagatacgagttttggccgggtgcggtngcacgcctgtaatcccagcactttgggaggccgaggcgggcgaatcacgaggtcaggagttcnagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccngagtgacagagtaagactctgtctcaaaaataaataaataaataaataaataaataaataaataaataaaaaataataatacaagttttcataagcacacttctaaaaaaaaaaaa

SEQ ID NO: 725501 - DNA, 316 bp, Homo sapiens
gacggcgttccactccagcggtgacagagcaagaacctgtcttagaaaaaccaaatagagtcaccagctgcgttagatcctaacaagagagtcaacctgccctttgaagctttaaagccaggcattgacttctctctagctatgagaatcctagatagcatcttcttccaactacactgaaaatctgtggtttagtgtagccaccaccttcatcagtgatcttagctaatctgaataacttgcagcagtttctacatcagcacatgctgcttcaccttgtgccattatgttatggagatggcttctttccctaaac

SEQ ID NO: 725502 - DNA, 2220 bp, Homo sapiens
  misc_feature (1751)..(1751): n is a, c, g, or t
  misc_feature (1864)..(1864): n is a, c, g, or t
  misc_feature (1927)..(1927): n is a, c, g, or t
  misc_feature (2104)..(2104): n is a, c, g, or t
acatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaagacaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatctncatatctatcagagtatccactgtttattcaacaactactacttgatggtcagacacaaacaaacaagctaggtgctaattaataaagatacgagttttggccgggtgcggtngcacgcctgtaatcccagcactttgggaggccgaggcgggcgaatcacgaggtcaggagttcnagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccngagtgacagagtaagactctgtctcaaaaataaataaataaataaataaataaataaataaataaataaaaaataataatacaagttttcataagcacacttctaaaaaaaaaaaa

SEQ ID NO: 725503 - DNA, 226 bp, Homo sapiens
tcaggattgtctgcgacactcaagctcgaagtcacgctgcagatcacgccggacggaacatcatcctcgacgtagacgtcaacaaggacagccggggcgagaccacgcatgcgggatcgcgatcaacaccaagcacgtgaagacccaggtactggttcgagaacggcggcacggtggtgatcggcggcatcttcgagccagggtcgaccggaatgaggttgtcgca

SEQ ID NO: 725504 - DNA, 143 bp, Homo sapiens
cgattacactggcgctttttcttcagcttctcacatcaaaatcatcatcatcatcatcttcatcatcatcctcttcatcatcatcgtcatcatcttcatcagcagcaagttttacttttttctgtggaaccttgctaccacct

SEQ ID NO: 725505 - DNA, 2087 bp, Homo sapiens
  misc_feature (1618)..(1618): n is a, c, g, or t
  misc_feature (1731)..(1731): n is a, c, g, or t
  misc_feature (1794)..(1794): n is a, c, g, or t
  misc_feature (1971)..(1971): n is a, c, g, or t
acatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaagacaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatctncatatctatcagagtatccactgtttattcaacaactactacttgatggtcagacacaaacaaacaagctaggtgctaattaataaagatacgagttttggccgggtgcggtngcacgcctgtaatcccagcactttgggaggccgaggcgggcgaatcacgaggtcaggagttcnagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccngagtgacagagtaagactctgtctcaaaaataaataaataaataaataaataaataaataaataaataaaaaataataatacaagttttcataagcacacttctaaaaaaaaaaaa

SEQ ID NO: 725506 - DNA, 518 bp, Homo sapiens
agttcccatgtcctccagctgcacagcctgattactcctcagtgtgcagacagacccctcaggaatctacatggccaccagttgtcctgacaagaatctctccatttttgacttctcctcaggcgagtgcgtggccaccaggttgggccacgggggtgagtgtagcctgaatcccgagtagaagctgatacctgcgtaaacctgagtgagtccagccagggaacttcactcttctataagtttctggggcacggaagagctacctatccctagcttgcagccaagccccgtgtccagggtggggatggagaggactgggtgggaaatggagggtggctaatagaccgtattcttggtccttcacagagattgtcgtgggcatgaaatttagtaatgatggtaaacatctcatctctgtgtcgggggacaggtgagcagaagccagtttccctgagaggcagattcttactcgtgcacagcagcctgccctcccctctctccattgcagtgatgctctg

SEQ ID NO: 725507 - DNA, 201 bp, Homo sapiens
ggcgtgcggtgatctagaggatccctgctcacgatagactgttgcgttcttagctttccacacacgtcccgcgacattcttactcggaccaaccgagttatgccagccgcatgggggtttaaccttatcgagttcaacagcctgtggtaacccgaaaagctgctcgagcattggggcttttgaaccggcggtccggcgtgg

SEQ ID NO: 725508 - DNA, 132 bp, Homo sapiens
cagtttaatttggccctgataatgttgcagtctttattaccccttttgctttaatccacttttctaaccaccttcgtcgctttagtttttaacactacacaccaaggctttgaaatcagtgatcccgttatt

SEQ ID NO: 725509 - DNA, 752 bp, Homo sapiens
ggcacgtcgagcgggggagcggtgctgcctgtggagatccgcggagggcgagaggattcgtttggctgccgtccccgcatgctgtgcaatggggttaagaatacgataatccaactatcagccatgaagagatccaagtctgcagcagtactatgccaaggatcatcgatgaagatgtgattagtgaacggtcattctcatgaagatgacaatccatttgcagagtacatgtggatggtacaatgaggaatgaattcaagagacaaatagaacgaggacgttactgggaacgaacgaagtttattgaacgctgtttccaagaaagtgctggaagaggaagaagagcatgaagtggttgattccagctcgagatctcccacagaaatatggaccaaatccaagaccagtttaattgacctgtgtttatcaggtgatggctcttctctggaagatcttgtggtcaagagcaatctgaatccaaatgcaaaggagtttgtgcctggggtgaacgtacggaaatatttgaggtagacggggcccgtctattagggtgggatgtagcgacaatttcgcacactgtgaagggcaggtattagaagacttaagttgtaaaaatgctctcttggtcacctgtggttacacttatgcattgccaaagtgtgagtagtcttgcatgcttaataaaagtggtgagactgttactaaggtagaaaagctgtgcaaacatttactggaaaattgaatgggcccat

SEQ ID NO: 725510 - DNA, 171 bp, Homo sapiens
agtgcgtgtgcttgcgtattagaacatagccgcctaggttcaacgagatacagcagcaagtactattgacccagcgatagaggcttcgacatggactttagaggagtcataagtggagtccgtccagaggtatctttactataaaagctattgtgtccgctcgtcataacg

SEQ ID NO: 725511 - DNA, 895 bp, Homo sapiens
gcagcgcatatgtataaatcttaatcggctggtttatggaagacgaattagcgtgtttggtaaatcagatgattaataacccgctttatcaatcacaaaggtttgccacagttacctgggtgaggttgtggcaagaatgagtttgcagaaagcggagcgttgatggcgtcaggctgtgatcgagatctgaatttcagtcaaatacgcagggttaccctggcacgttagcttaactgctttcacgttctcttttccccagctttggcaaaggcggcgtcaaagtcacggcggctcactgttttaccgtaattatccgcaaggaattttccggcttcgctctctttaattttcttgattcaggcgtaccatcgtaccgcacagtatgcgtccggatcaagaccaaagcaggcaccgagtaatggcatattcgtagcgttccaggcaggaacgtccgccagctcctggcatgacttcacttagtttagcggccgtttccagtgataatccggtttccggcgatgaacacattcggctggcgcgcgcttctggtagattcgggattgggcgagtagcgcaaccgaaggcgcatcctagcggcgttcatccaacacccatggggcagcaagcgattgtaggcaatcctggccacagacccatgtacggtcagcaaaatcagcttcgtggccggttcccggtttgcaggcgacatcattctcgtgcgtacgaatatcgatccgtgtgactctggcaaaatcggtttgccatgatacggcccggacttacgatcaaatcgcatactgttggctgaacgctatgcgtgcaaaaaaaggagcaaaaaccgtagcacggggtgcccgatgctcaagggtggaacacatacgaattttattaaaac

SEQ ID NO: 725512 - DNA, 133 bp, Homo sapiens
taatgcacgatccgcgacccagccgggcctcaccgtatgggctccaggtccatctcgtcctcgtcctcgtcctcgcccagctggatctcctcggggttgacctgctgcgccagctctgccagctcctcccggg

SEQ ID NO: 725513 - DNA, 396 bp, Homo sapiens
  misc_feature (100)..(100): n is a, c, g, or t
  misc_feature (139)..(139): n is a, c, g, or t
  misc_feature (315)..(315): n is a, c, g, or t
  misc_feature (372)..(372): n is a, c, g, or t
gggatttcatcaacaccaaatttttcttacaagaaatgctataaggagttctttaatctcaaggaaaagaatgttaatgagcaaaaaaatcatctaaagntataaaactcactggtagcagtaagcacatgaaaaacanaatattattatactgtaattgctatatataaactattcatatcttgagtagaaagactaaaagatgaacatatcaaaaaattacaacaacttttcaagacataggcaatgtaataagatataaataaaaaccacaaaaagttaaaaagccagggataaagtgagagttttattagntttttctttgtttgtgtggtaatttgtttgcttatgcaataagtgttaaaataagtntaatgggttataaaatattatttg

SEQ ID NO: 725514 - DNA, 160 bp, Homo sapiens
tttcgctgctctatccgatacaaccggtccggaaaatgttgacgagagcgtatcctactcatcacatctacttggggccgagagtttgatagtgcttctcacggtgatgacgaacgtaggtgtcactctacagatgatgaactcagatggaagtaccatc

SEQ ID NO: 725515 - DNA, 150 bp, Homo sapiens
gactgcatcatcaggtgcatctgtcgtacacccattgggtcaaaatgagttctggcttactcgaaagcctgcttgagataaatagcacaaaaactatttttaactttggcatattcattcctttaatgctgtgtctggtctaaatgcaat

SEQ ID NO: 725516 - DNA, 105 bp, Homo sapiens
gttggaaacctctgcgccatgagagccaagttgaggaagaagcgaatcgcaaggcttgaagcgcaaaagaagagagattaggcagagctccaagtacaccgttag

SEQ ID NO: 725517 - DNA, 149 bp, Homo sapiens
gcgtccaaatgaccattgaggtttcaccataggctgggtacatgagggtgtcaggctggtgtgatgctgaggattttacagcggcttagaaacacagctttttttctaggtgtttctcaaaccttagggtaagagtggagatgggaggt

SEQ ID NO: 725518 - DNA, 175 bp, Homo sapiens
aaatttggaagtccatgcgccatgacctgatcgaggagtaccacggcgccccgccgcgcgccctcttcatcctcctcagccactgcagctcttcatcaagagggtggtctgaagactccggcaagagcacaaccagctcaagacaagctgagaagacgaggagcggcctctatcc

SEQ ID NO: 725519 - DNA, 347 bp, Homo sapiens
tgtgtacactaggtgttgagttctttctccagctgctgttgaattaactttgctgattttgccattgcaatatcttgcttattgcaggctattaagaatgatggtgtattcttcagacccatactgtcaagtgaggacttgatacatgaaactcagccacatctttcgcctctcgctggaatgctgcactatccacaacaaacacagtagccctggctgaagacttaaaccgctctaagaactgaagcctcaaactctcatggccgggaaggtcaatcaaggtcagactattgcccctctttattgttgactctgtatacagcacagctgtcagtaatggacgtctg

SEQ ID NO: 725520 - DNA, 236 bp, Homo sapiens
cgcctacggaagatttctaacattaaaattattcagaacatattatctgaccttattttttatgttagaaatctataacaaaaagttcaataaaaatcctgttatgtttaaaattcaaaaatatatttctaaatgcctcatggatcaaagaagaaatcaaaataggaattggaaaaataactgacttgaacaattatgaaagcattacatatcgaaatttgtggaatatagcttta

SEQ ID NO: 725521 - DNA, 308 bp, Homo sapiens
atgcgcccttcgattaggcgtagtcatctctgaagggtcccttctcttactactctcaccttagcaacacctgaatttttgaggggcacactttcaaaccaccagcaggcacagtaccctagattgtcaagggaggcctagtatactcacaatcataatggcccttataaacagggaggcgagaggttgatagcgaacagatgctatcaggacggcaagccgcggtcagagggacgagacgatgctctgctgctggctttgaacacagaggaaggcagccagaagccaaggcatgccggtggtctttg

SEQ ID NO: 725522 - DNA, 336 bp, Homo sapiens
ccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttgggctgatgccattttagcctcagcctgtctgcatgcaggcgctcattaaaacagcatgttgctcca

SEQ ID NO: 725523 - DNA, 100 bp, Homo sapiens
atcagtaatgccggaacagtagataatacacattgggagtatggtaccaggtgaggtggacatggtgtggaagattgttgtacaagtgaggaaaagcaat

SEQ ID NO: 725524 - DNA, 177 bp, Homo sapiens
gaacttggccaaatcaatgtcatacagcttctacacagcctgtttaatctggtgcttgtaggatttaacatccacaatgaacacaagatgtgtagaagtcttctctcttcttcatggcagactcagtggtcagcggcaactgggcgggctactcagtggtcagcggaaactgggcgg

SEQ ID NO: 725525 - DNA, 179 bp, Homo sapiens
gagtcctaggcacagctctgagcctccttattcgagccgagctgggccagccaggcgaccttctaggtgacgaccacatctacgacgttatcgtcacagcccatgcatttgtgatagtcttcttcatagtaatacccatcataatcggaggctttgcaactgactagtcccctaataat

SEQ ID NO: 725526 - DNA, 1319 bp, Homo sapiens
  misc_feature (173)..(173): n is a, c, g, or t
acttactaaagcattcgttcgtagtgctgatctcgatacttcacgagtactatgattccgatggtgcgatatgcctgatttcgctaacgcagaatccgaggtcattcgactacgtagtattgcgaatttatcaccaagtgacacacaaccgctcgtgaggccacactagaggngcttcttgacacacacacttctcagatgagcagcttctagaagagttcattaaatcgagaaatcatgactccacatcaagagaacgctcgcacaagcagtagtcatccgaattcatcacatacttaacagtccaccggccccctgaagccttaagctctcaaccaatcagctcttctttactaatgaaaccccccttccaccaataccccaatccccactggttcaaaccctcaaagcctaaaggacctcgcctaattgttatttcataagacacaacacttcatagggcccataagaacccgttgtatacgttcgacagttcacatcgttgaatcaaagggatatgaacgccaattcaaaaaacttcaaaaactgtagcgacacgcttggaaattcgagcacggcccacattgacgacaggaccaagattaagacacccgaaagaacaaactactatccattacttgacaatcgttcacccccgcttaaagacctcaaagtccaatttccataaacgtaattgccacaagacagttataacgttaacatgtaacacgttggggtctttccccttttataaaacacagcaatacttcaccaaacgccacttgttaagtacaagacaaaaagcacagcgaacagggaagaagcgagacacatatcctggcaatttataaacatcccacttggacacccaattcccaattggaacgcccatattggggcaccaagctacaatttacttgtacagtttctaagtacatgaccaaccaacattaaagtccaaggatagaaacgccaacagccacgggaaaagaccccccccagttttaccggaacgcactttgtgtcaccgagaacatgtggaggtgagagtgttaccgcgaaacacgttaaagttcgttccaatggagctttccacaccagcaattctcgaaagtttatcagccgctgacaagaggcacccacatttagcggcgcgccgtaaatttagctctatcaattaaaggcacggaaaagtacccagcaccagaacaatttatcttacaatacaacatgcaacgaaggcaacaccataacgaccaccaagttacgcacaacgtccgttattgcccgttaaggggtaaagcaagagcgcttagttg

SEQ ID NO: 725527 - DNA, 359 bp, Homo sapiens
ggggttttttcaggggttttggccggccgcccgttacctttggtagataaagaggtcgggggatagatgatttttaaaattggccccccaaagtgccttgctcggggtcctgccgcggggggatgataaaaggggggggttttacgggcgggccgggttgtttcccgacccccccccgggaaatatgggctttagggggtctttttcagaaacttaaacattttggctccccttttccccaggtttcaggcgggggaatataggggaatatccttttaaataattcttttgggatttcccccataatttggggggcaagaatgggggggaatttggattttaaatatttttttacccca

SEQ ID NO: 725528 - DNA, 625 bp, Homo sapiens
gagtgtcgggacgccggctgcatgcgccatggtcttcctcaacgcgcaatctggcttgcgtggaatatcgcgtcaccgaccgctacttcgtgatccaggagtgctgaacactgccagcacttccggggaagtgaaaagtcgctgctacatgggtggcggtcagaaccgtgatagcgagccttagtgaagatgcaccaaaggcccgatacctgaataaacaatgaacatgaggaccctctggattaagtcgaattacacgctgctagccaggaacatggacgtgaagtatccagcgctcatatgggaattcagtcaaggtgccaggtggatgctcaccaggaaagtcctagcggatctggccatctacgaggccaaagacttgcaaatctttggctgcctatgtgccagtaggaggcgaccgcgcacaggatttgctgctggcttgggggattgggaccggaatctgacaggccatccgtccagagtggtgcactaaccactgaggactgtgctgtattgattcaggaaaagaagacacgagtaatttcgcggttgttgattcatactttcgtatgctacaaccaaatacagacatgagggatgggcatgtctctctgggagaagg

SEQ ID NO: 725529 - DNA, 179 bp, Homo sapiens
gtctacgtgcagtaccaccccttaacgcgcgcgatctcgtctgatctcggagagctgagcggggtcgggcctggttagtacttggctgggagaccggcttggagtaccgtgtgctgcctgcttcagtgcctggccggcttcggtgcctgagcgggtttcaggggcgggtatccgggctc

SEQ ID NO: 725530 - DNA, 880 bp, Homo sapiens
tgagcaatcagtagaacttacacatcctaggaaatctttctttgtaagtaattctttggtctcaagtgattctcttcatgtgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttgttaacttacaatccgttttttcctctattttattttgttttttcctgggtgtgggagtcttattatacgaaaacaggataaagtgacgctgttatcaaaagttgccgtggggattcgtgatattacttctcgtgcccttccaaatccccgagggctatgatgtttactacggtgaacccggcccagggtaaacacgggcttcacctgtcctggttggttagccttgacggtgaggcaggacttccctcgctgtgaacggttcacttacgatgtgtgtgtcccatcacattttggtgcagcctgtggtttcatgtagggccctgcgatggaccttcgctttattcagttgtttctcccattgcaacggggggcgttctccacacgagtcagtgtgttgtgggtccctccctaaaagcggttgtaccccaggtgtggttctctaagtgacaggcattgcgttttggtacccccggggcttccgcgttgtaaacccgagacaactgccgtcctatttggggcccactgttgggacccggcgtggggtggaccccatttttggacgccgggatgggcgctgggtgttctccatcgacttggagagttaaggggcgcctctaataggcagcggcgcgtcggggcccaccccatg

SEQ ID NO: 725531 - DNA, 940 bp, Homo sapiens
gagcagtgagaccaaacgacgggggtcggagtcagagttgcagtgggatgtccccggaccggatcacgagcctgagcgggagatgcgccgctcgcacgccctgtcggcacccgctgtacccgtgctgcaggccatgagccatcagcgcagcgctgccagtggagcccagcgagcaacgaatgctgacggggtctgccttcgatgcgtggctgtgggagggaggcaggtgctttggcttcccttgcaggttgtggcatacaagcactggagtcatcaatgccccccagaacggtgatcgaggagttctacaaccagacatgggtccaccggctattggggagagcatccgtgcccacctacgcgtcaccaacggctcgtggtcccttctcagtggccattctttgctgtagggggcatgagttggctccttctctgtgggccttttcggttaaccggcgttgggccggcggaattcaatgctgatgatgaacctggtggccttcggtgtccgccgtgctcatgggcttctcgaaactgggccagtcctttgagatgctgatcctgggccgggttcatcatcggtgtgtactgtggccttgatcacaggcttcgtgcccatgtatgtgggtgaagtgtcacccacagaccttcgtgggggcctgggcaccttgaccagctggcgtcgcggcgggtctcatcgcccggtgttcgagccgagggtcacacatggggaccaggggctgttggccatgttggttggcctcattttttaacccagagctgtttgacagggaccttgtgagacagatttggcccccaagagacccgggaagggctatataacgcgagaaggtgaacgggggacacggggtgtcgaaaatttgtggaccaatagagtgtgccacactcatcggcagattcgagacgtgacgagcagaga

SEQ ID NO: 725532 - DNA, 168 bp, Homo sapiens
ggtggatctgctagacaagtgatctctccttacagcggcttctgtttggtctccaagtccaggctctttccactgcacacatgcctccatcccaccaccttctcccgggctgagcctttccctagccagccagtgttttagaggggcctttactacccctctccctgc

SEQ ID NO: 725533 - DNA, 323 bp, Homo sapiens
aaaattcccacttccatggcaacatttcaatgacatccttacccctatcccctatacccactctgccccatctctaatttgcgctggtctgaacccgcgacaaagtgctcctgtagtatgtgttcgtgcacttcagtaactagctttatatgactagttgcatccagctcattctgtgaacccctgagggcgcaagggcccaggtcttgcttagtcattattcacttctcataattgtctatcatctggttagatgctttaactaacatgctaagtttgaatgtaatctctatcttacaaaaacaaaaacaacaagaaaaaag

SEQ ID NO: 725534 - DNA, 185 bp, Homo sapiens
aagagacgagatgctggtggcacgtcatgaggacagcatggtagtatcaactatgaagagctcgtccgcgatggtgctgaatgggtgacgaccttcctctgtctcgcccagcagttccgagccttgccctggtgtgaattttgtatctatgcctaaatgttaccctaggctttctctgtctcagc

SEQ ID NO: 725535 - DNA, 152 bp, Homo sapiens
aaaaagaaaagaaaagaaaagaaaaagaaaaaaatgaatttgttaaaagagctttaggtcttcaaccagagtttatgaaaattctaggagatcattgagggatgtaacatgatataatgtataactttctgtgatgaataagtttttaaaat

SEQ ID NO: 725536 - DNA, 390 bp, Homo sapiens
tggacctcaccctcaggggtccagtaacagctccgggggcaggaccagggcgggggcggcccccaccagtccacacggtgctcatcagcacgcatcaggactgaggaggccagaggcagtgctggtgacagttgaccatgggggcccctggcatgcatcgcttggttgaggacggtcaagggtggtcctggggctgtgtgcttactgggaagccgggagggcagaatggcattgatattacagggagcccacgtagccctttacattgtaattggcacctccaccaggccataagaccccaggtcccagcccagagcatgtcccagaggaagactcagagaagctcctggaatgtgtgtgcacggctccttggtattgcttgttccgctg

SEQ ID NO: 725537 - DNA, 685 bp, Homo sapiens
  misc_feature (39)..(39): n is a, c, g, or t
  misc_feature (90)..(90): n is a, c, g, or t
  misc_feature (114)..(114): n is a, c, g, or t
  misc_feature (124)..(124): n is a, c, g, or t
  misc_feature (129)..(129): n is a, c, g, or t
  misc_feature (139)..(139): n is a, c, g, or t
  misc_feature (141)..(141): n is a, c, g, or t
  misc_feature (148)..(148): n is a, c, g, or t
  misc_feature (168)..(168): n is a, c, g, or t
  misc_feature (200)..(200): n is a, c, g, or t
  misc_feature (225)..(225): n is a, c, g, or t
  misc_feature (240)..(240): n is a, c, g, or t
  misc_feature (254)..(254): n is a, c, g, or t
  misc_feature (257)..(257): n is a, c, g, or t
  misc_feature (262)..(262): n is a, c, g, or t
  misc_feature (270)..(271): n is a, c, g, or t
  misc_feature (354)..(354): n is a, c, g, or t
  misc_feature (398)..(398): n is a, c, g, or t
  misc_feature (411)..(411): n is a, c, g, or t
  misc_feature (443)..(443): n is a, c, g, or t
  misc_feature (528)..(528): n is a, c, g, or t
  misc_feature (593)..(593): n is a, c, g, or t
  misc_feature (614)..(614): n is a, c, g, or t
  misc_feature (616)..(616): n is a, c, g, or t
  misc_feature (618)..(618): n is a, c, g, or t
  misc_feature (660)..(660): n is a, c, g, or t
gaggagggaggccgggacaaggcgccggtgcagccccancagtctccaacggcggcccccggcggcacggacgaaaagccgagcggcaangagcggcgggatgccggggacaangacaaaaaanaaganctgtctgaanangataaanaacttcaaaatgaactgganatgctcgtggaacgactaagggagaaggatanatccctgtatcgaccaacgctggangaattgcgaaggcanattcgttcttctanaanttccntgacttcnntgcccaagcctctcaaatttctgcgtccccactatggcaaactgaaggaaatctatgagaacatggcccctggggagaataancgttttgctgctgacatcatctccgttttggccatgaccatgantggggagcgtgantgcctcaaagtaatcggctaagtgggctcccnaggaggattggcatcatggggtctgagtatgtcaaggtaaaatctcttcttcttgggaatccgcaaggggctctgaggctctganataattcagaattttctctgtggagtacaatctgtcttggagcatccgtgtattgaatttcccanacgctggattccttgacccanananaagtgcttcccctgaagctgtactctcttaatcgtctgggantatctgtaggcatctggcaggagaa

SEQ ID NO: 725538 - DNA, 113 bp, Homo sapiens
taagatgagctggtccgatggccatgtatatctgactcttagactcctccttcttctatctttcttctcctctgctgcagcagggtgcagaaccagcagcaggggctgcagag

SEQ ID NO: 725539 - DNA, 215 bp, Homo sapiens
  misc_feature (180)..(180): n is a, c, g, or t
gggtaccgggatgaggaacgtcactgggatgaggaacgtcactgggatgaggaacgtcactgggatggatgtaggacttgaagtaacgttattcggaacatttactcggtccgtgaccaaacttcacaaggttctttgtcgggttggtccccgttggaaccacatcacacgtgtttcctngatatcatggggacacagtaaacaagcattttcac

SEQ ID NO: 725540 - DNA, 139 bp, Homo sapiens
ttgtcggccaccactctttgtcacagctttgcgggagggggcgtacacatagtgcttctgccacatgtataacgagcgcggtgaaaccggatgaagaacatggcaccgcccacaaccgtcttccactcgtccgagcgaa

SEQ ID NO: 725541 - DNA, 186 bp, Homo sapiens
cccaggctaggggtctaatcagagctatagctgccagcctacaccacagccacagcaatgccagatccaagccgcatctgcaacctacaccacagctcatggcaatgccagatccttaacccactgagtgaggccagggatcgaacctgcaacctcatggcacctagttggatttgtttccactgc

SEQ ID NO: 725542 - DNA, 849 bp, Homo sapiens
  misc_feature (33)..(33): n is a, c, g, or t
  misc_feature (61)..(61): n is a, c, g, or t
  misc_feature (63)..(63): n is a, c, g, or t
  misc_feature (66)..(66): n is a, c, g, or t
  misc_feature (68)..(68): n is a, c, g, or t
  misc_feature (72)..(72): n is a, c, g, or t
  misc_feature (84)..(85): n is a, c, g, or t
  misc_feature (102)..(102): n is a, c, g, or t
  misc_feature (110)..(110): n is a, c, g, or t
  misc_feature (146)..(146): n is a, c, g, or t
  misc_feature (153)..(153): n is a, c, g, or t
  misc_feature (161)..(161): n is a, c, g, or t
  misc_feature (169)..(169): n is a, c, g, or t
  misc_feature (189)..(189): n is a, c, g, or t
  misc_feature (199)..(199): n is a, c, g, or t
  misc_feature (206)..(206): n is a, c, g, or t
  misc_feature (233)..(233): n is a, c, g, or t
  misc_feature (235)..(235): n is a, c, g, or t
  misc_feature (239)..(240): n is a, c, g, or t
  misc_feature (251)..(251): n is a, c, g, or t
  misc_feature (258)..(258): n is a, c, g, or t
  misc_feature (264)..(264): n is a, c, g, or t
  misc_feature (288)..(288): n is a, c, g, or t
  misc_feature (309)..(309): n is a, c, g, or t
  misc_feature (316)..(316): n is a, c, g, or t
  misc_feature (318)..(318): n is a, c, g, or t
  misc_feature (322)..(322): n is a, c, g, or t
  misc_feature (327)..(327): n is a, c, g, or t
  misc_feature (330)..(330): n is a, c, g, or t
  misc_feature (333)..(334): n is a, c, g, or t
  misc_feature (348)..(348): n is a, c, g, or t
  misc_feature (368)..(368): n is a, c, g, or t
  misc_feature (379)..(379): n is a, c, g, or t
  misc_feature (386)..(386): n is a, c, g, or t
  misc_feature (393)..(393): n is a, c, g, or t
  misc_feature (419)..(419): n is a, c, g, or t
  misc_feature (429)..(429): n is a, c, g, or t
  misc_feature (432)..(432): n is a, c, g, or t
  misc_feature (440)..(442): n is a, c, g, or t
  misc_feature (446)..(447): n is a, c, g, or t
  misc_feature (482)..(483): n is a, c, g, or t
  misc_feature (489)..(489): n is a, c, g, or t
  misc_feature (841)..(841): n is a, c, g, or t
cttcccatcaaaaaccagccacctcatctttcnaaactcttaatatatcatttcaaatatntncancnactntacaaaaatttnnaaatatacacaagagtntcactcancatcatgcctggtatataaaaaccactaactaaatntccatgnaataaatnaatatatnaatatcattccttcactcanccaagcaaantaggttntcaccaaaatactcccacccatttatnanaccnntattttttctnactctancaactntgcacatcataccacacgcttggncctgttattgttccatcaggngttcatnantctntattnaantcnnattcacttagcttngaacatgatcttagaaactngactacattcnctttatncatacanttacatccaaacctcaaactatcccncctcttcttncanttaacctnnnttannctctaatcaatactaccttctctccttactctccnnacacantgtttctatcctactagttacctaagactttataagtcaaacataaaaaataatgaaaagaagccttgctaagttgcttttatcagtttcacaacatggctgaagctgcctgcagtataatccctctccccatctctaaaatgacatttaacctataaaaaattcaacttccccaaaccacaatatctatttaacaataatctttaggaaaaaaaggttaatagccactccagcacatctcacatcaatggcactgaaaagtgagcttcagaaacaaggtcgaaatttaagaaactcctttaaattcttggtttttgagtagcggatcttttcctgggttcccgggaagaanacggcttt

SEQ ID NO: 725543 - DNA, 271 bp, Homo sapiens
  misc_feature (119)..(122): n is a, c, g, or t
  misc_feature (129)..(129): n is a, c, g, or t
aaaggtttttgaatttttttttttgggggaaagggggggcccttaaaccaaaattgggggggggggtttttaacccctttgctttttttttattaaaaaaaaaagtgagggggaaagannnntggtttngggggggggtttttggtttttttttttaaccccccccttgggaaacccggttttctttttaggggggggtttttaattaaaacccgggcccggggcccccccccgtccccctttttaaaccggtttttttttttgggttcca

SEQ ID NO: 725544 - DNA, 232 bp, Homo sapiens
  misc_feature (66)..(66): n is a, c, g, or t
cccccccccccccccttgggggaaagccgttgcctgttccccccctttgttcccttcgggttaacngctggggtaactttttcaggatctgtgtgaaaaatggtaatgccgtagttgaaaggaaaaaggcccgttgggggtttcctttgggggatttcggcccaaaaaaatgggtttgaactatattgtatgtaatttggaagtggggttaataaaacccccccgtttccca

SEQ ID NO: 725545 - DNA, 1549 bp, Homo sapiens
ccactaacgcatacattacgacatcgtcacaagccagcccaacagaccgttacttagttagcatcaaccctctactatatctcagccatacattcgatgaagcatagccgtagtgttagggctgtgtaccactcaggcctttatttccgtgccgatgcgcccttaaacaaatcgccacctgcgctgagatcatcttaacataccacgtgtacatcacgtaactgccatccacgaattcgatggtcgatgcactactgaccaactgattcgagatgtaatccagcgtgatcatcgaaaaaagacctgctaccatctctggtagctcactagatcactagggagacctatatatattaaaaacaaacataacaaatctgagactagcagaaaacaaaaacaacaaacagaggggcgggcggggggctaaacaggataatccccttcgcacgggggacccgcagagccataacccgccgaataccccagacacaaacgatgggatacccaacaggggagagccgcaacataggagcagaacgcaactaaatacagacaaagggacagcagggcacgcgagacgagtataacaaacgaacggttgacacagtgggccaacaacaccaggcgcacacccctagggagaaacactatcagaaccacggagaaaccgcataaccaaccaacggggagcaggagaacaaaaaacatgggcgccccaaacaccaaccccatacaaggaagaattaaaaaaagccccaaacaaaggggaaacacctaagacaaaacacacacccgcggccaacaaccggggtgtcgcaaccccaaacgccatgaccacacaccaggcccaggcccagccattgaacaacaccacctgggaccaacacgccgagatactcgcactcccacggaacacaaaataatatacccccccggcagcaccagagacacaaaacaaaccgaacacacacaccaacacgaccaagcaaaagaacaacagaaacagcagagaagacgaaagaacgggaagacagagaagaaaagagaaggcgacgaagacgggaagcagcaaagaagagagaagacgcagcaagagaacaacaggagagacagagagagagaaaaaagaacgaaaggcgaagaaagacaagacaaaaggaaaacagcaaggaggaaaagagagaacacgagagagaacgagcaagaggcgaacagacgcagggagaaacaaaacaaaagagaaagaaacaggagccacagcaaccgagaagaacagaagaaaaacgaaacacagaacgacaaaagcacagaaagagaaaaaagatacgaaagcagaaaaagcacaaaagagcaaaaaaacgacacaaacagaacgaggaaaaagacacaaacgaaaaaacaagacaacaagaaaagaaaaagccaaaaaaaaaaaagagaggcaagcagagaagaaaaagaataaaaaaacagacaagacaaagcagcaacaacaagcaacagaaagataagaaagaacacacaagacaaaacagcgacggcgaacaac

SEQ ID NO: 725546 - DNA, 242 bp, Homo sapiens
  misc_feature (50)..(50): n is a, c, g, or t
  misc_feature (198)..(198): n is a, c, g, or t
cagcacatgatgagctggagccataatctaagcagattaactctggaacnaaaaccaaataccacgtgttctcacttagaagtggaagataacaaataggactgtggattctaggagagtaggagagagacgggcatgttttgaagctactgtgggtgcatgttactataccaaaataccatgtacagtcctacacangtatccccgtttataaagctgaatttaaatcacatgtacaccca

SEQ ID NO: 725547 - DNA, 427 bp, Homo sapiens
cttacagcggaggtgcgtgtcctgcgtcgcggtgtccaccttatctgaggcccgcttggtctctgatgatctcagaaatggccagggctgtgtcctgtaccactatctaggatactgtcagcccgacagatcggtgactgcttgcgtccccgcggagtccatgaacagagatgagcatgacggcctcttggtccatcaccctgatatgcctgagaaatcccgctttctagaagtagtcctcctgggagcccattgtgcagggaaattcacagtctacatccagatactgagccgaaaggaggtacctgttatgaggactgtgatactactagatgccctctggaggtcatcacagagatagagaccccggtgatgctacttgacacacctggcattatcagtcctgagacacagaagaagctcctgg

SEQ ID NO: 725548 - DNA, 367 bp, Homo sapiens
aaggcgcaaatacattttgtttctttttctttgagatggagtctccctccgtcacccaggctggagtacagtggtgtgatctcagctcactgcaacctctgcctcctgggttcaagtgattatcctgcctcagcctcccaagtaactaggactataggtgcacaccaccaagcttggctaatttttgtatttttagtggagatggggtttcaccatgttggccatgctgcttttgcactcctgaccccaagtgatctgcccaccttggcctcccaaagtgtcattaggtgctgggattacaggacagctaccgtgcccactctaatttttaaattttttgtagatatggggtcttgctatgttgccc

SEQ ID NO: 725549 - DNA, 138 bp, Homo sapiens
aaacataaatgcaaaaatcaagaatacaaaaatattagtaaactatcaaactatgaggtgggtggatcaactggggtcaggagctcaaggccagcctggccaacatggtaaaaccccacctctactaaaattacaaaa

SEQ ID NO: 725550 - DNA, 1034 bp, Homo sapiens
ggagagagagaactagttcgagtttatgtttttttttttggggctaatgcttttcctgtccacttatttttcttatccctctgttttccaaagttctcaacctggcctctaattgggctctgttctcaactcccatttgcagaactttgaattcctcaccaaaagcattcataacggatagccaaaacggtttgggctgccagcatttcgagaaatcttcccttgtgtgttgggccacttgtctggcccacgagtgaagcttgataaatgagaccatacttaggggtactcccgtctagattggagggcctctgaaaagttgccttttcagctccaagaattctgaccggtagaagctgcattgcttggccaaattttaaaagagaacctgcattgagcaataagccgtgctccaattaattccccaaccattgacgtgtaccattggggttgcaagtggccatcattcgatttgtgtagatattcataggagcgtgggttcgatatttcagagatttcaactcaccgtgggtgcaaagatgccagaatattgcaaatatcttcttctgaaacctcgtgtccccattgatatctctgcagctgcttcacttctgcttcagcttcttctggcagcaactcagaaagcttggcacacggcatagtccttcctatcgccaatttctgtaaaccttgcagtatgtaacctcatctgcacatattttgccctactccagcgaaatgccagccataaccattctctacatcggcatactgtatcgtacacacttaatcccaggtcctcctaacagggatatgttgccccttgaccagaccatttgggtccatcacctttaacaagcggccaaatgtcacatctatatctgagacaaggctgttagcgccaattcccagaaccatagtgtcgcccatttccacgtgtgttctacccccgggattaaatcccctccccttgagtaagcaatccctctcataagatccttcaccacaagcactttggatcacctgggaaatgc

SEQ ID NO: 725551 - DNA, 973 bp, Homo sapiens
ggttttccgcccggcgctgacggtgctgcgcccgcggtccccagtgccccgagtgccccgcggcccggagcggagtgggacccagccctaggcagaacccaggcgccggcccggacgcccgcggagaagagccacttcccgcccacgtcccatttcgcccctcgccggtccggagtccccgtggccaaggtgtgtgtctggggaaggagactttacagaagttggagttcgctgagtcaaagatctaaccaatgagctacccttggttatcccccccgcccccaggtggttacccaacgcaaggttgcaccccagggtggtggttccctggggaaggtttgcttgccttacccttcttccgcccaggattggcccccccatcggggcttgaataacgtgccacctatgcggggggcgttccacccaaggacttatctctcgggaaatggcggccagccattgtcttgggaccttttggaggaagccacgcatgccaaacctgtacccctgggcccctgggacttgtacccacccagtgccccttgcggcctttgggggggaccccttctgcccaagagcttgtcctccctattggatgtttccacgcccaagggaggaagacccaactcttccaagggttggcctcattttccggcatacccatggggcaccttgttccggggcagcattgaatccaccagaatgattaccccaagggctacctaggaagcacaatagactacctggtaggctcaagtgaacatccttaggacatagccattgctactaaccaagaacccgggattgaatgacccgggttttccagccagttgacaggacacacatattccggatcacataaatgcgaccgagagaaaacaacggaacaggcaatatgagcaaagcagagttagcagagagtagaaccagaagtataacatatatacatccgtccgacacacatgtcgtgtgt

SEQ ID NO: 725552 - DNA, 115 bp, Homo sapiens
cattggataagcggatgagggggaggcggaggctgccaagatgcttggagaagcactgagcaagaatcctggctatatcaagctccgaaagatccggaatcgcctcagttgatag

SEQ ID NO: 725553 - DNA, 186 bp, Homo sapiens
acaaacgtgttgacaaggacataattacatcactctagtgagtatgtgataaagaaaaaaagccatgattattcgatgtggttggctatgtatatgtggcgccaataacgaacctgtataccagctgtaaccaatggtactgatctatccatccaatgtagtcattatatctgactgtggttcagc

SEQ ID NO: 725554 - DNA, 488 bp, Homo sapiens
tcagatacgaatcgagctcgacctgcagctctctctgatgggagtcatatgctctgttctctctgccccagtttgtccgtgaatccctttccctgccatggtgcatgcgagaaacatgctgcagtgccctgggccacctcgcggtcccgcctcctggcctcctgcactctaaacatacatacctgaatgtgagagtttgtcgggagtgaccttctacctccttccagagcacctgcaggtcaagggactccagtctgttcacagccaggcccttgaagcttgattcccacctaccagccctgtgcctctgacttacgctccctggttggccagaagcactcctgccggggccccaaggacgagggtttgctgccctagtggggcagccttggaggtgacagtagaatcctgctggcctccagggccaggtcaatgtccccccatatcatctgtaggggctagtggcccctcttgctgccaatgagccc

SEQ ID NO: 725555 - DNA, 341 bp, Homo sapiens
aatcgtaccgggcagtacggatattgtgtgctgtgcacagagctcaacagcttgggaagttagaaggaaggggaggcaggagtgtgttaatctgctgcatgatgggcccatgaatggtggctctcaaacttctgtgctacaagtgagtgtgtggttgggcgagtgtccttgttaattgataactaattgtgcttggttgggaacatatccatgaatgtccctcgtgggtggggggccagactgtccttgagctcattgtgttagcaccttccccccaatgagggtgaacctgtcctgtcgacttctactgtgcgacggagtgggctctgatacccaagggt

SEQ ID NO: 725556 - DNA, 571 bp, Homo sapiens
  misc_feature (521)..(521): n is a, c, g, or t
tatgtctcgatcgtaacagagaagtatctcctgcatactatcatttcagaaggtgcttcagtgattgctgtgggtgggcaagggggaggatgagtggcccctctcctctgcttcagtgggagtagccctgaaggagtagctcttttactactatgggttctgttttagatttcatttaacgagatttcatttaacgagatttcatttaacgagaggatcttactgctaaaacaagtttgaaaaccactcttctagaatctgatatctagatctgtgtagctcaattgacatgttatagttgtaaattttaaacaaaactgctgaaactccaaaattagaacccattttcaaaaggagatgaaaattacctgaagtagagggatgaaatcctcctgttctagagagctgcagttgggctttgctagaagacagatgaatttagaggcatcatcatgatggttattcagcaacctcggcctccgaaagtgctgggattacaggcgtgagccaccacgcccggnctgttctcatctttatgtccatgtgtacttgatgtttagctcccactaag

SEQ ID NO: 725557 - DNA, 278 bp, Homo sapiens
tccccggggcccccccccccaaaatttttaaagaagcaaagaaggaaaaaaagggggcagtggccctgcccctgaacaggagggcccccaagctacccccgccaaaaaaggcatggttttggccttttgggtaaattaggccccaaaggagaaactaaaaatctggttattttttgggaaaaggtttaagaaatttcccctaaattttgtttggtttgttgggatgaaaagttacctttttttcccaaaaaaaagagggaatttttcatgttaagtta

SEQ ID NO: 725558 - DNA, 138 bp, Homo sapiens
gcactcaggtcgggggtatgtgtcgatcataagaacaggaggttagaagtagggtctggtgacaaaatcgtggtagagtcagggagaggcgtcatatgtgtcccctgaagatgttggtgggccctgaagattttggct

SEQ ID NO: 725559 - DNA, 234 bp, Homo sapiens
atcatcagcagtgatgggttctccatctacttccagtactagggtgaaatctctgagagtccacacaaatgctgggaaaaaagctcacacaagtcagctgtagtcgtctacaggaatggttaccagggtgaggagttggccttgattcggatctggtcagctctgtcacatagtgaagtgggtccagggcctgctggttgatggttcccatgctatggtctgttagattagaga

SEQ ID NO: 725560 - DNA, 332 bp, Homo sapiens
  misc_feature (21)..(21): n is a, c, g, or t
caggaatgcaagatttaagantcactaccgcataataaaacagcacaagaggccgggcgcagtggcttacgcctgtaatcccagcactttgggaggctgaggtgggtggttcacctgaggtcaggagttcgaggccagcctggccaacatggtgaaacccgtcggcactgaagatatgaaaattggccgggcatggtggcaggcggctgtaatcccagctatttcgggaggcttgaggcaggagaatcacttggggcctgggaggcggaggtttgcagcgagccgagattcgacaaacaattccagccttgggcaacaagagaggaatttcc

SEQ ID NO: 725561 - DNA, 112 bp, Homo sapiens
gtggaagtgacatcgtctttaaaccctgcgtggcaatccctgacggaccgccgtgatgcccagggaaggaaaggcgaccctgaaggcccactaatttccttaggtcattcca

SEQ ID NO: 725562 - DNA, 161 bp, Homo sapiens
gcgacctggtggttgcgcctgtgagttcttaccttccttctacatttgtttttgtgtttgtgtgtttgagacagggtttctcactctgttgcccaggccgcagtaagccatgatcataccactgccctccagcctgggcaacagagtgagaaaccctgtct

SEQ ID NO: 725563 - DNA, 733 bp, Homo sapiens
actgaattaggcagtcttaaaaaaaaaaaaaaaacggaaaaagaaaaaaaagaacgtggcaaattggttaaaatgccaaaagggacagtttaattttggtacagattatgcttaccctcaggtttcttaagtggtgcttgaatggccccttctttccatataacacttatcttcttcttaagttcggcgcaagggaatatcttttaagttttaaaaaaacgggaataattatatctatctttttaggccgttaatattaaggggtctcaggttggataaaatcaaggtctgggttggtgggctggctgaattacatatttatcgacgtggggggcatttgtaaacgtatagtggaacaagacaccatattaaggtaccggggactaaaggcaatctatattctggtaaaaacaaacaacaaacatctggccttaggcttgttttaacaggaaaaaaaaaagggggcggtatacgggcccgtgtacgtggacacggggcagtggcgcgccataaagggggccgagacatataaatcggggacagcgtgtattgcgatcacggggggcacactataaaaagacccccagaaaaaggcgggtaaaggccccttagaaaacgtggggtaccccaagaacaagcgctgggacacaactcctacaggggggaggagaaccacctgaaaaggtgtaaccacataaggctgccaaggccactgcagagggcacccggtatc

SEQ ID NO: 725564 - DNA, 184 bp, Homo sapiens
acagagacagccaagcttctagaagaacacataggcaggtcctttctgatcaagtagtgacaaatactttcttgaacaagtatgcaaaaacgcttgctgcccaggaagcaaaggatcaaattcaacgtacattgcactattaagagccgggaagatcctactagtagctcgacctagcaggcca

SEQ ID NO: 725565 - DNA, 868 bp, Homo sapiens
  misc_feature (52)..(52): n is a, c, g, or t
  misc_feature (61)..(61): n is a, c, g, or t
  misc_feature (85)..(85): n is a, c, g, or t
  misc_feature (157)..(157): n is a, c, g, or t
  misc_feature (171)..(172): n is a, c, g, or t
  misc_feature (180)..(180): n is a, c, g, or t
  misc_feature (184)..(184): n is a, c, g, or t
  misc_feature (212)..(212): n is a, c, g, or t
  misc_feature (220)..(220): n is a, c, g, or t
  misc_feature (229)..(229): n is a, c, g, or t
  misc_feature (248)..(248): n is a, c, g, or t
  misc_feature (262)..(262): n is a, c, g, or t
  misc_feature (272)..(273): n is a, c, g, or t
  misc_feature (327)..(327): n is a, c, g, or t
  misc_feature (340)..(340): n is a, c, g, or t
  misc_feature (345)..(345): n is a, c, g, or t
  misc_feature (408)..(408): n is a, c, g, or t
  misc_feature (433)..(433): n is a, c, g, or t
  misc_feature (550)..(550): n is a, c, g, or t
  misc_feature (628)..(629): n is a, c, g, or t
  misc_feature (646)..(646): n is a, c, g, or t
  misc_feature (649)..(649): n is a, c, g, or t
  misc_feature (658)..(659): n is a, c, g, or t
  misc_feature (720)..(720): n is a, c, g, or t
  misc_feature (783)..(783): n is a, c, g, or t
  misc_feature (798)..(798): n is a, c, g, or t
  misc_feature (804)..(804): n is a, c, g, or t
  misc_feature (859)..(859): n is a, c, g, or t
ggctttcaaattattttttgctttatggttattacttttataaaccatctgntccacggcnaaactaactggtaccatacaaagntatgtctattattgtcatgtttagattttctattccacattcattgacaaatatatttaaatctagataganacacctgtgattgnnttagtgcntggnaatgcatggcatatacattgcttagggnggtaatanggggtcagntgctctactgccaccttcnagcacaggcaccgntttgcatttnntgcaaaacttctggttttactcaatttttacactggtggaagctgatgttagtnacttaaaaggcangctanttcttttccatttcttagctgaacaaaaaatacacacaatgtagcgtttttattgggcaaganttgctttttatatttcacgtgtgantgcttattacccttccttgtgcaaaatgaccagggtactaataaaaccatctttgcaggagtgtttaataagcatattttatttaaataaatcctccagttggggatggagaattcnttgcctttacttagaaggctatgttaatagctatctgtcaaatttatatatgccgctcaccaattttcccttactggnnacatcagtttttccacntcncatcacagnncccaaaacgactttaaagtctcaaaattccgtgtctcctttggcttgcttctctcttgatnccacccaggctttattaatggttcgcttcatatcatcgtctccatcttcataaattttctttngaacattcatcaatncctcantaggatctgtttcagtgttataggagggcttctctttttctttgcactacttttnaacctgggt

SEQ ID NO: 725566 - DNA, 341 bp, Homo sapiens
gttgactctaaggatcccttggggctctgtgtgtaaggggagaagagacgtccctcggcccggggctcagctctttactcggcagtgactcttcccatggtgatctcagcccgggaacccatgagagctcgggagggggtcctcctgaggggccctgacttccggctgtggggaagatccccagggtttctcagcatcagaccatccgtcactcagttgggactcaagccacacatcactgtttcttcaacgggcaatgaaggcaggggccaggccccgggttcatgtccagaaagatgacttggtgctggccagggcttcacaaccacagccagagtgct

SEQ ID NO: 725567 - DNA, 465 bp, Homo sapiens
gaccaggtcagttcgacatcgaggctcgtggcacccaggcatcagttccacattggccccggacaagcgctgcagccgacggtcgtattgcgcatacggcgctgcaggaccagaccgacccgcaactcgtggtgctggtcgagccactcgcgctgctcgccggacaagacaaccccttgcccatgggaagcaggcgccgcgcaggcaatcaagggaaaacacaaacagccgataacccacaagcagcaaaaccgtatcattcgacgctcacacactgacaaatgctgaccaactcattaggcttccaggatgactcttgccttggaaaattccgatgcttcttctctaccgcccttgcaattggccgcggtggtgcctggccgctggttactaacttggtgcccgggcccggtaattgggcggccaacgttcgaatcgggccgcaaattttaggtagttagtaat

SEQ ID NO: 725568 - DNA, 1254 bp, Homo sapiens
tattggaaacggagtctgggctctgtcgcccaggttgggagtgcaggtggccgcaatcccggcccacggaaagttccacctcccagggtacacgcgccgatttctctccccgccttcagccccccagaagatacgccgtggagaactatacagggcggcccggccaccattgcgccaagccaaaattccctgtgatatcttctctatagcgaaaagaacaggggttacaccggagtgatacagcacaggaatgggtgcccgaatatctccctggaaccatcgcggagacaccgaccggacctgaagacctaacccaaaagaaacaggggaataaacagggggtagaaacccaagagccgcccgcggggtaatacttataataatatatattagatgtgataaacagaacgtgcgacacacgcgtgaataatatatgagagccaccagaagagaggacacacaccaaaacaccccagaaccaccacacgcgacaaacacacaccaaccaatagagagggcacccacaaaagcaggcgagcgcagggacaaccaccaggaggcgagaaaaaaccacacacccacaaatgacacacaaagcagtctacagaaaaaaacgccaacacaaaaaaaatataaaacaacatcccaaacgacaagacgcggcaacaaccaaagccaggacgacaagaagagaaaggagagaagaccgcaaaaacaaaaagagagagacaagagaacccacagagacaaacccaaacgaagcggcgagaagaccaaccgacacaaaaaagtcgcacaagcaagcaacagagagcaagcgaccaacaaagatgaacgagaggggaacaaagacaccaagggaccagacgacaccacaaccaacaccactaccccaaacaaaacatatttccaacataaccaaaacaaaaaaaaaaaacaagaaacaacccaaacataaaacaagaacacatcttaagcaccaatcctaacaaaaacacataccaaattaaaaaccaaaacgacaataaagtataacaaaaaaacaaaacgacccccacaacaaacgggaacaggacagaaatatgagatatcaaccacctatacattactcattaaaaaacaaattagcctcataatcaaccaccacaataaaaaacaactactaccaaaacaaatacaccaacaatacatcaactctacctcagtaacacaacaaaacctcaatactcccattatccaacaccaaagcaataa

SEQ ID NO: 725569 - DNA, 639 bp, Homo sapiens
  misc_feature (71)..(71): n is a, c, g, or t
  misc_feature (192)..(192): n is a, c, g, or t
  misc_feature (204)..(204): n is a, c, g, or t
  misc_feature (327)..(327): n is a, c, g, or t
  misc_feature (423)..(423): n is a, c, g, or t
  misc_feature (431)..(431): n is a, c, g, or t
  misc_feature (490)..(490): n is a, c, g, or t
cggggccatctttcttttcccttactgtttagggctccctttattaattacttcccaccccctttcagctnccatccttcctttcacaccttaagcctactcaaccaacaatccccacataacccaaaccccaatcacgcaaaaagcacttccacctatctccttattcaaattaaaataaaattggtattnaggagggggccnaaactcccctctttcaaaaccactttccccccactccctctcttttccccctacatttctcttccctccccccccttcccccctcccctcctcttctcttttttttttcctcttcctacattnacccttccccttctcccccttccctcttctccccccccccttctccttcccctctctcttccccccctcctcctctttcctctcccccccttcttntcctcccncttctctccctcctcccccttttctctttcctctcccctctcttctcctcttttttctncccctctcctctcttttcctctctccctctcttctttttctcctctccctctcccttcccctctccctcccctcctccccctcctcccctctccctctctccccttcccccttcctccctccttctccctccttaacacaaaaaaaaca

SEQ ID NO: 725570 - DNA, 144 bp, Homo sapiens
aaaaaaaaaaaaattgcctttttgtttggccaaatagggcccaacctttttttttttgtggcccgttacccccccttaaaaatttagggtttttttttggttgtaaaggggccccaaattccctttttaataaaaaaaggttta

SEQ ID NO: 725571 - DNA, 104 bp, Homo sapiens
ccggaccgggtgggagacggaatgctgtgtgtgtgtgtgtttccagctggctggggtactgtgtgtgtgtatgtgtctggatagggtgctgttgtctgctgcag

SEQ ID NO: 725572 - DNA, 342 bp, Homo sapiens
taagggtcatgcgtttacaattcagcttggtaggcaatagtgcagctccatctcttatagagaacagtgccctcccagttgatttgtaaggcattatctcaaatggtaaagcgcaatagagaactagcattgttcttatatgggttaggcttccactttgcaagaatagcacgtatatccctgtacattcaatgggtttaggtaagtgtcatgtgtatgaggcatagacatgtttagcgccatgccagtaaatgtcagtatcatgccttgaactaagttctctttaatgacagatattgcccctgattggggtcatagactgagttctcgtatatagttctc

SEQ ID NO: 725573 - DNA, 228 bp, Homo sapiens
caacgcaggactcttgatgacgatgatatcctgaaagaactggtaagaacttgtcttgtggaagctcacggcatcaaagctgacagagaaactgttgcagtgaagccaacagaaaacaatgaagaggaatacacctcaaaaggtaaacaaaagaaaggacagcaagggcaataaaacagcagcttttgatgcataatgatagctgaacaattggaagcatcaaaggat

SEQ ID NO: 725574 - DNA, 1830 bp, Homo sapiens
agggccgttgagtaagcttgcatacaatgatgtgccacaccagtctagtcctaattggagagagtaggggactgactagctcccaaggctctcccccagacttgtggaggtaacatcagtgcctgtccaggatgagtggctgaggcgtggtaagagactagccctgggtcgcccgtggagagtggacgagagcttagttgtagcatggcgagtacggcggatacgccaacgaatttcctagatgcatgcgggccgactgacatgtcgtcggataacgtatccttggactgtgtgtctccattctctgactagctagaagacctcttggtaagaacactatgccataattcgcgctagaagattcgcctgagggctagaggtgactgtgcaccgcattcattcacgtgggatcccctttggcgtcggcactagccaaagatagttatcttggatagggcatcgcgctgaaaaaccacatactgctaggaggggcacacggtgtcctatcaagccaccgagcgagccattcgattcctaagttcccagcatgccgtattacactggctaaccacggaacgaatcgggcaaagtccatagggcccatgttatcaaggccaataggaattcccataccgcgaagtcactttatggcggaggtaggaaaccccggtcggaaacacagcgaaacgtggccaggacatccacacaccgtctgcgaaagcgcaagcaccgcggaagacggccttaggcctttggggcacacacacaaccgctcgctaaagccccaattgaggacccccagcatcaccctcggacggacgttacacgagaacggactataggaattcgttccaccccaaaggccgacacgcacaacacacgcggtttgtgcacatgaggtcggagctcaacacaggcaatcacgccagtatcggcggcgagaggcaattacgaccaacggagcgagcaactccagaattcagcgcccaccaggaacacgacagtatcatcaggctgcggccaacccattcgtaacaccaacatccgcaaactacgcacacaactatctcagaacgcaacacgcggtcacacacacgagggccagcggacacacgcacacacgtcccgcaacagcggacgtatccagtccaaacgccagcagagggtacaacacccaagcacccagagatcggccacataacacaacccgacaacacgaaacccacgacacaccttcaacagccaactcgaagcgataaacagcaacacgccgcgcgaaacccccaaaaaaccaggactaacctcacaacaaccatccccgcaaggactattggagccccatgtattcgctaaacgaggtatcctgaagcacctcgcagaccttgggataccaacccggcgaaacaatagcacacacacggtgactgagagatatcatcgaagattgcaccaaacacaccagcagtagagggaaactataccacaaggccgaaatagtagtagaaggcttgcagcaaagtacaaacacacactcaacagctaactaaaagagagttacgagagataaacgtcactagacacgaatagaggaacgaaactcatgaagctgttgcactctactaactcttacctcccacacggaggagactaatagagagcacaacaaatcaagtctgacagtaaagtaggaccgttagagagctacccacgttaaatgaagcaaagaaactactatgaacccacgactataattcggactgccgtacagcacacacaccaaacaggaggacatcaacaatgaagaacaacgcacgcataagcaactacaca

SEQ ID NO: 725575 - DNA, 444 bp, Homo sapiens
ctggaagatggcatgtagagtcttctctggcagagaaataccatgagcgcatctatactgactatatgcctgatcgtgaatactgacacatgtccatatctgagacactcctgagttgagtcgcatccttcgcacaaatagcttcctggctggtacccatgataacgattgagctgaagctgggtacctctggttggggaacaggtgagttctatgtgagacttcctgccctagcaagctgcctccgtccagaaatgcctctcacatcatgagctcgggcctctctttgtagctgtgagtgtcaccctctcaggctttgtctcatccttcatactgaataagatggcagtgttctcctctggggcctgatccacctctacaccagcccaggaagccccatctgtgcctgccctcaggtggtccatcagtctccccctttggttc

SEQ ID NO: 725576 - DNA, 166 bp, Homo sapiens
acggatccccggcgttaaagttaacctacacttgcttcgatccttggacaggatgtacgcagatttaagtgctgttggggctgctaactacacagtatgggagaaaatcccttccatgtcgaacaacctagtccccaactcctgctgcattaatgttactttgacg

SEQ ID NO: 725577 - DNA, 243 bp, Homo sapiens
taactcctcatcctttccctcctggtaatgctgtaaaactattaccatggatcacagtaccaaggactcccgaacacagtcgtgagagtgaagcctgtgaactagccgcgcctccctatcgatactggcactgtgctgagcataactaaagagaccaggaagctgacacacttggcgcccaaaaatatttcgtcctattgttggaggaagaggctcatatcccacctggatgagcactttcac

SEQ ID NO: 725578 - DNA, 279 bp, Homo sapiens
ttaagggcaccagggaaagaattacctttattaaggagtctaggcatgtcaaaaaaacccagttcagtcacagaaaggggggcaaatatgggtacagagcaagaatccaggggtgaaaataaaacctccatctaaatatcctaacagaaaggcggctgaatttagcccaggtgaaacttctgaaagctccgggggaaatgagatttgggcataaagagagagctctccagcacggcgtgcatctgagcttctataataaagtgacaggtctgggccagc

SEQ ID NO: 725579 - DNA, 1188 bp, Homo sapiens
  misc_feature (277)..(277): n is a, c, g, or t
  misc_feature (310)..(310): n is a, c, g, or t
  misc_feature (349)..(349): n is a, c, g, or t
  misc_feature (372)..(372): n is a, c, g, or t
  misc_feature (376)..(376): n is a, c, g, or t
  misc_feature (429)..(429): n is a, c, g, or t
  misc_feature (445)..(445): n is a, c, g, or t
attggttggggtcagataagaagaggagtgacaatcaagccaacagtagatgatgactgaagaataccagttaaataatacattcggatggattggaagttggaattcctcttaacaaccaaggggtttattttcaaagcaatattggggaattgatttcacagttcgttaccttagtaggtaacggtaaggttattctctttttttttttttttttttgggttatgaaaacttagggactaaaattaattataaaaatgggcataagtgtgggatntgaatctacattttgggcagaagttaaacattncccacataagtgtcaaaattatacattcagtgcagtccnggttttttgggttggtttaattntggntttgggttttggagtctgggctctgtcacccaggctgggagtgcaggggcgtngatctgcaacctctgncccccggggttcaagcgattctccgtgcctcagcctcccgagtagctgagattacgggtgcgcgccaccacactgggctaatttggggtatatataagtagagacggggttccagcatgtgggctaggccggtctctccgtgacctcaggggtgatcagcccacctcggctcaacaaagtgcggggatcacgggcgtgagccactttgcccagcccactatcatacagtctggaatatgaaattttggccaaaaccagccttggctgtagcacacacttttttcactgaacctgttggaaataaagtttgtaccttttccaaaaaaaaaaaacaacaaaacgacagtaaaaaagacaagagaaaaagacgaaaaaacaaaaaagaggggggggcgcgccaaataaaagataacccccaggagggagagccaacaatattgcagcagacagcaaattttgttagaaaaggagggcgccaaaaagggggggcgatatataaaagagcagcaacagcgcgcgtgattaaacacaggcgggggggcggcgagaacacggcaaccagggacacctatggggaacaggaccaacacacggggggggggacaaaatgggaggaacaaccccccacgcaagaatataaacccccccgggggaaacataacactagacagatgcatggggcgcaaacaacagcaacataccggtgcggagaaaaaaggcccacacggattatgaacaactag

SEQ ID NO: 725580 - DNA, 204 bp, Homo sapiens
ctgcttaaatacactcgtattaatccaaaaatcccaccacatttctaaataatacatgtgggctggacgcagtggctcacacctgtaatctcaatagtttaggaggccaaggtgggcagatcacttgaggccaggagttggagaccagcctgggcaacatggcgaaaccccatctctaccaaaaatacaaaaaattagtcgacg

SEQ ID NO: 725581 - DNA, 505 bp, Homo sapiens
ccccccccccccctttttgggggccgaaagggaagacccccccccccccttttttaaaaaaaaagggggtttttttttttcccctaaaaaggggtggggacttttcaaaatccccaagggggtctttttaaaaaaggccccccagggggggggggggctcctgtaaaagcccccccccccttttttttaaaaaaaattcccccctttttttgccttttaagggggttggggggaaaaaaaaaaaagggccccccctcccaagctttttttcccgggggggggttgcctgttttaaaaaagggttgtttaaaagggccattcccaaacccgtttggaaaggccgattttttcccctgaaaattttttgaaaaaccccaaggggggggggtttttaaaaattttaaaaaaacttcctttttgggggtcctttaaaagggggcaaaggcccccccggggcttaaaggttttgtttgatttttttttaaaaaaaaccccttttttttta

SEQ ID NO: 725582 - DNA, 1257 bp, Homo sapiens
tggctccagtggagacacgtgtgtggacggatgctggtggacttctcctgcgtgaatgcggacgtctgtcagggacatcggcgaagaacactttaacaccaatccgggagggtggtcactgaggattcgggacaaggccacaacgcaggcggactcgcgtgtcctgccctacgagactgcggttcaaggagcccttaccggagatacgtgcggttggtgactgaggttttcgaagaaagacaggagactacctccatgcctctctgccacggatcatcgcaagtgcttgcaactcacataccagattggaagcacgagttagttgcggtgctgtctctacctcaatagacaagaatcacgagaaggttgaaggtgagctcatcggattcgaggcgcccagaaacaacctctgctacatttctgggtttccatctagccctgacaagcctagaaacacctaaaagataacagacacatataggacactcagactgtgtgagcctgagaacctgggagattatagtatccttacatagttactaggagaaaaccctttgacccaacatcgatcatgacactgcaggaaggctgctgacttgacagtaggtgagtgactgttccaagtgagtgaggacggacggcggaagaaacacggggtttgaagagcgagactgatgactggactgaacagcggggggtgggctggataacccgtagtaacgcatccaggcagagtcgaggcaggaaccctggagcccatggggagcgtcccggagggaccttccgggatgggccggcaagaacccaggagcttctgccattgcaacaagttgccggacgcacatcgcggtgcagcacatgctaggcggacacaggacggcagacatggagggcccgaggacagactagtggcacgacaacgacgggcaaacaacaggccgtacctggtgaccgaggtcgctccccacgggggagcacaaactcatgaaaaggggctccccgcaacagcaacgagggcccacactacgcgtcccagcccacaaggagggaccccgagcgacagcgacacacaacaagagggacgagggcaacgcccaaggagcagcaccaggacatcacgaccaggaaacgcacccgcacgcagcgacgaagaacggaacgacgcacgcgacgagcaccgcacgacacgcacccccccctgccgtccaacgtatcgctccatacgtcgaagcaccagagagcaggagcaggaggtgg

SEQ ID NO: 725583 - DNA, 151 bp, Homo sapiens
cgtgcagtggctgagttactgatgcaagcaagcatagagcccattatgctttggagtaatcttgagggataaagagcttttgtcctgatagctgaaacttcccattaatgtgtccaatgaatacttgtgcttggttgggttagatgtcttg

SEQ ID NO: 725584 - DNA, 322 bp, Homo sapiens
tcaagctaggtaactgggtctacaactggggcctaagtgtgggagctgtatctcgcgtctataatcccagcagtttgagaggacgaggcagtggatctcttgaggtctgaagttcaagaccagcctggccaacatggtgaaaccccatctctactaaaaatacaaaaattaggtgggtgttgtggtggatgcccgtaatcgccacctactcaagaggctgaggcaaggaatcacttgaacccaggggggtgaaaatcgcagtgaaccaagattgcgccactgcactatatcctgggcaacagagcgagactctgtctcaaac

SEQ ID NO: 725585 - DNA, 113 bp, Homo sapiens
  misc_feature (20)..(20): n is a, c, g, or t
aacccggggaaccggggaanttttcacgttcacacactttgtgcagatgagagccaaaaatttgatctttaataagtcctttttcttgcagagttttcagggaaggtcttcgg

SEQ ID NO: 725586 - DNA, 369 bp, Homo sapiens
  misc_feature (157)..(157): n is a, c, g, or t
  misc_feature (199)..(199): n is a, c, g, or t
  misc_feature (245)..(245): n is a, c, g, or t
  misc_feature (255)..(255): n is a, c, g, or t
  misc_feature (326)..(326): n is a, c, g, or t
  misc_feature (334)..(334): n is a, c, g, or t
  misc_feature (360)..(360): n is a, c, g, or t
gtgtgctcgtcaagagattcgccatgccagattcgggcgctcccatcttgcgcaagttggtcacgtggtcacccaattctttgatggctttcacctgtctcattcaggtaactgtgtctcagatgaagtcacacaaagtgggggtcatttttgtcangtggccatgtttgtgcgagttccatgtagtgaccagattcancatttttttccaaagtgtaatgcacactcacattgcattcagcccngctctcccangtcatcacagtctgtgtttcttggatatccgtgaaggacagattcgcgccacctcgcttggttctgcagcnttcatcangtttctcacgcatgttccctctcctncatgagata

SEQ ID NO: 725587 - DNA, 191 bp, Homo sapiens
actatttaaaaatgtgtgcggtatggtgaatatacactaggatttagctcgagactgcgtttttttaagatgtactaaacacatgtgtgtgctttgctgtgtctcccccttggcgggtgcgtacctgggctgattaaccacgggtttcttccttttgggttccccaacacctgcacctgcgaagtgctggg

SEQ ID NO: 725588 - DNA, 241 bp, Homo sapiens
tcaggggcgagctgcagctcgcgagctgcttcttcagaagcaatacgccgccgttgtgctgcaggacacgtggagtaacaagacgctgaatcttgaggtgctttggtcctaggtttcttaccttctttatttaagggctttcttacaacatactggcggacctcatcttctttagaagagattgaaaagtttgcggattctgctagctctttcggggcccaggcagctcgcccctgaggga

SEQ ID NO: 725589 - DNA, 126 bp, Homo sapiens
gcagctgaaattgccatctgttctctgctcaagccaatgggggaggcctggggagatggcaccatacatcccagaactgtaggtcatttcctttctagagggcacctctcagccgtaggtcgacgc

SEQ ID NO: 725590 - DNA, 411 bp, Homo sapiens
tatattcagcctttaggatggctgctagtaaaaaatcaaagtacaggtgtggcaagaatgtagaggaattggaacctttatgtattgctggtggcaatgtaaaatggtgcattcactgtggaaaacagtatcgtggttcctcaaaaaaattaaatgtagaattatgatacaactgtttcacttctgagtgtatattcaagacaattgacagcagcgacttgagcagctatttgtacacctagctaattttttaaaaattttagagagatggggtcttgctatgttgcccaggctggtctagaattggcctcaagccatccccctgccttggcctgccaaagtgctggaattacagacatgagctgctgtgcccagccaacactgtattatgtatattttactacagatttt

SEQ ID NO: 725591 - DNA, 939 bp, Homo sapiens
gaagcttttacatcagagcactggcttgtcaggatatataaagtgaaagcacctgacaacagggagacactaggtcacaaacctcgagtcaccaacatcgtccccaaacagaagtattgtcaaagaagactactaaaaggaagcgtggctacgttaaaaataagctagtgtttaagaaaggcaagaagacctctaagaagactgtttaaatgcgctgttctggcctcacttgcagcagtccttgagagaaccggtctttgccttctgctcatgtcctgtttcacagcaccaagggtacagaacatcgctgggccaagtcaatgtacaaaatgttctggcaatgcctcatttaaaattaaattggtttattgagaacagctgtttctgatgtgtaacgtgaagcaagacagagccctgctgtgagcagctggcagaagattttttttttttaattattgggtacatattacccttcaaatctgagaattgggactaatggcaccaaagaaccctctaattggtccctggcacatgcgtacctgtcaactttttttcttttacaagacctgcattttatttgaactacccaaatagcaatatgtaagacagaaatgcgatgtgatgagagcttcttgaccagtaaacaaactagccaggtctgagagagacgtgctaaaggaagctacgtcgggagcctattacgtcccggcctccggggtgaaaaggtcctccatgtcccgtggcgcactgcgggaagaaacgcgtgggggggccctcgggatagcgaacaggtgtgacggccgagaccgggagcgccccccggccccgaacagggttccagggaatccgggaaggaggcccaatcggggaggccagggctccaaatagagagggtccgcaagaagggacacgcggaacaactcagcatacgcagagcgg

SEQ ID NO: 725592 - DNA, 508 bp, Homo sapiens
  misc_feature (11)..(11): n is a, c, g, or t
  misc_feature (179)..(179): n is a, c, g, or t
gggaaagaganaggcccccgatatattgtttttaggccttttagaaaccatggagttgttcctttggccccataaatgcgaatctataaaaaaggtgatattgtagccctcaagggaatggggcctgttcaaaaaggaatgccccccaagtgtttccatggcaaaactggaaaagtttncaatgttccccaccacgctgttggcattgttgtaaacaaacaagttaagggcaaaattcttcccaaaaaaattaatgggggttttgagccccttaacccctttaaaagccgaaaaagcttccttaaacgtgtgaaggaaaatgttccaaaaaaaaaaaaacccaaaaaaaaagggtcctgggttcaattaaaggccccccctgctccccccaaaaaagccccctttttgaaaaccaatgggaaggagcctgagctgctggaacccattccctatgaattcatggcaaaaaaggggttaaaaaaaaaaaaaaaggccctttgggccccca

SEQ ID NO: 725593 - DNA, 163 bp, Homo sapiens
cgtagccacattcattgcataaggacaaagggtaggtcatgggctcatcagcactgcgtgtctgcacctgggtataggggcaggttcttcttcttgcatttgctgcactgggaagaggtcaggtggtgggtgccgccagtcttggccatctggtggctcacgg

SEQ ID NO: 725594 - DNA, 397 bp, Homo sapiens
tcatcctctgttacggttggcatcagtggtttacaaacagaaagttctgtttcgggcaatagtgatggagggggtgttgtaacaaaattggatcatctatatatagcaactggtgtgtgctgtgctgatagacaaagactaatgaatgaggaaaccaacgtaattgcctggcacattgactgtcatacttaccttctcttatttgagctgatgcttgaacagatgctctgactgtagaaaaacctgtcgataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtact

SEQ ID NO: 725595 - DNA, 155 bp, Homo sapiens
aacatatagaactcgagctggtacccgtcgacatggcacatgcattcgtgaccctgatctggcatatagcttcagaactgcagtggcgagtgtgcatctcttagttagctaccttaactgtccacccttacttactgtgtgttggcccttatgag

SEQ ID NO: 725596 - DNA, 241 bp, Homo sapiens
cacttcgcgatcactgtctgttgatggtctgaactgtgctcattccattctaccatcgggactgccagtgacggctgagtagtctccacgtgaggtagagatcagcacctataagttaggatatgtatttgtgaaactcctgatcgtctcttgccgtgggaaacttctacttggcctacctcctggtctctgacttctggaatgtggccggctgtcagttgcatcccatgaagaggtctca

SEQ ID NO: 725597 - DNA, 267 bp, Homo sapiens
  misc_feature (9)..(9): n is a, c, g, or t
  misc_feature (47)..(47): n is a, c, g, or t
  misc_feature (75)..(75): n is a, c, g, or t
gtgccttanaccctctcagcacgttgggaggcccaaggtgagtgganctgttgagtccccagagtttaagaccancctgggcaacatgcaaaatgccatttttactaaaaatacaaaaatgtagctgaatgtggtggcgcatgcctgtagtcctagctacccaggaggctgaggtgggaggatcatctaagcccaggaagttgaggctgcagtgagccatgataatgccacttgtatgccatcctgggcaatggaaatgagagaccc

SEQ ID NO: 725598 - DNA, 955 bp, Homo sapiens
tccaaaagggttcttaatggaacacccatttgggctaggcaatatcctcccccgtgccctctaatccaggctcaggtacccccaggggagttatcctcagaaaaggcaatttccccaagaaccaggagtaatgaaagatggggcaagaagggtaagggagacacgccggggaagagaggagggaaaatggaagagacaccaggggaaaagaggagagggccttagaagctgggacagcggagatggcgtttggtcctggcccacgcacccatatcctgtcccttctatcgaggtaattatccatctggccacccaacaaaccaccagaaccaagtgctacagctctgcggggggtacatgccaggcctgtccattgggtggtagtgccatcattaccggggcgcacaatggatagacgtaggagggctgggataccctatcctcgacggggaccaagagaaaaaaccaaaatcccagcaggatctggtcagcaaaggggagaccgctctttgatatacaaagaaacggggggcgaggggggggccaaccatggtagaaagcccaagagaagtagaaggccaagctcagaatgaaacgcaagagctagagacgccaagaagagcaacgagacgtcccgtgttggggaagtccaggggaatagcaactcgctatgaagcccaattatatagcgcccagtcgttctatacgagcatagtgacccaataaaatgtcctcctcggccccaagaggtgacctggacagaagtcccaaacacaggggtcctttcccaacacggggtggtcatccgggaaggtatttgcagcgaccagggagaattatcatcccccgggggattaaaaaagtaaatgggttggctacacgggggatcctagggtcctgtcgtagaacacccccggggaacagatcagggtgcttccaaggaaacacacagacg

SEQ ID NO: 725599 - DNA, 335 bp, Homo sapiens
  misc_feature (186)..(186): n is a, c, g, or t
  misc_feature (239)..(239): n is a, c, g, or t
cacccacggtcgtcctgtgtaggcttgttcctgcagcgtgcgccgtatgctcttgagtgtcaagacagccggacccccagggacagtggcgacaggacagcatgcgaacctatgaacgggaagccctgaagaaaaagtttacgcgagtccatgatgcggagtcctccgatgaagacggctatgacnggggtccggccaatgacctttgaccttctcgcaggctgccagctggttcctcntccttctcctaccctggggctgggactcagtttcccatacagaacccacaaccttacctccctccgcctggtctttaataaacagagtattttcac

SEQ ID NO: 725600 - DNA, 152 bp, Homo sapiens
ggtaaacccagcccatgatccctaacagggtccctctcagccctcctaatgaccgtccggcctagccatgtgatttcacttcacttacataacggttctaatattaggtctactaatccacacatcttacccatataccattgatgggcgcg

SEQ ID NO: 725601 - DNA, 290 bp, Homo sapiens
  misc_feature (30)..(30): n is a, c, g, or t
ccaacatggtgaaaccctgtctctactaanaatacaaaaattagccagatgtgttggcgcgtgcataatcccagctacttgggaggctgagacaggagaattccttgaacgggggaggtggatgttgcagtgagctgagatcgcaccactgcactccagcctagaaaacagagggagactgtctcaaaaaagaaaaaaaaatccaaatgttatcttttgaacatgtaatcaatataaaaaagttacccatgagattttttttgtaactccacaatttattttatttcttc

SEQ ID NO: 725602 - DNA, 613 bp, Homo sapiens
tggcaaggctctctacctatttcgttcacaatgtttcttcagtttcagcaccagcgggcatctgggtcacgatcccgcggcctcggggaagggcaactccggacagtgcctccaacagggagctctggcccgagctcgggtccccgatgacggcgagggctggcagggccaggtccggctccacacctagagcccgcagggagtcaaggaggtcgaggcaggggcgcaccttctcctcataggggctgcacgggtggtactcaaccaccgagccgggattgggctggggccacagtagcatctccattcagaaatagagggggggatgcagcagcgggatcagctttggcgaggtccgcttcggaaacaaccatcttccttcttggcaaagtaagctctaatatacgtcccttcaaataaacgtaaggtcaacaagttaaagggtatcacagagcggttctccggcacctcctgggaaggggggcgggagggcggcgtacttcactccagattgcagggagggggagtcttcctgtagcctccgacccagaaccgatctcctcgcagggtggccacagaatacaaagccctgagctgagtgacaggtgcgcga

SEQ ID NO: 725603 - DNA, 301 bp, Homo sapiens
  misc_feature (177)..(177): n is a, c, g, or t
  misc_feature (220)..(220): n is a, c, g, or t
  misc_feature (226)..(226): n is a, c, g, or t
  misc_feature (244)..(244): n is a, c, g, or t
  misc_feature (272)..(272): n is a, c, g, or t
agacggcgagtataccagatcacactcttcgaggactcacggcatagcagaactccagatgatacagatgcaaccaagtcagtgctctctcgggtactaactgcaacggagagactacaagatgataccctttttacccatgtctctctactattgctgcttattgttaaccctatnaacgccaacaatcattatgacaagatcttggctcatagtcgtntcaggngtcgggaccaaggcccanatgtctgtgcccttcaacagatttcggncaccaaaaagaaatacttcagcacttgta

SEQ ID NO: 725604 - DNA, 307 bp, Homo sapiens
cttaatcatgtccaaagctaatccctgagccaaaaaaaccgccaaaaaaaccctaatttttgcctaaggggaaacccaaaaaaaaaaaacccccaaaaaatccctaacttttcccaaaactaaaccccaaaaaaaaaaaaccccctaaaaattccatattcttttccaaactttatccccgaaaaaaaaaaccccctaaaaaaatccttatttttttctaaagttaaccccaaaaaaaaaaaccctcccaaaaaatctcttttttttccctaaaggtaatccaaaaatcaaaaacttcctttaaata

SEQ ID NO: 725605 - DNA, 1043 bp, Homo sapiens
ggagggacggtgcaggcgcagcagtattgggtattggctggcctcgatttaaagagacagaagctgtcggggtcctggaagacggtccccaataccctaccccccaagtccttgggaccacttagggtaccccagagctaggggagataggtattagtaggcggctttcgcctagctccaagaatagctgctttagcgctctacaacgtaggtactacatagctggtagagcttgtttgctacatatgcgacgtagggctgctataggggcaacaggagcctaagagagtactaagagtagtacccacgcaataccaacatacatactgagcaggaagtaccatatagctaagtaagagagaagtactatacctatactacctataatataagccatgtaagagctaggcactaaggtaggtcgtagctaggtacaagcacaagcaacctaaagtacctagcctagttacacctaagacatcagcactagcatacattcctatgagtattagcgtgctatcatactttaccaactatttgtaaatacttctatagctacatagtctaaggcctatttaaaccgaacgcaaacatgaacacggaattggtccaggtccacataggcgtttcttttgcgctggaggttcactagaggccaaacaaagaactccggggcactgcacactggggaacaggacacgttctcggacttggctcggtggggctttataacaaaacccgtacagcgagccctgggtagttcatacaccgaatatacatgcatttcctggccgcttgagaaacttggcaaaaggctagaagtacccaagattgcccagaactgtggtggcagcaaagcgttcttaaggcgtttcagacggaaggccctgcagaaatccctcgcgggtgctgggcactacatttcgataaggattccgggcgaaccagcggagtatagggatcgcacgtgatggtgcggacatcggcaggatactgtaaagccactcggcgggctacgaattaacatgcggcctcgcggacat

SEQ ID NO: 725606 - DNA, 255 bp, Homo sapiens
tttcaactctctgcaccatttttgtggtcctcatcaggctcatccatttcatgagcaagcacttacctcttctcatctattcacatgctctcaccttctcttccaaacctggtcacacagtttcaatgcaactcagcatgtgtcatggtggcagcagcagtttgtcatgggctttgcatttcagcagtcagcaccacccacatttccaatcctggttcccagcacaatctccaagggggcatcctctcagcagtc

SEQ ID NO: 725607 - DNA, 158 bp, Homo sapiens
ctacaacctggctgtacctaccgacgggctactgtaggctgacttgaccgacgtactgcactgacgcgactattacgtgtctgtctgtctgtacggaacgactggactgcttgttactaacttactagccccactacggactacgtacacacggacac

SEQ ID NO: 725608 - DNA, 118 bp, Homo sapiens
gaattctgtgactgccgcggacacggccctatactactgtgcgagagaagtcagagataactatatcgaccacggtattgatgtctggggccaaggaacaatggtcaccgtctcttca

SEQ ID NO: 725609 - DNA, 388 bp, Homo sapiens
atgtgcgaagaacgtcagcggatgtcagaggggtgcttgggtaacctctgggactcagaagtgaatgggggctattcctagattttattgctatagccattatgattatataatgatgagtattgattggtagtatatggttatgagttcattagtccaggagacgtatatttgttgaagacggatagctacttagaacggattatggactgcggattgcttgccgtgaggaacctacttgactggcacgcttctgtgcgaccgagggtttatttcttttggttagaactggaaataaaagactagcatgtttatattctacggcctcactcaggtaaaccaatcagtgcgacgcttagcgcttgtgacgacgtgcccacgcgggatc

SEQ ID NO: 725610 - DNA, 137 bp, Homo sapiens
ccgtcaaagctgcctggaatccatgcaggaataaatggcggcttactcagggcgtggtcacgctccttccacctgtgggaagagaatccatagtggaaaatcatttcgtgctgcaacgcgacacacatacgtacatc

SEQ ID NO: 725611 - DNA, 113 bp, Homo sapiens
tggtgacagtggaaaatgctaatgaataatggtggcaataatgacaatagtgatggtgatggtggtggtgatgatgatgatgacgaagtgaggtgatggtggtggtgacgaga

SEQ ID NO: 725612 - DNA, 131 bp, Homo sapiens
ggtcatagaaagtgaaagaaagtgaggcctatattcagagttcagcaagataacaagccttacaaccaatgacaggagcttaagggaaaatatgacattccaaaataagagagcctcattatacctgagga

SEQ ID NO: 725613 - DNA, 212 bp, Homo sapiens
atctactacccagaacctagcagatagatgcaaccaacaaaaggccgcaggggaatgtgttgccacataaatccccaagtatgccaacattacacaaaagataggttattcatcataattgaattatccacaaacctccccaatcacaagtcttataagtggaagtaaacaatcacattattacagatctcaaacatgtcttcaacaattta

SEQ ID NO: 725614 - DNA, 287 bp, Homo sapiens
ggccagagtcaacagtgcacgctcctactttgggcagtcgctttacattttggggactcccttgcctgatatcacagtatagaatgttgaactagattattcccaagattttctaatccctgagaccttcgattctgatccctgaattatctgagacaagtctcagttaatttagaaagtgtattttgccaaggctgaggactcatgcccatgacacatcctcaggaggtcctgacgacatgtgctccaggtggtcatagcttttttttgtttatacattctttggg

SEQ ID NO: 725615 - DNA, 306 bp, Homo sapiens
ttttaaaataacatgtacatttatttcctcattcactcagtgctattttatccaatatataggctttatatttttctcatctatctatacttctccaatacttgtcttagcttgtcttcattttctatctgaaactcttgacaatattttcattttctatcttgtttctatcttccaattttcttctaagtttgtacattttgcccttagctttttgtttcctagctagtcttttttcttctgcttcctacttttcaggtttaaatttatcttttttcttctaaaagtatgtttttatcttctaat

SEQ ID NO: 725616 - DNA, 113 bp, Homo sapiens
ctcgattgctcttagctagtgtccgtggggcccgaagcgattgactttgaaaaatattagagtgtacaacagcatggcccagagccgtcctggatatccgcagtctaaggaat

SEQ ID NO: 725617 - DNA, 302 bp, Homo sapiens
tggaagcaagtgaggatcacttgaggcaggatttgagaccagcctggcaacataggagacctatacctacaaaaatttttttttaattagctaggcatggtggtgcgcacatatggtcccagctactcaggaggctgagatgtaaggattgcttgaacccaagaagttgaggttggactgagccatgattgtgccactgtgctccagcctgggagacaaagtgagatcctgtcacaaaaaataaaaaattttacaaaagggacatctactatgtgctaattgtgcgtgttggggataacata

SEQ ID NO: 725618 - DNA, 211 bp, Homo sapiens
tggtgcatgctgtatccagaggatcccacctacagcgcctatatagagggcagttattatttgtctcagagtgggcagtgctgagtggatgggatgctgagtgagcaacatccccccaggccccaaggacacacacactattgtcctatcccatgtggccatggctcgagggagctgaaccagcagaagtggagatggagtgctcacaact

SEQ ID NO: 725619 - DNA, 1202 bp, Homo sapiens
gattcatgttcagccgtggtgctggggtgagctggtacccaaggggccggggcgccgcggtccgcaggaagaggcgcggggttgcatggacttgtaaagcatactaagcattacaaacactggcttccagacagaagctcctgggtcatacctggactacacacggaagccaggacggacacacctggacgacgcggtcacctcccatgatacgaactgctcactgacggcgtagcgcttggcgagttacacggtgcactcggatctgccgcgggacccttggccatggaaacacacagacaccacaagatacccaccgggccgataagacaccgacggcaactggctgggactccacctcccggcctcccatggcacctgccccacaggccccctcggcacacggacttgcccacacaacacatacaaggcaccgcgcgcaccaccacgtacctggcaactgacttgacgctggcgatatcccataaccgccaccgtaggacggcggcttaacacctaccctgggcggcccgcgcaccatacccacgccacaccctaccgtaacgttccgtcggaaccggcgctaccctcggacccttggcctctggctgggcacaccgcggcaacgcaatacacccctggcacaaacgcggcaccgcccaccgccgcaacaacccaccccccggagcaacccgccagcacacaccctgggaaaccccgcacacccgtgccccacacatccatggatagccccacgcgcggagttctcccgtaacccttggccataccagggggcacccggcgagccactcccgctgggcaaccaccacctcaaccgccgcatcaccccgcccgccacccaccccccccacaacccggaacaacgccgaaaacgaagacgcagcccccccccgatcacaaaggggcctgaaaccgaggcacaccaacccccctgggagatgggcaaccctgggcgacacgggtctccaagtagcaacagccacccccgcaacacgcgccccgggggaacggcaaacctccccgcggggatcgggggcgacaccataggaaagacaaccagaggccccactgggcaacgtccccgggacgaaaccaccaccgagccaccggcgcgcatgcaccccacgggcgcgcgaccccacaccggcgcctcgccgcgcaccagacactatcacacccca

SEQ ID NO: 725620 - DNA, 740 bp, Homo sapiens
  misc_feature (35)..(35): n is a, c, g, or t
  misc_feature (109)..(109): n is a, c, g, or t
  misc_feature (118)..(118): n is a, c, g, or t
  misc_feature (150)..(151): n is a, c, g, or t
  misc_feature (161)..(161): n is a, c, g, or t
  misc_feature (167)..(167): n is a, c, g, or t
  misc_feature (181)..(181): n is a, c, g, or t
  misc_feature (203)..(203): n is a, c, g, or t
  misc_feature (207)..(207): n is a, c, g, or t
  misc_feature (228)..(228): n is a, c, g, or t
  misc_feature (252)..(252): n is a, c, g, or t
  misc_feature (294)..(294): n is a, c, g, or t
  misc_feature (329)..(332): n is a, c, g, or t
  misc_feature (336)..(336): n is a, c, g, or t
  misc_feature (339)..(340): n is a, c, g, or t
  misc_feature (361)..(361): n is a, c, g, or t
  misc_feature (423)..(423): n is a, c, g, or t
  misc_feature (434)..(434): n is a, c, g, or t
  misc_feature (460)..(460): n is a, c, g, or t
  misc_feature (485)..(485): n is a, c, g, or t
  misc_feature (491)..(491): n is a, c, g, or t
  misc_feature (501)..(501): n is a, c, g, or t
  misc_feature (645)..(645): n is a, c, g, or t
  misc_feature (698)..(698): n is a, c, g, or t
atgtcttacctgggcccccccctcccccccccagnctatggcggcgggacagccgggctgacaggccaaaggttgggggggtagggggatgtaaaagagttgggaacanagcccatcncccttgatgtactaatagctcccctccctttnnctgttgaccngttaancttagaccttaacntgccggatgtgggtagcgtttnatcnggttggtcctccctttccccnccgacgtagctccttcgggataanctggataccgaccccgcttcctgttcttccccttgcttttcntaactgttttgagtttaactggcttccccttaccnnnnctcnccnntcggtgagtggggccttttcnttcccctccccgccccccccctcccccccccccccctcccaccttgctgttatccccctttnggtcaataagnaaagcttttagtctcacccctaggtnatgcctgtcgaactggcttgtcacncacgcncttctctgcnagggggcgatgttggtgcaggagtgcagtgtttcgagggtgtgtgttccaagtatgtacaacacgcagcactgctgtatcaggtaaacatgtgcacaggggaagatgaggcgtgggctcatagaaagcagtcatatggaaatcnaaaggactttctctttcagagttcccctatctttatttgtagaggttatccantaatttctttaattacatcgcatacttctgagtccattcccg

SEQ ID NO: 725621 - DNA, 121 bp, Homo sapiens
  misc_feature (32)..(32): n is a, c, g, or t
  misc_feature (74)..(74): n is a, c, g, or t
  misc_feature (94)..(94): n is a, c, g, or t
tgaagcggcttcaaacccagggcggtgataancctgcccactgctgctgcttcctttccccttccttctctcancctccgctgtctcctattcnatccccactacacccccttgggaaatc

SEQ ID NO: 725622 - DNA, 273 bp, Homo sapiens
gggggaaattttaaaattttatttaatctaacatttaacttttaggtttttgtgggactcatctgaaaggttggcatttgttttctttttatgttaaaaatggattttagatgaatcaaaaatggggattcctagaaattttttttagggataaaaagatcattttatgttggcatttaaaaaaaatcatttttgttttattgttttgggtaaaccaaattcattggaccctggggggaaatttttgtttaaataaatgatttttatttttta

SEQ ID NO: 725623 - DNA, 715 bp, Homo sapiens
gaatgaggtttgagaatgattccctctgctatggaatgtggtccagacgtcaaccaggaacatgtaactggagagggacgaagaaagggtctgataaacgacagaggttttaacacagtccctaccattgggctgcattcctatgtatcacaagttgcaatacttcaaggtagcatacttaaagatcgtagagtcgaattaatgtcgttaggtaggctttatcgtttatagcttgaatccctctctcccgccttctttttggtctcagaggattagtatgtactaatatatgttctctgggctatggtcgtaggaataacttagagcgctggtattgcctcagctcgatcacataatgttgaagtggtggcagaaataacatatagagaagacggaccattctgaatgtagaaggattactctaaatggatttgcactcaagattggaataatcgttccaagtaatctggactcagtgattcttacagggaaaagggttgtaactgggggctggcttcagttggaaattccgaaggcatatctttggtagcgcaggttgtagaccgtgagataatgattagggtatggagatcccgaatgttggggactggtgtgaagcgtatcatacagattgttgataccaagggagccgttttgactaaggtaaaagggggaacgaggatccgggggaggaattgctgaagaagggttcgga

SEQ ID NO: 725624 - DNA, 862 bp, Homo sapiens
  misc_feature (29)..(29): n is a, c, g, or t
  misc_feature (62)..(62): n is a, c, g, or t
  misc_feature (91)..(91): n is a, c, g, or t
  misc_feature (100)..(100): n is a, c, g, or t
  misc_feature (107)..(107): n is a, c, g, or t
  misc_feature (126)..(126): n is a, c, g, or t
  misc_feature (129)..(130): n is a, c, g, or t
  misc_feature (138)..(138): n is a, c, g, or t
  misc_feature (165)..(165): n is a, c, g, or t
  misc_feature (176)..(176): n is a, c, g, or t
  misc_feature (186)..(186): n is a, c, g, or t
  misc_feature (197)..(197): n is a, c, g, or t
  misc_feature (218)..(218): n is a, c, g, or t
  misc_feature (221)..(222): n is a, c, g, or t
  misc_feature (241)..(241): n is a, c, g, or t
  misc_feature (248)..(248): n is a, c, g, or t
  misc_feature (250)..(250): n is a, c, g, or t
  misc_feature (253)..(253): n is a, c, g, or t
  misc_feature (265)..(265): n is a, c, g, or t
  misc_feature (268)..(269): n is a, c, g, or t
  misc_feature (288)..(288): n is a, c, g, or t
  misc_feature (359)..(359): n is a, c, g, or t
  misc_feature (361)..(363): n is a, c, g, or t
  misc_feature (405)..(405): n is a, c, g, or t
  misc_feature (494)..(494): n is a, c, g, or t
  misc_feature (498)..(498): n is a, c, g, or t
  misc_feature (743)..(743): n is a, c, g, or t
  misc_feature (857)..(857): n is a, c, g, or t
gggagggggaagaaaaggaggaacatgcnaaaaaccttatgacaatcatccaaatgtgaggnaagaacaaccgattcaccaactccacttnaacaatttnacaactntctacatctcactcttgantcnngccttccnggctgccacagcctggcagtccctagngcccctgggangagccctggntctccaaaagncagggggggagaagccctgcnggnngcgctgaccacttcccagngaactgncngtncgtgctcccaanggnntgaaccaacagcctaatgngaaaaggaactgcactggaaggggggggggggaatggtgatgggctgggcttatgtgagggtgtgtatatntnnntaagggagcgccagaatctttctctcagttacagcctcaggnaaaccacgttctggttggtgggttctgcagggatctctcccaccactgagcctctagtcccaaaaccatccttgacaacatcgtgtgtntgtnacttccctttgcccacctccaggccacctggggaagcccacaggcagccaagaccctgaaatgaaatgaacacaaagtctgactcggtaagtattagtttcaaacagaacactaaagagaaaagttgaagctgcaatgtgtgtttaaggcagagcccagcagatccgtgtccacccatgtgccaataagacaatgggcaaagctacaaatggcaagagaaaaatgggactattaatgcgtgtggnaaaggccttaatagttaagttacagctaagaatgtcatgtcttgggttagaattttcatttttagcaccgttaatgtattcacttaaatctatgttagcaccttgtctccaggnagaac

SEQ ID NO: 725625 - DNA, 466 bp, Homo sapiens
atccacccaaaaaaactggtgcttgttacccatgtgtatgtgtatgtacatgtgtgtgcatgtgcctgtgtgcacatgtgtccatgtatgcatgtgtgtgtctatatgtgcgtgtgcatctgtatgcacacgtgtgtgtgcaagtgtgtgtgtgtgtctgtgtttctacactgctccaccagcagcaggatgataactaaccttccttgaatgactttcagtttccacactggctaaagctctcaccccaaacacactctagatttttccctcccataggtttttacaatgtttctctcaaccattattaatttgaacaaacagcaggctgtcaagatttatgactcttaccatggctccaacccaatgcatcttgtattgattatttcctaaaatatctccaggcttgagtatataaaccactgcatggctccagcttcagctcacactgctgaagttattacca

SEQ ID NO: 725626 - DNA, 259 bp, Homo sapiens
  misc_feature (5)..(5): n is a, c, g, or t
  misc_feature (41)..(41): n is a, c, g, or t
  misc_feature (110)..(110): n is a, c, g, or t
tgtantcaatgacatggattaatagataattaaattatgcnaaatgggtacttatgctggtggttccagacaaacatgtggtcacatttctttttaatgaagcatatatnttgggcattactatttcaatgtttatttgtcattatgagttttatgttcacttgaggcagtgtttaatttaggttaaaaccttttcataatgtaaaatttgttgattcatttcatattgatacttaaaccaataaacctgaaatacatg

SEQ ID NO: 725627 - DNA, 232 bp, Homo sapiens
ctgccacgaagtgggaggcggcccgtgtggcggagcagctttatagcctacctgtgagggcctgtgcgtggagtggctccgcagatacctggtaaaacgggaatggagactgctgcagcgcgcggaccccccaaagacacatttgacccaccaccccatctctgaccatgaggccaccctgaggtgctgggccctgggcttctaccctgcggagatcacacttcgtgggcag

SEQ ID NO: 725628 - DNA, 186 bp, Homo sapiens
tcgagcgcaggttagcttagcctaatgatgatgtgttgtagccatggtaatactgctcagtactgagaggaacctgtaggtacagacatttggtgtatgtgcttgtgttgagtgagccaaatggggcgaagttacacatctgtgggattatgactgaacgcctctaagtcagaatcccgcccaggt

SEQ ID NO: 725629 - DNA, 445 bp, Homo sapiens
ggatcttatgtcatcccccttcgtcctcccagagtgttgggattacaggcgtcagccaccgtgaccggctcagactgtactcttctagccatctgaaatacgttttctaggtagagaatagattggtgtaagggtaccagttgtgaggataacagaaaacttggcagattatttaaaatcatcctgaaagtggtgctttatcttgatgaaacgtgatttgtaatccataggaaaattgtttcaacggtgcgcaaagagttgccggcggcgagcaggaggacttaccacaaagtgcaacagtaagggagcttcctaccctagcagttgcagagatcgttcacgtgctgatgcagatgtatgccacgtgcccttagactctctcaacattcaatttctcatgtgttggctttttcagatccccccttctgcaagaaaggctctttgc

SEQ ID NO: 725630 - DNA, 153 bp, Homo sapiens
atgatttatattatgcatatataaagtattttgtatgtgagcttgctacaccaagtggctacagtgacatgtgtgacatcatttccttgaactctgctaaaatatgcatttgtccacacatatggccttctgcagctaggcaagcagtcatat

SEQ ID NO: 725631 - DNA, 1019 bp, Homo sapiens
gaatatcttccgagtgcaaggagggaaacactggatccctatggcttgctcctagagatgggatggtccatgaatatcgtgaaatgttatcattggctgctcccacatgtgtgagcattggatctgatgaggtcggaaggaaatctcactctcagacctgaatacttagacggcaaagagtcccttgcacgaggtcggtggtatgttgtccgggcatgcccatggtgaccgtcctgacagacgcatcatttgttggcagtagaaggtaccactttacaagagaagcgcaaaggaccctagaggggatctgggcgcctcaggaccgctcttgagaatacggcctaccctagaatgtcatatactaaaggacatttcatcgtccagagaaatgcttctagtggcggattattccaggctttgtgatgacattaaatatcgggggtgaatttctataatgacgatggcgtgtttcaccgaaaggtaatggcttctgaataaggaacgcgcagtgttccaatgtgacagctgtaaggccattacagtttaaaggcaaatacgcagtaatgtacatggactagtaaaatctaatagaatgaagtattggttaagtcagaataagggagcgtatgattaaataattcaaaaagtggaggtaaaaagggtaaaagtgcagtggtggtcagtggctttcagtaaagaaagttaaaatacttgtctttgtgcaataaggtaacaggggatcttggaaggtgggaatcgtagggaaaatcattaggacccttggagatgaccaatggtcattagaaactcgatggaaaatatctgaggaaggaacacagtatgagaggggagaattttgagctggtagcatgtaggagatagagtaacagggatagaaaatcttagggagaagggaacaatggtaatttacgatacattaaaaaattcagataaaaaggaagggaaaaaaaaaaggttggagcaaggtgcataagtatagaaaggaaacagaggaatga

SEQ ID NO: 725632 - DNA, 381 bp, Homo sapiens
gctctagaggatcctaagctctggaaagggagaggagtctgttagagttggagggtggctctcacaagatggacggtaaaaggtggcactttattaaaaaggattaaggaggatttactcacaaaggaaaaaaagttaatctttttcttaagaggaaaaaaatactggtaatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgacca

SEQ ID NO: 725633 - DNA, 112 bp, Homo sapiens
  misc_feature (16)..(16): n is a, c, g, or t
ccagctgtgaagagantctgtttgcttgtgtttgtttgtttgcagtctctctctgccaatggttggcaaggtgctggaaggcagcttgtggaggcgttggttccgcccactc

SEQ ID NO: 725634 - DNA, 207 bp, Homo sapiens
aaaagccgctcgcaagagtgcgcccactatgggaggggtaacagaaacctcatcgttacaggcctggtactgtggcgctccgtggaaatatcgacgttatcagaagtccactgaaccttctgattcgcacacttcccttccagctgtctggtgcgagaatattgctacatgactttagaaacattatctagcgcatccagacgcgaa

SEQ ID NO: 725635 - DNA, 635 bp, Homo sapiens
aagcactttcttgtaagcaaggccctccttttaccaccaagtccacttaaagcgcattaaaaccccaagttatgtgaggtttcttataaaacgtcccctgacaaagtcacgtcacggtttaagcaaactttttttcatctcttgaaatccgactggtgtctgatattttgcacaagctacttttgatagtgaaaataaattctgccagagtctcattcaatcatatataaccgtccaagcacgatagggtgcttaccccgcatataaaccccatcgtttgattcttatgcgcatattctaacagcatattctcgccaacgccctgctcatgtgagactgtcaggccatagagcggcacccactagcacttgttgtgtgtggccttaattagaagatgcgcattactcgcttgtttgttaccacaataaaggtgctaactttgatttcgctaactggtcgttactaatcattttttcccagtcattgaacagcgatggaagtctctaagggacactagatgtacaggcccgaagaggaaattgggcgcctaatcggtaacgcttattttatacagtggacgcacagtacctttgtgagtggcgcttgactgcggcttcatcaatgatttaccttcc

SEQ ID NO: 725636 - DNA, 326 bp, Homo sapiens
  misc_feature (105)..(105): n is a, c, g, or t
aactaacacagtggcacaagattagaaatgacggctcaggagtcatgcagccaaaggctcgagatcatgaacctccccaatgctcctgtagataatattattatngtaaaacctaacatgggtgtttgaggtatttttcagaccctgccttctgatggatcagctggcaccacccagaccaataaactggctcatctggtcttctggcccccacccaggaaccaactcagtgcaagaggatagcttcaactccttatgatttcatccccgaaccaaccaatcagcattcccgcttcccgagccccctgccagcacaagaaccaacg

SEQ ID NO: 725637 - DNA, 342 bp, Homo sapiens
gttttttgagatgggagtgcgctcttgtcgcccaggctggagtgcagtagcgcgatgtcggctcactgcaatcttcacctcccaggttcaaagctattctgctgctcagcctcataagtagctgggattacaggagcccaccaccacgcccggctaatttttgtccttttagtagagacggggtttcaccatgttggccaggctggtctcgaactccttacctcaggggatccgcccggctcagcctcccaaatgtgcttggggattacaggcgtgacgacttgtgcccggccagtttaaggcaattcttattagacctcctgcttactgatagatagcaga

SEQ ID NO: 725638 - DNA, 161 bp, Homo sapiens
aatcattctgatacagcctcatcaaaactgctctgtgaagttcttggcagggggagtgattgtatgaaaatgaaattttaaagtgacttcatcaaagggtcctgcttccctcactatagagccatcacttgtcaacaaaaacaagtaggcacaggcataaa

SEQ ID NO: 725639 - DNA, 531 bp, Homo sapiens
ggactcgatccatatctcctctacctcgggcttgcctcatcgctactattacatgcttgaccccacggcactcagccttaactgaacatgttgtcatgcagttgtgcattcgagctaaaatcgtatatgtcagatcgtcatctagtgtcaacctcacattcttcgtcgttgctttttccgtgttttaaacattctggttcctcagttttctcaaagaacgagaactttagacaagtagcaggacaagctacgccacagcaatgccaccaggcgacaatactatgaataagtcaggaggcctcctagaatgcagccaaataggaaactgttccaaacagaatcagtcttgcatacttctgctcagaaggctcctctcgctttggaaactggaatgaggatcaccaacaggatcctcattttacacaggggttatgagaggtacatcctctagcagagatgcttggtcattacctgtggtacatgagattaccgagcttaaagggaaaaaaaaccgatcttaatgttctccca

SEQ ID NO: 725640 - DNA, 1226 bp, Homo sapiens
cagcgggacctgcttcaccgagctgcagcgaagccggagaccctgggctggctccctctgcatgccccctgtgagcgggccatgccgccgcgggagctgagcgaggccgagcctgcaccggatccgggacctcgactcacctccctccgtcggaggcgtatattctgccaccccaagagctgtgggcagtcaaggttgcggtgactggttggagcagaagggccgcctgtatggagcaaatagctacgactacatcggtcgaccttatatgctgtgacaatgcggtacacgcactggatgcctgctaacactgagcgcgcagcattagacgcttgggaataatccaatatcgtccagtgcgaggcacacagtaccatttgggagtgcgacatagtgacggctaccggcgttgcggcaaatatgatggcatcaatgaggaaccaaccacgttgtcgaacaaggacgagaatatattaggaccccagaacagtctcaagtgaaccgcatttggggcgtagctcacggcgtgaataccccgaattgttagtatcacccgatgagaacaggttgccgtaaccaacgccagaccgaacacggcaaggacgcacaaaggcgtacgccgaattaccacaaacaagcacgtcaaaccaacggaatgacaaaccttgggtgcgttggcgccccggaaggaaaataccaacggcatagccagcaacagatagagccacaccaggaggatgcccagacccatatggttgccagtggcatatgcgctggcgcgcccacccaccaaggggagccagaacccccctatacgaaggaggagaacacagaatttagtaccaccacgcggtcacccgtaagatttacccaggccgtggcgaatcgcacacgggggtcgactcgcacaccggtcgggagcacgctgtgccctcccgcgcgagatggtccccccatagacgaaccacccacaagagaccgatccaagggggggatcgttgtgcaacacgcagagcacacggaatatccccaggacaggtcccactatccaatggcccttcacaccttcatgtaagtgagtgggctacaaaaagaccagcattagaaacagccaaatcgacagaacacacacttaccaacactacggaaccaggtacacctacacaggtacacctccgatagggcctaaatccccataccacagcgagtgacccggacactcacac

SEQ ID NO: 725641 - DNA, 577 bp, Homo sapiens
ggtgataagcgacgctcccaccttcgcctctaactcgctgccgccaccctgcccagtgtcctccggagtcccggacccgagcacgatgtggaaacgatggctggcgctctcgctggtgaccatcgtcctggtccacggcgaggaggaacctagaagcaaatccaagatctgcgccaatgtgttttgtggagctggcagggaatgtgccgtcacagagaagggggagcccacgtgcctctgcattgagcaatgcaaacctcacaagaggcctgtgtgtggcagtaatggcaagacctacctcaaccactgtgaacttcatagagatgcctgcctcactggatccaagatccaggttgattatgatgggcactgcaaagaaaagaagtctgcaagtccatctgccagcccagttgtctgctatcaagctaaccgcgatgagctccgacggcgcctcatccagtggctggaagctgagatcattccagatggctggttctctaaaggcagtaactacagtgagatcctagacaagtactttaagagctttgataatggcgactctcacctggactccagt

SEQ ID NO: 725642 - DNA, 103 bp, Homo sapiens
actgtgatagacaaataatcaaattgtcacgaactgcctgtaatgttaattagatcatgtggttatctggtgttgttttcctcatatttttgtgcttggagtt

SEQ ID NO: 725643 - DNA, 168 bp, Homo sapiens
tgtaccctttacgctgatgtagaaaacagaggctaatggtaacaagacggtacggggaacatggtggttttgaaaccacatttgttctgatccttgacaagactctgcctgatgtgctgagtggggagacgggtcagtgacaacctgctggcctacatgcacatgcct

SEQ ID NO: 725644 - DNA, 231 bp, Homo sapiens
ccacgctattacttgatatacaactgagatcatgtaaatgcctgtaagttttaaattctgcctacgattgaaggatctgccacaaaacaatcttccctgttctagaaggagaagactttactctacagaattctgccgagtgttacaaacacaagtgagaagaatctttgtgaactctctagttctattaatactattgcaggggcccagctcaaacgttcagctatcttt

SEQ ID NO: 725645 - DNA, 663 bp, Homo sapiens
  misc_feature (1)..(1): n is a, c, g, or t
  misc_feature (114)..(115): n is a, c, g, or t
  misc_feature (117)..(118): n is a, c, g, or t
  misc_feature (150)..(150): n is a, c, g, or t
  misc_feature (193)..(193): n is a, c, g, or t
  misc_feature (203)..(203): n is a, c, g, or t
  misc_feature (235)..(235): n is a, c, g, or t
  misc_feature (245)..(245): n is a, c, g, or t
  misc_feature (248)..(249): n is a, c, g, or t
  misc_feature (278)..(278): n is a, c, g, or t
  misc_feature (315)..(315): n is a, c, g, or t
  misc_feature (339)..(339): n is a, c, g, or t
  misc_feature (343)..(343): n is a, c, g, or t
  misc_feature (391)..(391): n is a, c, g, or t
  misc_feature (394)..(394): n is a, c, g, or t
  misc_feature (449)..(449): n is a, c, g, or t
  misc_feature (454)..(454): n is a, c, g, or t
  misc_feature (520)..(520): n is a, c, g, or t
  misc_feature (556)..(557): n is a, c, g, or t
  misc_feature (561)..(561): n is a, c, g, or t
  misc_feature (567)..(567): n is a, c, g, or t
  misc_feature (597)..(597): n is a, c, g, or t
  misc_feature (660)..(660): n is a, c, g, or t
nttttttagagtttaattctttttcctttttaaaatgccacaggagccaaggttaagcgattcttttaacttaggaactgaccctctccaggcagagtctccaaagtatattanntnnaaatttcaaagaggcagttctacaagtatganccttttaagaagccaatcctgttttccattgttttgctttcanacacgggttnaacttgaactcttacctttctccatttataanaaccaaaatncannttaaaaaatcaaaggctgggagcggtggntcatgcctgtaatcccggcatttagggaggccaaggngggttgatcacctgaagtcagganttcnataccagcctgaccaatatggtgaaacccccatctctactaaaaatanaanaatttttagcggcgggtgcctgtaatcccagctactcaggaggctgaggcggganaatcncttgaacccgggaggcggaggatgcagtgagattgcgccactgctactccagcctgggtgacacancgagtactttctcagaaaaaaaaaaaaaaaaatttnnttgnatggcntctgtggaagcaaatcttgatttaggggcncacaacctgagactccacccgctcaggatagacagacaggaaagccaaacgctctctggggancac

SEQ ID NO: 725646 - DNA, 179 bp, Homo sapiens
gtgaactacaagttgaagtcagtggcacatctgccctggaagccttcactacaagctttcacacctccattgatgacgtctttgccttcatcataaccatgcccacgtcttaccgcctggcctgctttccgggacgacgtggtgtttcttggtctacctgtaccaccggtggctttatc

SEQ ID NO: 725647 - DNA, 422 bp, Homo sapiens
tgtctgtttcatccataactcagccactggtggaacaaatctcataatcaagaggatcatagtccctggtaagtggatccctggagcattggcaccatgttttccagtaaagtctatctagctgtcagggaagagccacctgccctctgcaaagggagagggaaaatcaaaacccaggaaagggaatatgtttctgctccaaaaccaccagcttctgcctgtccccttcactctttctagatcattctttagacaatacactaacaatgaacaatctgaaaggaagttaaggaaagaatttcaattcacattaacatcaaaaggaataaaatattttggaataagtttaaccaaaaaggtcaaatgattataccttgaaaactacaaaacattgctgaaagaaattaaagacgatatcaata

SEQ ID NO: 725648 - DNA, 265 bp, Homo sapiens
tcgaaccgagctgtgtaccctagttttagaagtttcaatagcatctttatggtttcactggtgcaaaaaaaaaaatcataatggggatgcatttccggctaaatttacaaggaaggggatacataaattatatagatcacaagttttcttttatactatttaaaacccaatttatatggactaaatatgtccagaaggacaacatggggttcttaaatgggatgggctggatgtccaaatactggcaaaatataggcttctgggt

SEQ ID NO: 725649 - DNA, 91 bp, Homo sapiens
gctccctcccaaacatctgtgttacttctgtgccagcagtgactcgacaaccggggagctgttttttggagaaggctctaggctgaccgta

SEQ ID NO: 725650 - DNA, 380 bp, Homo sapiens
  misc_feature (13)..(13): n is a, c, g, or t
  misc_feature (145)..(145): n is a, c, g, or t
agaggacaaaggnggggaggttaggagagagaggaggagagatagaaagtaggtaaagagaaaacaatggtccccatattccctttaaagcccccagggtaaatttaaaaccctataattgataattgaaggtcttctctgtganactctaacactccaatacccaccttgttgtaagtgtaaaccaaggcatagcccgaaagcactgaggccactgacaacccgtagccttcctatcaaaaatccttaacccagtaacccatggatggcccaagtgaattcaatctgtagcggcaactgctttggtagcagaagaaagtagaaaaataacttttagaagaaacctcattgtgagcacacctcgccagttcagaactagc

SEQ ID NO: 725651 - DNA, 861 bp, Homo sapiens
ccccccttacccctgttgatacactataccgccatctttttgcccaaatcctctctacaaggtgctcactctgttgtccccaagctccaatttccgcggcagctgtcaacccatttccctttaatggctgtttatccccgctatcttatcatgggttccccacccacccctgtatccgccgggtccgaaggctcctctaaaccccctcttgcttagaaaatatttatacaaaccgcttaataaatataaatatctctgtcccactgttggatggcaaagccaccacattgggcagcgaacataatcacgtccaccccagcccttctgagaagaaaattcttcaccaaggagcattttaatgaaaaaatccgtaacaagccttacttcccaaaagtttgcttgagcatcctccatgactcctgcaatattccacacctcgcggttcctgtaagaaccccaattattcattggtggaactttcctctcgcctaacaaagttctcaacacgcccactttatgtatagactcgcccctctaatctttaataacccactcaattaaatggcgggtaacaaacattcactacaaacatcttccaagtataagtaaatttcaaaatgcccaaccaatcatgctccaccaacaactcgccgcttcttgctattcttctttactaaataaagactttttattttcttatgacaaacccctccacaaccacaaaatttgccacacgcaaccaagaccacagacaagctttagctggcgagagaagccatctgtcaccgtcaatttcccggccccccccccacccgggttttggcccccaaaaagattgtggggtaaacaacccccaaaaca

SEQ ID NO: 725652 - DNA, 181 bp, Homo sapiens
  misc_feature (25)..(25): n is a, c, g, or t
gctgagtgacccttacaagtccttnttgatcctgaactgggttaggtgccgctgttgctgctcgtgttgaatctagaaccgtagccagacatgggacttggaggacgagcaaaagatgctttaccgaattccggagatcctcaggaggatcccctaacaacagtagagagcatgcgagcag

SEQ ID NO: 725653 - DNA, 1308 bp, Homo sapiens
gtctcccaccgctgtgctttcgtaggtttgttactttccttctttttactcctcgtctttgttctctctacagctttttgtcccttcgtgacgctaggcatcgtatctctgtgccgctcccgtgactcgtagccctgctgccccttttgcatgttcgtgtcatccacccggttttccctctcgggtgttgttgctatttattcccactccttgggtttcttaaacgcttgtctacactttccgtctttcccgtgccccgtgttattctgtactcgtggattactaccttacttagcttcgcgagtacattcatgctaccagtcaacgactcagttaatcaacgtatgtgatcacttctgtcaaacttctgtacacgtaatattcctgtatcaccctgtgtgattcacaccctgacagcgtggtaacaaacagcgtttccacaccaagtatatccctactttgaacctttgctcagcttcatgccagcatgtatatgactgaatgcatgtatgcaaagcagtgcatgcactccaatggctagtatgtatgcattggatcgcatgtattttggtatgcatggagcgatagcttgcaagacttctagctgctctagtgtcacagtatactcttatagtccgatgatatcttcgctatcgcccaatatttgctacctcaaaggtcagatattcagaaatggtcacagagacctgctaaaatcctattcattcacatcatcgcaacgagtcatataatggactaagaatgcgctttcaagtactatcatggttttaaacctcctcacaacagccacacaatggaacctagtggctgctagatacgacacttaaacgctaagatatgtcaatgcaacgtactagagtacacaggtggttctcttccccaagtggaagccaaattcatcaacttatgtgaagaacttgcttccggatgactgaaccaagaggcctattcaagactctctggcagtggaggaagctctctttaacgcaaatagtgttgaaaccatctgtgttggccacattttccgtgcttattcttcatgtttctcgtaacacgttgatgagtctcggctgtgccttgttctgataactagcagacgtcgaggaacctttccgctaccgtgtcttgatacaatgttggccaggttctattgctcaagaatgtgttgtccaaaactcgcctgtttagttttgaaacgactggcactccaccctttgcttggtctttaagtatgtatggaatgttatgataggacattgtgagtagcggtaaacagcagcatggaaa

SEQ ID NO: 725654 - DNA, 745 bp, Homo sapiens
aggcatcaccatgttaaacgacgctcagacgtttgtaagaaatggtttcctgtatgaaagcacatggcggttgaatcttaagggtgtaaagtttctaatattcgtaaagatcctctatgaattagagtagtttgatcgcaatttgttaacgttaagtggatataaaatggagcaatgacaacaaaatgtaggcttgtaaaactgacttgtttcattaacgtgggttttgaaatctagccccagacatactgtgttgacgagatacttagagggagggagtaggttttgaagaggattgatggtggctggggagggaaggcctcctgaagttgagtattgatgcagagctttatagccatgaagaatctttcagtcatagtaactaataatataaacgtttcagtatttaaaaagacaaagtattttgtccatatgagagtctgcactgacatgaaaagttcacgtatggacgctggggccgaaaagctgttgattttctctaagttgacggttgtcaatatgatcgaactgttcgccaagttagtcaagtatgtctcaacagcgtagcatgatatacatgagggacagcgtgcagactgaatgacaaaaggaactccaaatacagctctgtacataaagttaaagtcctaattggaattgtactagtcctcccagtttgttacgtcggaaagattaaatgctacatgtgtaagtctgctaaatacggagcttaaaataatcgttt

SEQ ID NO: 725655 - DNA, 374 bp, Homo sapiens
gcggaccgcacacgcgatagcccacacgccgaatacccaaactgcacacgccgaatctccaaacacatgagctaaaggtcgtagtggacgaagttgttgcgcaacaacttcgtccactacgatctgagggccgtatggttactcggcgtgtgcatgcacacgccgaaccaccacacacttcttaaaatcaagtcttaatggacgaagttgttgcgcacacgccgaacgtccatacctgtccaaggagatctcagtggacgaaggcaacaacttcgtccactcggatttcacgcgaacaacgccgcgagtatggtgcaacaacttcgtccaccacgacatgacttgaagaagtgtgtggagcctcggcgtgtgca

SEQ ID NO: 725656 - DNA, 200 bp, Homo sapiens
agcggtaccataattaatgttggcccactaaacaggagattctggatcaggttgtaggtcaaagttttagaaagggctccaagggttggtttagatcggttacttgcgttggttggttggttgctatgcttgctcgcattgcttgtttggttggtttgttgctatgcttgcttgtatggttgattagggttgacgtcatg

SEQ ID NO: 725657 - DNA, 407 bp, Homo sapiens
gacacgtgcatgtaccggccatgcccgggctaatttttggcatttttagtagagatggggtttcaccatctgggccagtcgggtcttgaactccgggtgtggtgatctgcccgcctgggcctcccaaagggctgggattacaggcatcagccaccgcgcccggcctcccctcggcttttggtatcccttcgaggctcacaattcccagagctctccttctgggtgatagaaaggggggccacggcctgaggtgtgatggcagacctctccttggactctttctctgcaattactggttccggggagaccgtcaacctcatggttttagtgtccagggggttcccggctcaaatcacttcttccgggaagtggcaaagaggtgatttttccagctggctcagacgggt

SEQ ID NO: 725658 - DNA, 117 bp, Homo sapiens
ccaacaggaggagagattcctttggcttaggtcctcactgtggagaaaatgagaataatggaggacctcaaaagccctcaacaccaagaaacttaacaacttataatggcaccacca

SEQ ID NO: 725659 - DNA, 622 bp, Homo sapiens
acatgacggtcctttgcctgtacttgtgccctggtacgaccggacccgcgagcctcttgcctcgacgtgaagtgcagagaggactttgccaagcggatctgtacaacaccgacggtccttcgatgcattgtcctccgggacagcgcgctggaccgggacctcgcctcctgcctcgacgtggacgaatgtcgcgagcgaggcccagccctgtgcgggtcgcagcgctgtgagaactctccccggctcctacgcgtgttgtccgggactggatcctggggtaccacagcgggccccgagggcacctgtgaccgatgtgggaatgagtgccaaagaatatggtcccgagatttgtggagccagacgttgatgagaacacccctggatcctagcgctgacaaaccagactgtgaacctgtgtatcaggcccaacgaccagggcggcgggatgcacaggaatgtgaaacgagtgttgaaaacactaccgggtgtatgtgaagctgccctgacgtgaaaaatggacgaaaggctccttccatctgatgtcttgcaccaaaagcccgaagaagtttgaacccacagaacttgacaggcagtgttcacccaagaaactttagctagaact

SEQ ID NO: 725660 - DNA, 326 bp, Homo sapiens
gcgcgttcagcgtctaacggcagccactgtctctaccaagccaagagattcaatggtgagggtaggtgaccggaacacggagtcagaggagggcggtaaggcggtgcacgaggttgaggtggccctcaagcacaaccggttcacaataggagacctattacttcgacaatcgccgtgctccggctcaagaaccccatcaccttccgcagtaacgtggcgcctgtctgcctcccctagacgtgactgggccgagatcacgctgattacgctcaacacggggattgtgagcggcttcaggcgcacccccaagaagggcccggggtcca

SEQ ID NO: 725661 - DNA, 820 bp, Homo sapiens
cgcggtggctcgtgcctgtaatcccagcactttgggaggctgaggcgggtggatcacgaggtcaggagatcgagaccatcctgcctaacatggggaaaccctgtctctactaaaaatacaaaaaattagccgggcgtggtggcgggcgctgtaatcccagctacttgggaggctgaggcaggagaatggcgtgaacccgggaggcggagcttgcagtgagcggagatcgcgccatgactccagcctgggcaaacagagggaaactccatctcaaaaaggaacaaaaaacaaaaaaaacgagcacacttagtgcccacatctgtggtttctaatactattctccaataaaagaaaccaggatcctctgggtgcggtggctcaccacctgtaatccagcactttttttggagggcgaggcgggcggatttaacccttggagggggttccccaaacgggaagggtttccgcggaaagggaaaactttaaagggcccctttggggggcgccccaaaaaaacaccagagttttgggggcgggttgtgggggaaaaaagagacagaccccgctccctcgctggtggttggtggtggtccccactcgctttttccccgttttttaagaacgggttttttttaaaaacagacgcaagaaccaagcagcagtttttttttaagacgcgcagagaaaccaatgggagtgacgaaggactcaccaaccatcgttttttttcatgaacgtggcgcccctcccccaagataggggcgggcgcccccccggggtgtatggtggggggagaagcaaatgttgggggggggccatt

SEQ ID NO: 725662 - DNA, 916 bp, Homo sapiens
  misc_feature (916)..(916): n is a, c, g, or t
tggaaccacgtcctcttcatactggtaacctctgctgccgagcgaggtgtgtcgccgagatgtaatcgggctggacacatggagacgagacgtagctggtgtgcgcttccagtgagagtaaggcaggcaggtggccagcatccatgtctggaacggaacatcatagcatcgcactgccacccgcaaacacgttgcgttaatgcgagtggactggctaggtgtctgaaattgctagtgcatcgcagcacacatcaccgcttcctcttcgagctcgtcgtagcgatgaatcgtagcagagcagcccgagtttgcattgagtgtgaggccttagaggtggtaggttgtgaatcaatccatacacatactgatcgtcagcatcgtggagggctccatcgcacacaagatattcctacactacatcgaccatcaaccagacgctctcgcgaggtttggcacaagcacattttttgtggcctagaggagacaaggccttgtggcagttactagatcctatgacggcagccatgcccagtagggtcactttggtgactccaattcggcgatactagtaacattgaggtaggacaatcacactcaagagccccgtggggtagtccactaaggttagaagtgagccatttgatgcgtcgacgttttaccacccattttgcagcgcatagagcacttcgaagcaaggcgaaccaaacacgcactgaaacaaaaacccaagttcgcgcattagcagaacccaaaaatacccggagttggggaagtatgagaagggggatagaacacatggtgccgcagagacatagtgtacaaaagtagcctatgccgccaaaaccaaatttcgcccagagggacacatggtaggtcgccactccggattcttcaggtgccgtctgagaagcagaan

SEQ ID NO: 725663 - DNA, 598 bp, Homo sapiens
cgaacatgtcgatggctattttttgtatttttagtagagatgggatttcaccatgttggccaggctggccttgaactcctgacctcaagtgatccacccgcctcggcctcctaaagtgctgggattataggtgtgagcctccgtgccgggcccacaaagagattttatcatgaatgaatgttgaatatttttcaaatggcttttttacatatatattgggatggtcatattatttttctttttttcttttctttttttttttttggagatggagtctcgctcagtcatccaggctggaattgcagtgactcctcagctcacggcagcgtctgtcccccgggttctcaagcagttctcctgccttagccacccaagtagctgggattataggcatgcagcaccatgcctggctagtttggtatttttagtaaagacagagtttgtccatctgggtcatgctggtctcaaactcccgagctcagatgatccgcccacagttgcccccgacattgtgggaattacaggcttgacccaccgtgcctgggcaaacaaaggcgtttctatgctagggcgtccttgtgcctttatctgggtgagc

SEQ ID NO: 725664 - DNA, 124 bp, Homo sapiens
  misc_feature (75)..(75): n is a, c, g, or t
cgcatatggaactatgttaaccttttttgaggagctgccagctgttcgaagtgacatcaccgattgtacatcccntagcagcagtataatgaggttttcagtttctcatccttgggagcaattc

SEQ ID NO: 725665 - DNA, 672 bp, Homo sapiens
tataatactgaccaccatctccgtctccagagctatgtatcttcccaagacgaaactctgtgcctgttaggcacgaactctccatctccctatccgcccagccgcgggcaccccgacatttgaattgttgtctcgggtgagtctgactccttttagagcctcgaatgagggaaccatacagtatttgtcctttggtgactggcctatttcacttagcacaaggtcctcagggttcatccatgtcgtagcttgtggcagaattttattccttttgaaggctgaatagcattctattgtatgaatggaccacctttgcctatccgctcgtctgcccaatgacacttgggttattgagaactatgccactatgaacatgggtgtgcaaacagagtgactcttttagaacacaggtcagtccgtgacagtcctctgttcaacccgggccttcctgttctctcagtggagaagcccaaagcctttatgatggtccccaggacctgtacaccccaccccatcacgtcctgcagccacactgagctcctgctcttgctcagacacatgggcacactgccgccttatggcacaggcacaggctgctctcctgtcccctctgcctggacacccttccccaggcggtcccatgctgtcctccaccaccctccagtgtttgcc

SEQ ID NO: 725666 - DNA, 117 bp, Homo sapiens
aggaccactacgcagtatcagacaacttatcagctatacgtgcaaagatgtatggcggatagagggttaatacgatgaataagggccatctctcagccaggacagcttactttttgc

SEQ ID NO: 725667 - DNA, 892 bp, Homo sapiens
atttaaaaaacattgaaataattaaaaagaatcaagtcagaaattctagagttgaaaaatgcacttgacatactgaagagtgcatcagagtctcttagtaacagaattgataaaacagaagaattagtgagcttgaagacaggctatttgaaaatgtaaagtcagaggagacagaaaaggaatactctaaaagaatgaagaacagctataatatctaggaaatagcctcaaaagggcaaacataagaattatgtccttaaagaggaggtagagaaagagataggggtaaaaagtttattcaaagtgataataccagagaacttctcaaacctagaaaaagatatcaacattcaagtgtaagaaggttatgaagcaccaagcgtatttaacccaatgaagactaactcaaggcatttaataatcaaaccagcaaaggccatacaagaaaagatcctaaaagcagcaagaacaaagaaacaaataacctacaatggagctctgataaatttggcagaagactgttcaatagaaattttacaggccaggagagagtggcatgacatgtttaaagtgctgaaggaaacaatttttgtatcctataagcagtatattcagggcaaataagcttcaaacacgaaggagacaatcaaaagctgtcccagagaacaaaaacagatggtttcatcaacaccagacttgtcctacaagaagtggtagatagagtcttcaggcccgaaagaaaagctgtgatcggcaccagaatttctgtgggccccacccactcgcggtaaaagacccgcccatggggctcggagggtggggtaaaacccactgttcaaccaaagaatgagcgggcggcacaacccggtggggccagtgtttgacacaacgg

SEQ ID NO: 725668 - DNA, 529 bp, Homo sapiens
  misc_feature (223)..(223): n is a, c, g, or t
  misc_feature (383)..(383): n is a, c, g, or t
  misc_feature (393)..(393): n is a, c, g, or t
  misc_feature (446)..(446): n is a, c, g, or t
  misc_feature (484)..(484): n is a, c, g, or t
  misc_feature (521)..(521): n is a, c, g, or t
tcagcaaagcatttgtattggtccattctcatgctgctaataaagacatacccgaggctgggtaatttataaaggaaaaaggtttaattgactcacagttcagcacagctggggagtcctcaggaaatttacaatcatggcagaaggcgaaggggaagcaaggcaccttcttcacaaggtgccaggaaggagaagtgcaagcagaggaaatggccgaggctancaaaaccatcagctctctgagactcactcattatcacaagaacagcatggggtaaacttcccccatgatttcaattacctccacttggtcccacttcttgacacatggtgattatgggagattattaatttcaagttgagttttgggccggaacacaggnttgatatccnttgaaaacctttttggtattaaattattacccttcatattgtcatatattctnaatttcggtgggggaatgcataatttacttccaatttnaaattgttttaaattttatttcttggttatttccctntttttcat

SEQ ID NO: 725669 - DNA, 198 bp, Homo sapiens
agggggtcccccccccctttttttttggaaaggagcccgggaaaagaaatttttccctttgaattccccttttttttttccccaaagggggtttaaaaagttttccccccggggttaaaaaaaaaaaaaaaaaggggggaaaattggaaaaccggggcgggccccccaaaaaattaaaaaaaaagggggggcccctta

SEQ ID NO: 725670 - DNA, 471 bp, Homo sapiens
ctcatttgagttctttgcagtatagtttttgtgttcatgtcttatttatatgatagacttaggcttccttaaggattgacatgatgttaaatgtatctttatattattcataatactttaaagtcttctccatctactaaattttcaattaaaatttgttgactcagctgggctcagtggcttacacctgtaatcccagcactttgggaggccaaggcggttggatcacctgagatcaggagttcgagaccagcctggccaacagggagaagccccgtctctactaaaaatacaaaaattagccaggcatggtggcaggtgcctgtaatcccagctacttgggaggctgaggcaggagaatcgcttaaaaccgggaggcagaggttgcagtgagccaagatcatgccactgcccttcagccttggcaacagagcaagactccatctccaaacaaacaaactgaaatgagcc

SEQ ID NO: 725671 - DNA, 316 bp, Homo sapiens
tttttttaaatttgtttatcttccttgtaaactctggatattagacctttgtcagatgaatagattgcaaaaatattcttccattctgtaaattgtctgttcactctgatgatagtttcatttgctgtgcagaagctcattagtttaattagatcccatttgtcaatttttgcttttattgaaattgcttttggtatttttgccatgaaagcatttttttttttttggctcacccattaaaacctatattggccatgctagcttaggtttttcctgtaaacagaccttagactatgtggaggcaggagagtcgacg

SEQ ID NO: 725672 - DNA, 448 bp, Homo sapiens
tggcttaggtgaacctagcttggtggccctggtggtgtttggggccctcactgctgcccctggttactggcctactgtgttgatgaccctgaagggcctggcgccggggtgtttgtcccccctgaaccctgttgctaacccgacccaaaactatgttccagcgtgtcaggaacccgagtgttcacgttagcaatgctgtcaaaggggctcccccccctacacgttgacttgccccctgagcctggaaagaccacagcactgtgatggaggtcgggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgc

SEQ ID NO: 725673 - DNA, 340 bp, Homo sapiens
  misc_feature (145)..(145): n is a, c, g, or t
gaggggggggggggggggcccccccccccgccggggttattttttggtttttttgtaaaggggggggttccccggggggggccgggggggtttttttcccccccaagggggttgggtggcccggggccccccaggggggggggangggggggtgacccccccccccgggccccaccccaattttttgggggggcaatttttttgggggaccccccttgggttttcccggggattttaaaaggggttttcccccccttagggaaaaaaagggggggtttaaaagggggtggggacccggttttgggggaggggttttttttaaaaaattttttttccccca

SEQ ID NO: 725674 - DNA, 708 bp, Homo sapiens
  misc_feature (270)..(270): n is a, c, g, or t
  misc_feature (284)..(285): n is a, c, g, or t
  misc_feature (305)..(305): n is a, c, g, or t
gaattatgtaggaggcaggggactgtgtgtaatttcagtatgatggacgtgctctgagctatgtgaattcagtgcgacgtgtgctcgtgcagtgtctgcacacccggtggctctggccccgccggtgcctgttggcccagcccgccggcccctgagctccgtgtagcccgccgctggaggagctgttcacccggtggcgggcccttgcggaccttcctcgatgcgccaggcggggtctgaagcccatttgaaggtcaggaggcccgagtngctggcggtgatcnnacgctgaacgagaaggagcnggagctgcgggagactgagcacttgctgcacgatgagaatgaagatttaaggaaacttgcagagaatgacatcactttgtgtccaaaagaaataactcagctgaagcatcagattatcttacttttggttccctcagaagaaacagatgcaacaatgattctgatccctggaagtaaactgcaggagttggaggtcagggaggcaagtgtcgtacacatcagagcattcatcggatatgtatcagcaaatatgctgccgtttaaaagatggcatctgagagcctggaatatttccaagtgaagctaggtggccttagacatgcatctgcaggcatagggggtccagaggctataggcactgacattcgacggaggtgtcacggagtacaaagagtgcaagaca

SEQ ID NO: 725675 - DNA, 379 bp, Homo sapiens
ggcgggtggatcacgaaatcaggagatcaagaccatcctggctaacacggtgaaaccccgtctctactaaaaatacaaaaaattagccgggcgtggtggtgggtgcctgtagtcccagctactctggagggtgaggcaagagaatggtgtgaacccgggaagcagagcttgcagtgagccaagatcgcgccactgtactccagccgggagacacggcaagactccgtctcaaaaaaaaaaaaaaaaaaaaaaataagcgggggaagggggggggggccccggggaatccccaggctaacctcagggagggagagagggatgggggcatacgggcgacttggaggccgggggggacagaggggagagactcaggctcctc

SEQ ID NO: 725676 - DNA, 846 bp, Homo sapiens
tagtgggagaagaagaaaagagtggagcgaaaggagtctaatgtgatagagcccacgaggggggggggcaggagagggcggctgacagagggggggcgccgcgacgcgcgcgccgccggctgggggaacgaggagaagcgagtgctaggggcccggccgccaaggacgccacaggggggctgggcagagaaacacggggaggggtgaggccgttcctccactatacaatagcatagcgaaaggggggagagcagagcgccagcaaggcgacaagccggaggacagccggggcgctgccgagagggaggcgccccaaggaggacgggaggcgccccgggcagccaagggagagtacacgtgggcaggggtgcaaccacacggggcgggaaagaagtggcgaaggaagtcaggcgcacctggagccgcatgtgggaaagaaaccaagggagtaaacggggcgggcgccctccctgtgagcacacagacgatggaagagttacatatgtggagggcgcgcacgctgccggacagaaagtagccgttcgtgcgcaatgcagggggggccggctggggaagacggttcaattcgcgcccgaagcggacagaccgaggagcgtccaccgggcagcacgactgcccgggagtggtgcagcctcctggcaggcagccccctcgtggcggcttggacggactcccatcccgcagaagagcaccactcgtgtcgaggccaccgtccggtccctccgggggacacaacacgggcgcacgccccatcagttctccaccgcgggagggccagtcccaatataaaaagaacgaggtcttaaggcggcccatcaaagacaa

SEQ ID NO: 725677 - DNA, 886 bp, Homo sapiens
ggacgaagcgaggaggctaagaaagtggtgaatcccctgtttgagaaaaggcctaagaatttaaggcattggacaggacatccagctccaaaagagacctcatcccgcttagtgaaatggccccgttatatctaggttgctaatggcagagagccatcctctatagaacgcgtgaaagctgcctccgtgcttgaattatagccaacgtttcagcgccacggtcgctgtggtagccgctcgagatcatgcgtatcgtcagcgtgctataagactggacccagcaatgtacaagaccagagacaagagcaagagaagaagcagagactgttggcccgggtgcgagaagaaggcttgctgtgcaatacgtgggacgtcccaacaatagagaccaccgtgtccttcgagcaggaagttaacactcgtcaccaccttggtggagaacaagaaagctcagtctggtggtgattgcagcacgtagctgtgggatcccatctgagactggttgtcttcttgcctgccctgtgtcgctaatatggcgggtcccttactgcccttatcaagggaaaggcaagactgggacgtctagtccacaggaagacctgcaccagtgtcgccttcacacaggtgaactcggatatgacaaagggcgcttgtgggctaaagcttggtggaagctatcaggaccaaattacaactgatcacgataccgattgagatccgccgtcactggggtgggatgtactgggtcctaagtctgtggctcgtatcggccagctcgaaagggcaaaggtaaaggaattgccacttaaactgggttaatgtccccgtggagtttctggccttaaaatacttggatcatcacactttctcttcaaaaaaagaaacg

SEQ ID NO: 725678 - DNA, 711 bp, Homo sapiens
cacgcgtcgctcatttttccaaccatatttacgctggtctgtgaagctgtgtattaggtttagttaggtgtagttttgttttgttttattattatactttaagttacagggtacagtgtgcacaacatgcaggtttgttacatatgtatacatgtgccatgttggtgtgctgcacccattaactcgtcatttacattaggtatatctcctaatgctttcccttccctctcccctcaccccacgataggcccccatgtgtgatgttccccttcctgtgtccaagtgttctcattgttcatttcccaccgtatgagtgagaacatgcagtgtttggttatttgttcttgcaatagtttgctgagaatgatggtttccagcattcatccatgtccctccaaaggacatgaactcatcatttttatggctgcatagtattccatggtgtatatgtgccacatttacttaatccagtctatcattgttggacatatgggtaggttccaagtctttgctatcgtgaatagtgccgcaataaacatacgtgtgcatgtgtctgtatagcagcatgatctcataatccttcgggtatatacccagtaatgggatcgctgggtcaaatggtatctctagttctagatccctgaggaatcgccacactgacttccacaatggttgaactactttacagtcccaccaacagtgtaacagtgt

SEQ ID NO: 725679 - DNA, 246 bp, Homo sapiens
gtgagggaaacctgggttgtttggctcaaagtgcccattgtacttgcctaattaaatttggcccaaaccggcttccatccatagggactgtgctctaacttaatgtgtcaatcagttgtaagctaatgtagatttatggacttgcaaccaagcaactgagagttaaccaatcataggagccaaaccctttaacaatcctaggctggatgctgccaaattatgcccacataaggcaaatatttaact

SEQ ID NO: 725680 - DNA, 903 bp, Homo sapiens
tacatgtaggtttatttctgggctgttgttctgttccatggtctatatgtctgtcttaatgtcagtaccttactgttttcactactgtagcttgtagtataatttgaaatcaggaagtgtaatgccctccagctttgttctttttgcttagtattgccttagctatttgggctctttttggttccatatgaattttaaaactgttttttctaattctctgaagaatgtcattgtagattgataggaagatagtagactgacaggaatagtattgaatctgtacatgctttgggcagtatggcattaaccaacgttatttcttcctatccatgaggcatggaatattattatccatatggtgagggtacattacatgattttattcgaaaaagagtttgctaagttattcatggtaagaaggctccagggagagacatcacactagataaggacatggattgcactagagataattattacctcattgaacaagagaggaaacatgagacgatcgagatggtacagcgcaacccaacaatgtaagttatgaagtacacgagtgctacaaacaacagagcataaaaggaggaacgagcagagacgccaggaagacaacagacacacagcaagagacagcaccatgagagggacacagtcgagaacaagcgagagagggacgagaatgaagagaccaaccacgagtacaagaggagacacaaaacagggaaaccgggaacagagagcaaaacagcacgaaacgagataaacaagaggaaaagccacagcacagaggaacaagcaaagcatcacacgacagtgcagtgacaggagcgcccagcagcagacgagtgcaacagcaaggtctagagaacaccaaaaagcgcgccacagaccacaagggag

SEQ ID NO: 725681 - DNA, 133 bp, Homo sapiens
cacgaggccgacctccaacctgccactttgtgttccactttgcagaatcccaatgaggcagtcagaacaggacactttgggaaggacaggccccgtatgagttttgacatcaagcctctctgcctatcaaact

SEQ ID NO: 725682 - DNA, 868 bp, Homo sapiens
agcttacccttgaccacatatctcgaacatctacactatatctaataacactcattcctctctacaagacaacgtgttttctaattgtcagttcccagatggtggcgtagtgcctattttgtttcacccacagagtctgttatcatttcttagaacgtttgttattttctcctctctttcccccaactatgcaatcttaaaagccctgtgtgtctaaatcgagtgcgcctcatctcctgtaaaaacgggtcccccgcaaattataccaccaggcggctcttaataaattcgcccccaactcgtgggttatggtatctcccgccccttggtatttgttgtgttgcgaacccgagccccaaatgatgggtgggacccccccgccgcccaccgcaaagatctgtctcccggacgaaatattagtatatgcgacgtgccccaattaagtggggaaaccacttttgcttctccccgaaagatagatcgtttatccccgtgaatcccacgggtcccctgtccagttgttggacaaaagaaaactgacgctaagaggggggtagaaaattaaccctactgggaaacgagggaggcttccccgagggtccacttgtacacatgacaggagggagcttccactaagattatggatcgcccgcacgcgtggtgccgcaaaaaaataggagaaccactattagaagggttcgagaaaccttagtataaggatgttcgcccccgcaagccccccccgagcacccacagggaagcaccctcaagcaaaaaaaaagggttagataaccaaaggaccaaaatttaattttttaaaatgttacccccccatggagaaataaaaataacctgttccacaaaaaca

SEQ ID NO: 725683 - DNA, 352 bp, Homo sapiens
ggatgtgtgcatctgtgcatttttaaaaaattatgagggtcacagtaagaaacagtaaatcttgacatgtagtttaaatatgagttggagaccagcctagccaacatggtgaaaacccatttctactaaaaatacaaaaattagcctggtgtggtggcgggcgcctgtaatcctagctactcacgaggctgaggtaggataatcgcttgaacccgggaggcggaggatgcagtgaggggagattgctccgttgcactctagcctgtgatagacacacacacacacacacacacacacacacacacacacacacagaggggagatcgctccgttgcactgtagcctgagatag

SEQ ID NO: 725684 - DNA, 559 bp, Homo sapiens
  misc_feature (4)..(4): n is a, c, g, or t
  misc_feature (33)..(33): n is a, c, g, or t
aaanatgcgaaagggaaagctgcaagtgactgnaaagctctaatttagagagtgttaagtgtgatttggagaaaagcatgaaagctggtttgaaaattcactctcatttgagtggcatccagaaagagattaaatacagtgactcattgcttcagatgaaagcaaaagaatatgaactcctggccaaggaattcaattcacttcacattagcaacaaagatgggtgccagttaaaggaaaacagagcgaaggaatctgaggttcccagtagcaatggggagattcctccctttactcaaagagtatttagcaattacacaaatgacacagactcggacactggtatcagttctaaccacagtcaggactccgaaacaacagtaggagatgtggtgctgttgtcaacatagttccaatggctcctttctgacctgctttcatgttttaatgtttgtttaatttaataggaaacctcattttaaatataacactcaaaaaaatgtaaatcatattgtagtattcaatagttaataaaaactcgagaaatgtgttgtttctg

SEQ ID NO: 725685 - DNA, 340 bp, Homo sapiens
  misc_feature (5)..(5): n is a, c, g, or t
  misc_feature (47)..(47): n is a, c, g, or t
cccanttcccgggatgacagggagtatatggaattacacaggacacntgtatcatgcatgtgttatacatgattgagacatatatgtccaaaagacgctctgtggggaacacagaacttcagctgggaagtcaaaggcagtggggccacagcaggctggtgcaaagtctctgtcttcagtgactgaggacatgaaggatggtgtggctgcgtgcctacagggagatcggcgggaccagacagaggaaagggcagtggtgtcccaggcaggctccatgtctccaaccttgggaacaaggctcaattcaagttaaatcaggacaagggagctctgtgaggct

SEQ ID NO: 725686 - DNA, 199 bp, Homo sapiens
gtcagtgatttcagacttgcagatcatccatggagtaatgcttacatcttttggccagtcctacctcccggagctctccaggcccagaactttctccagtcagcctctacagatcaagctcatgactcacaatggcctatttaggcccataccctacgtcacggcagcctccggagataattttactgcctcaaaacag

SEQ ID NO: 725687 - DNA, 266 bp, Homo sapiens
cttgccttcgggcataataatactcttttaactacatttaacaaatctttattgggctgctgctatatggtaggcacccttgtgtgtccttttaggtcattagtgcttaggagaagccgaggaccgtggatgctttgcagggagtacgacgagacggacacgttttgccctttacacactactcttgtgatgagggaaggtctcacctgaagtgcggtcttccggacggtgtgcgacgcagccatgtggttgtctgggcagcgctg

SEQ ID NO: 725688 - DNA, 268 bp, Homo sapiens
ctagttttagaagtttcaatagcagcacaacacaacaatatctgcacctcctagcaccacatctgacctggtggaagaagctacgagctacgacagcagccgggggtcaatggcaacaacacactttcctgagagctccacaacctcaggccgtagtgaggaatcaacagcatcccacagcagccctgataccaatggaatcacacccttacctgcccattgtactaccccgggcagcaatgtgctattgaaacttctagaaactagg

SEQ ID NO: 725689 - DNA, 689 bp, Homo sapiens
  misc_feature (379)..(379): n is a, c, g, or t
agcggaggagagacgggagaagagagcgcgatgagaggggagggcgtatatgtcctagggggcgccgatcaagaatacagtgcattgcgagtagggatggtatcagattgtgtccacgttcggagttcagacgtggacacacgccacgagtctgacgaatttaatggaggtggctaaagcgaagcattcagcagatctacctatatgtcgtattcatggcatctcacatgctcttgcagacgaggaggtctaatgtctatttgaggagtacttataactgggacataggaaatgtactggtagaaagttagccattactagcgaattcagtatatttgacgggataagctaactgctcaccgttccttacgcgtgtgcnatcgagctgcacacaaggtcgtgttcaccgaaatcaagaactaggtcaggaacaagtgcgcaatattagctccaattgccagaaattgaatggaaccacggaaggactgcaaagaggcacggcttcttcacttgtagcctctagattttgaaagtaactaattccagagtgggagaacagaggttatggaactatccgtcggagtgaatcgaggtgcacagggaagagctgtactccagaaaagttgtccaaggacgtggtagcgtggaattcttagatgggatgaaagaggtagtatgagtaaggggaa

SEQ ID NO: 725690 - DNA, 930 bp, Homo sapiens
tcaaggtcaaagctgttttatccaccactataagcaatcatgttggcccttttttttcccataagaggtaggtctctcagaattcccagggtatttctattccttttttccccccatttggcttagcagttctgcaattagagaccctattgccattctttcaggagaacatgacggagaaagtgtgattataatcacaaccgggaacatccggctcatggagggtataaagtaaaaggatatggtgattatatcaaaacttctgtgaactcacttttctaccacttgatgggtcacaaatgattggaataagatgaagctgaattgcagtagggaaatccttttttactggggcgttcttcattatagccttcaacccacaagctcttataatttaacccttgggaataaggcaaatctgtatttaataccagaattttggcagcacaaagggatacgtgtggggccctggggtgggtatggatgcatatgatttccccaggtgtggtctactgtgtattattccagataggaagacggattaaaattgagaaaattcatcccttcaattaatgtgtcgaatttgccccacccgtttacaaatttgtccagggagtgttgaaagggacttcctttaattcacagaatttttgtagaacatccttgtgtatatgtggtgggcagtaccctgatgtgggaacaccgtgtcctgacacttgtggttatcgggttaccaagttgtggattgagtgatattggagattggtgtttagtggcacaggaaatatggttatgagcgaagttcgacaattttgacggtattgtttctaatcgaattacgaagatagtggttggtgaagaaagaaaaaagaggggcgtgatatctggggacaggagaccgttgaagggaatggttaaagtgacggttat

SEQ ID NO: 725691 - DNA, 667 bp, Homo sapiens
tctatgcccaaaggtagagttctggctaaaaacctggatgaggaagggtttgaaagtgaagactgcgtcgatgatgacaatgagtgcatgggaggctctgatgctggaatgataaaggtgatgaatcagctccgattccttgcagaactggcctatgagctggatgcgcatgatgcgcctgaaagcagtcagcaggcacctcctaaggacaacgagataagcacgtcttacaacgcttgtaacgtgcattccccgctgaagcttatcaacagtatggtcatctcgggaccgtgctgcttcatcatggcgcaatgattggctgactcccagaacatgtgctgccttacagcaccgtgagcctttcgtcgacatagggaacgaccgtccaatttgaatctagctgtgacatgctagtgagctagtcatcatcgtcgagcatgatgctgatgtcctaaccatgtatagagattacagaaacagccagtgatttaggcaggaagaaccatttaggcggagcaaatacaaggtgcctttttaaagccaggcgattttccattaggcagggctcaacaaatctcccatatttggctgcaatagcctggttcccctgtatttgaagtggcaattccatccctttgaacggcgttttacatcgaaggaattggtt

SEQ ID NO: 725692 - DNA, 778 bp, Homo sapiens
  misc_feature (7)..(7): n is a, c, g, or t
  misc_feature (29)..(29): n is a, c, g, or t
  misc_feature (47)..(48): n is a, c, g, or t
  misc_feature (53)..(53): n is a, c, g, or t
  misc_feature (57)..(57): n is a, c, g, or t
  misc_feature (77)..(77): n is a, c, g, or t
  misc_feature (102)..(102): n is a, c, g, or t
  misc_feature (111)..(111): n is a, c, g, or t
  misc_feature (136)..(137): n is a, c, g, or t
  misc_feature (155)..(155): n is a, c, g, or t
  misc_feature (160)..(160): n is a, c, g, or t
  misc_feature (171)..(171): n is a, c, g, or t
  misc_feature (175)..(175): n is a, c, g, or t
  misc_feature (177)..(177): n is a, c, g, or t
  misc_feature (181)..(181): n is a, c, g, or t
  misc_feature (185)..(185): n is a, c, g, or t
  misc_feature (203)..(203): n is a, c, g, or t
  misc_feature (207)..(207): n is a, c, g, or t
  misc_feature (215)..(216): n is a, c, g, or t
  misc_feature (223)..(223): n is a, c, g, or t
  misc_feature (227)..(227): n is a, c, g, or t
  misc_feature (229)..(229): n is a, c, g, or t
  misc_feature (232)..(232): n is a, c, g, or t
  misc_feature (235)..(235): n is a, c, g, or t
  misc_feature (241)..(242): n is a, c, g, or t
  misc_feature (251)..(251): n is a, c, g, or t
  misc_feature (254)..(254): n is a, c, g, or t
  misc_feature (265)..(265): n is a, c, g, or t
  misc_feature (272)..(272): n is a, c, g, or t
  misc_feature (298)..(298): n is a, c, g, or t
  misc_feature (307)..(311): n is a, c, g, or t
  misc_feature (313)..(313): n is a, c, g, or t
  misc_feature (340)..(340): n is a, c, g, or t
  misc_feature (407)..(409): n is a, c, g, or t
  misc_feature (416)..(417): n is a, c, g, or t
  misc_feature (421)..(421): n is a, c, g, or t
  misc_feature (425)..(425): n is a, c, g, or t
  misc_feature (430)..(430): n is a, c, g, or t
  misc_feature (439)..(439): n is a, c, g, or t
  misc_feature (441)..(442): n is a, c, g, or t
  misc_feature (450)..(451): n is a, c, g, or t
  misc_feature (455)..(456): n is a, c, g, or t
  misc_feature (464)..(465): n is a, c, g, or t
  misc_feature (468)..(468): n is a, c, g, or t
  misc_feature (476)..(476): n is a, c, g, or t
  misc_feature (478)..(479): n is a, c, g, or t
  misc_feature (482)..(482): n is a, c, g, or t
  misc_feature (517)..(517): n is a, c, g, or t
  misc_feature (519)..(519): n is a, c, g, or t
  misc_feature (525)..(525): n is a, c, g, or t
  misc_feature (544)..(544): n is a, c, g, or t
  misc_feature (552)..(553): n is a, c, g, or t
  misc_feature (555)..(556): n is a, c, g, or t
  misc_feature (576)..(577): n is a, c, g, or t
  misc_feature (580)..(580): n is a, c, g, or t
  misc_feature (587)..(587): n is a, c, g, or t
  misc_feature (591)..(592): n is a, c, g, or t
  misc_feature (600)..(600): n is a, c, g, or t
  misc_feature (607)..(607): n is a, c, g, or t
  misc_feature (612)..(612): n is a, c, g, or t
  misc_feature (616)..(616): n is a, c, g, or t
  misc_feature (639)..(639): n is a, c, g, or t
  misc_feature (653)..(653): n is a, c, g, or t
  misc_feature (672)..(672): n is a, c, g, or t
  misc_feature (683)..(683): n is a, c, g, or t
  misc_feature (712)..(712): n is a, c, g, or t
  misc_feature (752)..(752): n is a, c, g, or t
gccctgncttgcgttccagtgttccagcntctgggagatgaacctcnnggcgngcgngggcgagagtgggggcagcntgcccccggcgctctccgacctctncctggcgcntttgctgaagaagcgtagtcggccnnaggctgatatcgcatccnttgantactgtgaaanaggncntgtncaanaacgggtctcctgccccnggtngccctgcnnaggtcangggncnggnggngcgganngtgcgaatnatncagtttgcganggtcacngaagagcccatgggaatcactctgangctgaatgnnnnncngtcctgtacggtggccagaattcttcntggtggcatgatccatagacaaggctcccttcacgtgggggatgagatcctagaaatcaatggcacnnntgtgacnnatcnttcngtggntcagctgcngnnggcgatgnnagannccaaaggnntgntctcattnanngtnattcccaaccagcaaagccgtcttcctgcactacngntgttcntgagagcgcagtttgactntgatcccnnannggacaatctgatcccttgcnnggnggcgggnctgnngtttgctnctggggncattntccngattatcaacaaggatgacagcnattggtggcagggncgggtggaaggctcctccnaggagtcagcnggattgatcccttcccctgagctgcaggnatggcgagtggcaagtatggctcagtcagctcctagcgangcccgagctgcagtccctttgggaag

SEQ ID NO: 725693 - DNA, 496 bp, Homo sapiens
  misc_feature (27)..(27): n is a, c, g, or t
agtcttttgcactacttgtaggatctnaatggagactataagaggatcagtcgagactaatagaagggaacactgggtatctgtcttttagtctcacactttaaagcaaaatatgaaatctagttattgtttataggtcagagagttagaatcccaaattgattcagattaatctcttgtccactaatatgcctgtttctgtatacttcaactcatttggtaaaaggtagcaggcaatggttgcatccttaaatacatagactggtctgatggacaatacaagctttaaagaggatgtggagtacaaccctttgggaaaacagtttgatattaattcataaacttgggaaaagtgcgtaaacggtaagccagccatttaaccctgacatatctctaggcgtagagatccactggccttgggttctcgggtagtggatggggctgttcatggcagcattatttgtaatagcaaaaatgagaaaccgtcgaattcgag

SEQ ID NO: 725694 - DNA, 218 bp, Homo sapiens
ctctcaaaaaaaaacaactgtgtgtcataatcagcagtgacaatcatcttaagcaacaacaaaacaaaacaaaacaaagtattggattagttcactgaactgatggaacctagatacaaatagctaatctcagcactttgggaggccgaggcgggcggatctcaaggtcaggagttcgagaccagcctgaccaacataatggaaaccccgtctctact

SEQ ID NO: 725695 - DNA, 222 bp, Homo sapiens
gctccaccttaccaccagacaaccttagccaaaccatttaccaaataaaggtataggccgatagaaaataaaaaccttgcgccataaatatagtaccccaagggaaaagattgaaaaattttaaccaagccataatttagccaagggcctaacccctatacccttctacaaaatgaaatttaacctaggggaaccctttaacaggggggcccaaattttaaa

SEQ ID NO: 725696 - DNA, 682 bp, Homo sapiens
tttgctcccgctgtgcggaaaagaatccaggcccttccacgcgcgtgtgggtgcgggggccccgaagtgctcgtggtctccccgctaggtctccgctagggcaggacaccggaatcatgtggtgggaccaccagcacccgccgtgttcaccttcgaggcggacgagaatgagaacatcaccgtgttgacagggcatccggttttcgggaaacatgtgattgatcgattgaggaatcctctccatctgttcgaagtctcagtggtatcgtggtgcttatggtgcctcaagtttctgaatgacagacttgacacaaagcaagagtacgctgaggagctggcattggacgcaagccaagaaagaatccgaagatcaggaaacgattaaagcaaggccaaaagagcttggaccgagagagggcttgctgcccaattgagcagttaaacccaggagccaatccatttcggagagcaggacttattgttagacgaggaggagaaaagggcgcataagggcaaaaagacacctgagggattagacacaggtttgagaaggagaaaagaccggggtgctaaaagaaaacagggatgcatttcttacaaaagaaacaggtggatagactggaggaaaaggagtcagagtctacaagatgtcccattgaaaattatcagaaaagttgtgatg

SEQ ID NO: 725697 - DNA, 345 bp, Homo sapiens
  misc_feature (33)..(33): n is a, c, g, or t
  misc_feature (71)..(71): n is a, c, g, or t
  misc_feature (308)..(308): n is a, c, g, or t
  misc_feature (321)..(321): n is a, c, g, or t
aaaaaaattttaagcaaagccaggagttagtgnctctctgaagtaaattcaattgcaaaatcttggcagangcagaaatggctcatatcagaagtgtccaaataaaagttctgggaaactagggattttgctttccagagcaatgggaatagcttccaaggtcagagtaaggtaatgagaatcttcccgggcaaattcccagtgccaggctttctgaaagaagtcaaaagcttggaacctcaatttggggcgccatccatgactcatctagcagcccctctctttttccctttcactttggatggttnccattctatatgncccatttactagcttggccatagg

SEQ ID NO: 725698 - DNA, 889 bp, Homo sapiens
ctcgcaccccatttggacccatgaggcctaccttgagggtcctggccctgtgctttttaccctttcggagatctacacttgacctgcaccgggatggcgagggaccaaaactcaggacactgagctttgtgggagacccagacctagcaggagatagaaccttccagaagtgggcaacttggtggtgccttttggagaagagcagagatacacatgccatgtacagcatgaggggctgccgaagccccttctaccctgagaatgggagccgtcttttcccagttccaccgtctccccatcgtgggccattgtttgcttggcctggctgtctctagccagattgtggtctatcggagactgtggtcgctgctgtgatagtgttagagaggaagaagctccaggtcgcgcccaatagagcagaggaggctatctatctccaacgctgcgtgtcagcgtagcagtgccccacggagagatttgcatgtgttctctccacagtcgtgcaaaaggcctagaccgacagcattgtcttgtgagaggactgtagatccaggaagttactttgcacgcgcttcccccttgtgagatcgagaaccctgcgggcatttcatttgtgctaaagcacctgaatgtcgatctgcgtccctgttagcattatgtgaggaggtggagagaccagctccacccacggcgtgtcccaaccgctgacacccttgttttccactggcgtgacacatgggtttcctcccccctcatctttccgggtccagagaagtgggggtggacgtaccacatctcatggtggtcaacatgtgatgtgcagcgtgaagacagcaaccttgtattacttcccgacagtaaataaagaatgggaagattatttgctttt

SEQ ID NO: 725699 - DNA, 169 bp, Homo sapiens
ggaggacgcacagtttctatcttatgacaataagtaccacaaggagcaagaggaggcagattttgacaatgaggaccagcaagccgcaagagtttccagattttgaccataagtaccacaattcgcaagaggatccagattttaactataagtaccaccaggcgcaaga

SEQ ID NO: 725700 - DNA, 427 bp, Homo sapiens
aacgatgaacagattcttttaagggttttcattcccaaataaaagtcttcagtttaccaagaataccatttttgatttaatcattcaaccttcccttggctggctcagattctcacccaaacatattaaaaagcatgcattctgcctgccacctaaaatgtcaacattgcccatatgccaattgcatgtcccgtcaggagatactgtaaccctcttcggagttcaattactgcaccgacacttttcttaagactaaaactcgtgccgaatttctgcaatcccggggatccactatttctagaaccggccgcacccccgtgggacctccatttctttttccctttaaccaggggctaaatttccaacttggggaaaatctgggccataactgtttccttgcggaaaaattttatacggtcaacaatac

SEQ ID NO: 725701 - DNA, 810 bp, Homo sapiens
cctcgtcgattgtgttctctgttatttacgcgccgccctcttaattagggggcggccgtatgatggcttgcttgcgcgtcgcatggcgcgtagtcgagctgctggttggttcctcgtgcgagagtattctctgtgttcgctgggtaatctcggctcgccactaatagctcttggtgttgtgtgcgccacgctctctgttgtgcggcaatgtttcatccttgtgccgggtgtccgcgagacaccaatggctccgcgcggatttttcgcggccccctctttccgccgccgcgcgtgctatgccaacatttgtgtccccaccgctgtccatcgtggccccccccatcggccaccgttgttgtgtgcgcccccggggttggctgctcgaccccttgtgcggtgcaaattttcttggctcgcctctttctactggcccgttaggggcccactgctggttgttgtcacaccctgtgtggaatctcctggtagaccgcgctgggagttttctattcttctcgtgcctcgctcccacttgatgttggggcacaaatcccactgtgctgggggcactgcctccactcgggccgtggtgaaatcgagaagagagggcttttgagtgcactctgggccccacagggcgcccatttttctcgcccacagggcctataggcgggctactctcccgcaggattaggaccattatcttgggtcgattcctccaacggttgtgcgccccagcctgtgccccgagccccctggagtctttcgtacgctcctaccctcatataacccctcggggagcatagatcaaga

SEQ ID NO: 725702 - DNA, 180 bp, Homo sapiens
ggatttgctggtgcagtacaactaggcttaatagggacatggttttggaagttctggccagaagaattaggcaagaaaaagaaataaagggcacacaaactgaaaaggagaagtaaaactatctctatttgcagatgacataatcttatatgtagaaaacccttgaagctcaactaaaaa

SEQ ID NO: 725703 - DNA, 800 bp, Homo sapiens
tggcctcaaaaagctttctccccattgggtccaaggcttgtaaggcctcgttaaaaaagctgcctatgggctggcaggagcagcaggtttaggcagaagcccttattcactttggcagggggcccttcaacactgtcgctggcgctcacaaaggctcttacagtcaccgctctgacagtgagcctttcgcaagcagtatactcgcccagcccagcctccgggccacccagcctgtgggaggctgggcacagggtggctcacccatccttctgtgactaagctcacacattcctcatctaggcaagctgagtctccaggcaagctcaccagaaaagtgggggctccgctgcgggcgcagaaacccagggcatgacagcatccaaaaaggggcccggggacaccagcctatacacacactacccgagggccccaggggcacgagccctcaccccagcggcccgacacgaggggagataaacacaccacacaagctcaactctaacagacgggcggactcacctcgaaagcgctacccgtggaacagacaaaaggcgccgcacgccgaccacacgacggaagaacaccgccactcctcaccagcggcacaacagcggcctccgaatacacccctctccgcgcgacctaatacctccatgcgagcaccaagctcccgggcggcaaccacaccggtgggctctcgcaaggcccctcccccagaaacacccaaaccatcaacacggcgacgccacaacactaacaacacgcccccaaacccagcaggctaggggtggacacgacac

SEQ ID NO: 725704 - DNA, 383 bp, Homo sapiens
  misc_feature (383)..(383): n is a, c, g, or t
tgcagtatggtggggttctgaacaaggccaggtttcagaccacggtcttcttatatctttatatggcaggaagagggtgagaaagctctcggggatcccttttataagagcactagtaccattcagtgagggttttactctcatgacctaatcacctccctaaggcccggcctcctaagaccatcacattaagggttaggatttccacatacaaatttgggagagacataaacattcagtccataacaagggcaaaagtgacacgaagtgtgctcttaggtgggatcataaaaaaggcccatacttccaccttctcttcttagaaggttggctttggaaaccaagaagtccatggagaggaccttgacccacatcggtacggn

SEQ ID NO: 725705 - DNA, 162 bp, Homo sapiens
  misc_feature (4)..(4): n is a, c, g, or t
ctanagatccccggtgctcgccgaatgcagttgaagatgtgcccattttcagggtctttgctgtacatgttaggatactccactttgtacttcttgcgggcgcgtggaagcattgatggctaggtgggccaccattataaagctgacagcaccaccaataca

SEQ ID NO: 725706 - DNA, 485 bp, Homo sapiens
aaaattaaaaaactttttctctctgaaaaatcctgttaagctgggcgctgtggttcatgcctgtaatcccagcacttcgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagc

SEQ ID NO: 725707 - DNA, 211 bp, Homo sapiens
  misc_feature (4)..(4): n is a, c, g, or t
  misc_feature (29)..(29): n is a, c, g, or t
  misc_feature (103)..(103): n is a, c, g, or t
  misc_feature (109)..(109): n is a, c, g, or t
cttnttaaacatgtgtatccctattaaantcacttgtactctttaagcctcagttttcacagctggtccaggtagagttaaactacacgtggtctcatctctntccctngcctggcttgtgacatacatgcaagtgtttgttgagcgaggtccctttagcaatagatttagcgtgtactgaaagtttgattgtcacacatctaatgtgcat

SEQ ID NO: 725708 - DNA, 183 bp, Homo sapiens
  misc_feature (159)..(159): n is a, c, g, or t
gatgatctagaggatcctggctcagtgatcttcccacctcggctcccaaagtgctgggattacgggtgtgagcactgtgctagccctcctcctatttaaaaaaagatattcttccctttgtcaagcagagtttttaaaaattataaatgtgactcacanaatttgaacatgaaaccaaggtta

SEQ ID NO: 725709 - DNA, 783 bp, Homo sapiens
  misc_feature (783)..(783): n is a, c, g, or t
ctgatatgcacttggttgtatggaactgcactcaagactagtctgggataaactgtcatcagtaccctctggcatgtatagattccgcgatatgggtaacttcacctgtccttactttatactgcactcgagcaccaggctgcatactcatggagttcttccattgtcgtgccacctatacagatgactgatggcccaggagaaattcatgcccaagctctggagagtgtgtggggacttggtgagaggacatggttttattgttatctgtttagttcctgctgcggaagatgagactctcgctctctttgtcatttccccacatgcacagaaacacacatatttctacttttctcatcctctcaacagggtgtcataactttggttaaatcaatagtcagtgtttgtatattattattggataaatattacttacagtggaacccattgtgtgtatgactagatattctttcttgtagaactttatgtttatacaccagttaatacttatctgattaatttgcagttgctctaatgacctgtacacctggtattaatttatgctgaactctccaacacagactgaaatcttgacttactatgttcaaacccattgggggatactacacgcttttttttttatttatcgatacattctccctaggctttccctctacctgctctagtctaaactcggttgctctctaagccaaagggaccggtatcattcttttctgcccttggccttaatctgggaagtcacgttggatgtttctcccgtan

SEQ ID NO: 725710 - DNA, 119 bp, Homo sapiens
tgggcggatcacaaggccaggagttcaagaccagcctgaccaacatagtgaaaccccgtctctgctaaaaaatattttaaaattagccgggtattgtagcattgctgtagtcccagcta

SEQ ID NO: 725711 - DNA, 405 bp, Homo sapiens
  misc_feature (9)..(9): n is a, c, g, or t
  misc_feature (21)..(21): n is a, c, g, or t
  misc_feature (105)..(105): n is a, c, g, or t
  misc_feature (254)..(254): n is a, c, g, or t
  misc_feature (315)..(315): n is a, c, g, or t
  misc_feature (318)..(318): n is a, c, g, or t
  misc_feature (373)..(373): n is a, c, g, or t
ggccgggcngggaaattgttnaactatgcaggttgaaacccaatagccctgaggtccctttcgcaaggtggcagaagccaagggcgcagctccctcaggggcccnactgacatccttcttgcccagcttcggaagctgtggctgccggtgtgtgcccagtctggcttcggctcccaggggtcgtgggcgggtgggaagccctcgctgggccatctcctcggtacaggtcagcccctccacagccttgatccttntgacaacctggtggtgcgtctcgccctccacgttgacgccgttgacctcgaccaggcggtnccnccagcgcagcgcggcggcctcggcgggggaaccgggttccacgcgccggatgaanctgcccgcggcggcccttctcgccgtgcaggt

SEQ ID NO: 725712 - DNA, 1954 bp, Homo sapiens
  misc_feature (798)..(798): n is a, c, g, or t
accgcacccctgtgtgttctcgcgtcttgtgttctcgtccttggtcgaatcgtgttgggtggggcccccaccaccgggtgtgttgttttcgacagctcagcgtcagtatggtggggtggccgccctcctctatatggtggtttctactactctctcttgggtgaatgcacgatgtttcgctccagtctactaggttcgactcatactatctgtgggtgtgtgcatttcgcccactccttctcttttggtgagttctttcttcttccatccccgctcgtgagttattggctatgactaccctcctctcccccgttgttttttttctttccgccggcatctctttgtttagtgagagtgtcgttcttccgaaggtttttttctctcccgcctcctcgacactcacaacagtagtgtggtggtgctgcacacctcatgattccagtctttcgttctatcctgtgatggctccccaccgtgtttttgttagctgggtgtgggctcgctacctcttctcttgtagtaacaccattgcttctctcttatctcagtaccttgttgtctgtggagtggaggctgtcttacttattctttgcatacgcgtctctctctttttttcaccattccagtctgacgcaacaggtgcggggcgaccacactctctgtgtgtggttggtcgaactctaacctctctgcttccacccacacacacagagaggtgttgtgtgtcgctgctcccatgattgttgttcctcgacttcttagtactcctctcctgttctttgttgtctggtcacgtangcagaaactaatgtgtttgtttctgttttggtggtcgacccctacatcaggaggggtgcgccctcttttctttgctttgtgtttaattgctctagcaacacatgttcgttcctgctcttcatcttgaggtggctcgtcggctgcttcgttcttgtcctcaccccctctagtcttgtcgtgcgcaaattggtgcgggcagagcgccgctgctttttcttcttattcgtagatgacactcttcgttttcgtcgtgtgttgttgattataagctcgtctatgagatggtgggcggagcaccacatcagcctgtggttgtcctctcctctcgcggctgctgagtgtttgtgatgccccccacctcctcttttgtctcccttctctggtttgtctccactccactcccttcactctctcggctgttaggactgcacccctccgccgcccgtccgcttagtgtgtggtgtggccgtccacccgcgtgctctctctcccactctctccgcgcgcgagagagatctatttgtcctcccgctcgtctgtctttgtgtgtgtgtatattagatagagagaccgcgtcttgtgtgcgcgtggtgtgtgttgtgttgtgtgcggagagagtgtgtggtgtgtgtgcgttggatagatgtaaggtattccacacacacactctctcacacacctcgaggtggtctctctctctgcttatatatatagagagagagaggctccgctgctcgtgagagagagatgtgtttgtgcgtgtgatgatgagtgagagagagagagagagtgctatgatagagagagagtgttgtctctctctctctgtttacgagatacgagagagagacgactctctctctctctctcttcattatgtgttgttgtctttgtctcctctctggcagctctctctctcgcgcgcctcttggaggcgctcgctgtgctcccccccacacgcggtggtgcctcggggtggtgtaaaccaccgcgcgagagatgggtggggggagtctcctcccctccccccaccacatcatgtcgttttccccgacccacctctctgtttgtggaaaaaaaaaagggggagagaggaggtgagacgtatcgatgtgcttcgggggtttacccacaccataaagtaagagaaaataga

SEQ ID NO: 725713 - DNA, 490 bp, Homo sapiens
  misc_feature (38)..(38): n is a, c, g, or t
aacgtatacataaatattattagcatcagttacttgcnttacaacaggatctgtgggctggatgcatggctcacacctgtaatcccacactttgggaggcggaggtgggtggatcacgaggtcaggagatcaagaccatcctgggctaacattggtgaaacccccattttctacttaaaaaatacaacaaggggcagggcctgaatactaaccctcaggcttcgcgttttcttctctttttgcctcaccgtgctgtcagctccagaacatgcccttgggaatgagcagcctcccatctccacattctggcccctggagtccctgcacttccttctgatcagggaagtgattcaaggtgggacatgatcccctttgaacatcgggacctgaggctgagggcattaaaagagtcaccctctctcatgacctgctgcaagaaaacagccccttatttatcaaatgccttttcctgcccctccgaagaactcag

SEQ ID NO: 725714 - DNA, 411 bp, Homo sapiens
  misc_feature (18)..(18): n is a, c, g, or t
  misc_feature (121)..(121): n is a, c, g, or t
ggttttaacctaataaanccctgaactggggctactgccctttttttgaaaagatgccctgccccaaagaggagggaatctggagaggcagtctggcagcagtggccttgctgaggtgtgngtgctttgcccagttcgaacttccctggtggctttgtttacactgtgagggcaaaaccacctattcaagcctcagcaatggtggatgcccctcctcccactaagcttgagtgtcccaggtcaggctcagactgctgtgctagcagctagaatttcaagccagtggatcttagcttgctgggctttcatgggggtgggaccccgccaagccagacacttggctctctgcttcagcccacttttcaggggagtgaatggttctgtctcactggcattccaggcgccactgag

SEQ ID NO: 725715 - DNA, 351 bp, Homo sapiens
tcgacctgggccgggggacgtggctcacgcctacaataccagcactttgggaggccgaggtgggcagatcacaagttcaaaagatcaagaccatcctggccaacatggtgaaaccagtctctactaaaaatacaaaaaattagctgagcgtggtggtgtgcacctgtagtcccagctactcgggaggccgagctgaggcaggagaatcgcttgaacctgggaggcggaggttgcagtgagccgagatcgcgccactgcaacccagcctgggcgacagagcgagactccgtctccaaaaaatgaaaatgaaaatgaaacgcaacaaaataattaaaaagtgagtttctgggg

SEQ ID NO: 725716 - DNA, 455 bp, Homo sapiens
  misc_feature (261)..(261): n is a, c, g, or t
  misc_feature (306)..(306): n is a, c, g, or t
  misc_feature (344)..(344): n is a, c, g, or t
  misc_feature (372)..(372): n is a, c, g, or t
  misc_feature (384)..(384): n is a, c, g, or t
  misc_feature (402)..(402): n is a, c, g, or t
  misc_feature (426)..(426): n is a, c, g, or t
  misc_feature (445)..(445): n is a, c, g, or t
  misc_feature (454)..(454): n is a, c, g, or t
ggccgcattcggaccggtccctacaaacaagggggtgattagtatgttgggacaaacacgctgttgctaaatggaaacactgacctcacagtgcatcctcctgccaacacacacacacacacacctctcacacatgcacgcttacacacacacacacacacacacacacacacacacatacacacacacacacacacgctctctctctctctctctctctctctctgtcagtgtgttatcggtgtggagcggaggccgcgnaggtgcctcggtccttcagcacccctcggcccgacgcacccacgnccctcaccccccgagagccgaacgcttccccgcaccgnccccggttcccttccctcggccgggagngacttctgcagnttcgttgtttccgaattnggcaccagcaatgtcgggccagtngtaggagggtggaagagcnccggggagnc

SEQ ID NO: 725717 - DNA, 419 bp, Homo sapiens
  misc_feature (174)..(174): n is a, c, g, or t
  misc_feature (249)..(249): n is a, c, g, or t
  misc_feature (271)..(272): n is a, c, g, or t
  misc_feature (305)..(306): n is a, c, g, or t
  misc_feature (316)..(316): n is a, c, g, or t
taaatagttttaattttttaataaaattttctctacgttctatatgcaattgttatatatctatttgaatagctgaaggactaaaatacttttttaagagataacttcaggaaaccgattatagttttacctatcgtgcatgtgctgttaatcatgtggtacatctcgtgaagnctgatgttgatttacagaacccatttcatttatcatatgtagtaatggagattcacatgtagtatgtgatctacntatagatgtcgtacatgattcnnttgggcatgattactgtcgaaacttacagatanntctaaatttnaaaaaatttttataaaggggggaaaaatttggggggttttttaaaaaagggggggttttaaatttacctagtcattcttctatcatgtatattgatgctgaaa

SEQ ID NO: 725718 - DNA, 980 bp, Homo sapiens
  misc_feature (569)..(569): n is a, c, g, or t
atttcggaacgagggagtcggtgtttacactgggttaggttcagctttctgcgtatcgggtagtatttggagtagagagaaagattggctgcaggggaaataaattgcatgttatagaccgatgtcagctcgaaaggagcaaagccattttggaaatctagctcttggccagtatctacgtttaggcacgacagcgccgttaagcaacacaaaatgaagggcgaggaatgattttctacacactgtgcttggaaaatttaaataggtaacctttgggcttgcacctgggcgtcttcttcggagtccagatctgggaagtcctagaataaaaaaaaatcacaagaggtgtgatcagttatacttcaggttactgccatgtggagagcatagcaggaacataaaaggagaaaatggaagtgttaggagagcaacagggtgaacaagacgtaatagagatgggaaaaagaagcacaaagacatagcaagacatttgatcttcagagagaaaatttcggacctaaaccgtgagtaaagcaaattctgaggagcccttgcttgcctgtaaccangtgtgaggtcgtgagactgcaggaacatgttcgattcggtttatgcgtgcttggctaccattgcggggaaagagaaagctttaacatatttgtgagcctaaaccgttgctatttagtaagtggtataaaggttggttatattatctgctagccataaagcatcatttttttccttaaagtgtgtgaatgaaacgcagccaaactgtgggcaaattcagagagaaaattcaattcttaagtatgtgttctggaagagtttcctcttagtatagtgcccagaatttcgattggtcattctttggtcattgttcatacttaagtaaggtggcttttgatgaaacggtatcatctgatggtcttttgaaagttaatgtgagacagctaatgtcaacccctcgtacatttaggaaa

SEQ ID NO: 725719 - DNA, 253 bp, Homo sapiens
cgggagaatacagaataagcttcagctacaagtgactgtggtgatatggatgaaatacagtagccaagagaatggtccaagtgatcccccatccatttatccctgtcatcctaggtctgatcaaatataaaatccgtggtccagaaaaacttcctgcgctgtgtggagacaccccaactaggtcataaaatctagaggttttctacaaggtaccttccctctcactgcaattgcagcaaactgatttatgggc

SEQ ID NO: 725720 - DNA, 323 bp, Homo sapiens
  misc_feature (178)..(178): n is a, c, g, or t
  misc_feature (280)..(280): n is a, c, g, or t
taaatggtcattttcaaacgttttttggacaagctttttactatatttcttagccttggtgtaaaaacaatagcacaggaatctgtccttgtctattttaggctttttcatcgaagttgtctgccccaaatttatttggctgagtggtcactagtatgttgaaagtcatttgggttcngtttttagaatttgactggttgaataagtggttggtatgaagctatgtgtaattggcagacttatctgttgcacttggttagctttaattgttctgtattcnaaaattaagtttgttcaataaatctgcagagattgaacaaata

SEQ ID NO: 725721 - DNA, 321 bp, Homo sapiens
ctcctactttagatctgatgaacacttaacgtctctgcaggtccatttttatacaaattgatagaccgtaataactttctggcttgccacacgcatatctttcttttctgctcatccaataaacatgctgtgccctacctgtgatagattttccaagacaaaaatacctggcgcagcattttagcaaaatatgacttcagatggcattcaacaaatggagtttccccaagcacagttctgtgatatgtgcgtgtgagagtgtgtgtatatatgtgtatatgttttttaagtttttatttgtattgtgcttaaagtttgcca

SEQ ID NO: 725722 - DNA, 116 bp, Homo sapiens
  misc_feature (61)..(61): n is a, c, g, or t
tacacggcaggtattctcattactgcctttgatctgtagtagctcaggagcccgttgctgngcacgaaccatcgccgctggtagcctttgatatattggtccatctgacccatctt

SEQ ID NO: 725723 - DNA, 246 bp, Homo sapiens
tgcggcgggtaggcgtacggccacggctattggttgcatgagtaggctgatggtttcgataataactagtatggggactaggggtgtacggtgtgccttgtggtaagacgtgggctagggcatttttaatcttagagcgaaagcctgtaatcactgcgcccgctcataaggggatggccactggataggtttatagactagttgggtggttggtgtaaatgacgtaacggcggacgattgttcacg

SEQ ID NO: 725724 - DNA, 221 bp, Homo sapiens
ttttttttggtgaggcggggagatgggaggcacagggatggagttttcctctgttgcccaggctgcagcacagtgtcgtgatcttggctcaccgcaacctccgcctaccaggttccagcgattctcctgcctcagcctcgcaagtagctgggattacaggagtcacctggctaagttttttttttggttttttttttttttgtttttgagatggcgtttcg

SEQ ID NO: 725725 - DNA, 110 bp, Homo sapiens
tctagaggatccctggtcattttctacacctaccaccctgataggtttcaattgattgaatgttaccatgagtgaggcgcaatcgcatccaagcctgcatgcttgtagaa

SEQ ID NO: 725726 - DNA, 125 bp, Homo sapiens
gacgagacccttcttccagtagtcgagatcctgcagcgcgacggcctgcgggtccgtcatctcgaggatctcgcgcgagatcgatttgccgaagccggtggcgtactcgagcctggccttgctct

SEQ ID NO: 725727 - DNA, 1792 bp, Homo sapiens
  misc_feature (713)..(713): n is a, c, g, or t
taccatgcaacgaaacctttattaactttttgggaacaggttcagctattactgaaacttgtaatttctaaatcttaatgttgggggcaaatgggctatagtggcaagatgtaatggccactcatctggggcactggcagaatggccatagacctgagaaagaattacacagccacccctccaggcgcaagagaccagtgtggcaggggctcagacctctctttctctgtgagaagtgttgtgagtgctcaagaaaagaaggtgcgggccatctcttctccaggcgtgctgtgcctgtgcaacaaatatagaagcctctcgtgggtgagctcgagggggagatgtgcctcttctttatatctctgtgagaaactcttgtgagaccatctccacatatttctccgaagtgcggtgttcccacagtggggcccctccccaactctcccagaaggagtgaaagtggctcttgtgccccggggttcagcagaggggctctctctcacacagaaacagacattctgtgacacacttctcccccacacctctcctctcagagcaaacacgcggaagaagactacccagaggcgtcgtgccacaggagggagctccgaaaactactcctcattcttctgtagcggacaagtcgtcgtcggcgtcgtcaacgaactcctcgagagacaacaatacggcacaaggaggttgagcccgcaggnccaccacaacttctctgcttccccaaaagcacctatttgtcgtcttggtcgcaccccctgttggatcgcacgcagcaacggcaatcgttgagtagacgccgccccttcttgttcgtccgccgttgaagcgtcctcctcggtggggtgcggtggccgaccagtacacggtcggccgccgtcttctcaccctagatcgtgcattctccgctcggtggaaaggaaccatcctcctggtgggcggccgctgtgttctgtccgaaccgccgattattacttttacttccgaggcaaggtttgagtgagttgtgcttcccccgtgttgggggcggagctctctcctcccaagcgttcttcccccatgatgacgtgctcgtacggtgccgcctcccttgttggcgccgcggtgttctctacgaagggggcgtgcatcctgttcgttcagcgcggcaaacaacggcacatcttctgcgtgggcggctcataattctcgtacgacgcctgtacctttactaaacaacaccgcgctccagtgactgacacccccccgcagtgggcgttcaccaccggagcggcgtctgcacgacccatcctgccgacattatatccatcaaggataggaataagttgacttgtctgaattacagctgctctccgaggggacatccaagcgcgcaagagtctatcctacgaggcgcagctaaatcaatctactctgccgccctaacaacgatagctgtgcgtatatttgcacgtccattgtcccgaccgagcacgtcatcttttcgtagcggcccactcaccgtggcctttgatgaccttcgcgcgcgacaggcataaacttcgcccctcctttaccctctaatcatttgcccgtgggagcacacctccttgctgacggccccgtgtcaccaacatcagcttgttatccatcgcgcgcttgttggctgtgctacatcgctcggtgtgggtcgtccatcccccaattcctccttccgaactgactgctcctccatcactgtatgacatttgtgcccccgcgcaggctgtaacgcgggggacggtttcttaccctcatgcca

SEQ ID NO: 725728 - DNA, 914 bp, Homo sapiens
  misc_feature (626)..(626): n is a, c, g, or t
  misc_feature (650)..(650): n is a, c, g, or t
  misc_feature (656)..(657): n is a, c, g, or t
  misc_feature (693)..(693): n is a, c, g, or t
  misc_feature (710)..(710): n is a, c, g, or t
  misc_feature (715)..(715): n is a, c, g, or t
  misc_feature (721)..(722): n is a, c, g, or t
  misc_feature (725)..(725): n is a, c, g, or t
gtcctggtgcggagcgtcacgtctcgtgcgtgttcattcagccacgatgcctgaggaaacccagacccaagaccaaccaatggaggaggaggaggtcgagacctttgcctttcaggcagaaattgcccagttaatgtccttgatcatcaataccttctactcgaacaaagagatctttctgagggagctcatctccaattcatcggacgctctggataaaatccgttacgagagcctgacggaccccagtaaactggactcggggaaggagctgcacatcaatctcattcccagcaaacaggaccgaaccctgaccattgtggataccgggattggaatgaccaaggccgacttgatcaataaccttggcaccattgccaagtcgggcaccaaagccttcatggaggctttgcaggctggtgcagatatctctatgattggccagtttggtgttggtttttactctgcctatttggttgctgagaaagtgactgtcatcacgaagcataacgacgatgagcagtatgcctgggagtcctcagctgggggatccttcacagtgaggactgacacaggtgaaccaatgggtcgtggaacaaaggttatcttgcatctgaaagaagacnaaacagagtatttggaggaaaggngataanngagatcgtgaagaagcattctcagttcattggtatnccattactctcttgtgnagaanggacgnnatnacgaagtcagtgatggaagggagggtggagaacagggagaagaaagagggagagaaaaaacagagaataaggggctggtggtatactgtaatagaaaagttgggtcttaggaaaaagggggacaaggttgtggaggaaaaaaaaatagggagtttgttaaaaactcaaaaacgcggtgtggaatcttgt

SEQ ID NO: 725729 - DNA, 839 bp, Homo sapiens
  misc_feature (127)..(127): n is a, c, g, or t
  misc_feature (163)..(163): n is a, c, g, or t
  misc_feature (180)..(180): n is a, c, g, or t
  misc_feature (219)..(219): n is a, c, g, or t
  misc_feature (241)..(241): n is a, c, g, or t
  misc_feature (247)..(247): n is a, c, g, or t
  misc_feature (265)..(267): n is a, c, g, or t
  misc_feature (271)..(272): n is a, c, g, or t
  misc_feature (295)..(296): n is a, c, g, or t
  misc_feature (298)..(298): n is a, c, g, or t
  misc_feature (303)..(303): n is a, c, g, or t
  misc_feature (310)..(310): n is a, c, g, or t
  misc_feature (322)..(322): n is a, c, g, or t
  misc_feature (340)..(340): n is a, c, g, or t
  misc_feature (343)..(343): n is a, c, g, or t
  misc_feature (364)..(364): n is a, c, g, or t
  misc_feature (384)..(384): n is a, c, g, or t
  misc_feature (396)..(396): n is a, c, g, or t
  misc_feature (416)..(416): n is a, c, g, or t
  misc_feature (465)..(465): n is a, c, g, or t
  misc_feature (472)..(472): n is a, c, g, or t
  misc_feature (474)..(474): n is a, c, g, or t
  misc_feature (544)..(544): n is a, c, g, or t
  misc_feature (555)..(555): n is a, c, g, or t
  misc_feature (562)..(562): n is a, c, g, or t
  misc_feature (572)..(572): n is a, c, g, or t
  misc_feature (575)..(575): n is a, c, g, or t
  misc_feature (578)..(578): n is a, c, g, or t
  misc_feature (581)..(581): n is a, c, g, or t
  misc_feature (598)..(598): n is a, c, g, or t
  misc_feature (600)..(600): n is a, c, g, or t
  misc_feature (607)..(607): n is a, c, g, or t
  misc_feature (616)..(616): n is a, c, g, or t
  misc_feature (619)..(620): n is a, c, g, or t
  misc_feature (623)..(623): n is a, c, g, or t
  misc_feature (628)..(628): n is a, c, g, or t
  misc_feature (648)..(649): n is a, c, g, or t
  misc_feature (652)..(652): n is a, c, g, or t
  misc_feature (655)..(656): n is a, c, g, or t
  misc_feature (671)..(671): n is a, c, g, or t
  misc_feature (685)..(685): n is a, c, g, or t
  misc_feature (688)..(688): n is a, c, g, or t
  misc_feature (693)..(693): n is a, c, g, or t
gccgacggctcgggagcgcgcgcggtcgcgtgcgggagggggcgggtggggaaggatcgcaggcgagattacgaggcgaggtcggcgcccgcccccgcctggcccccagtgcccacccggtcggccnggcacagccatgatcaaggcgatcctaatcttcaanaaccacggaagccgggntctccaagttctaccagccctacagtgaagatacacaanagcaaatcatcagggagacttnccatgngtatctaagagagatgannntgtnngtaatttcctagaaggaggatannantgggnggatctngaaacaaagtgntttatagacttatgcaangtnatattggtctctgtgtggatnctcagaaagtgaactgtggnatttagatctanttcaagtatttgtggaaacnttagacaaatgttggaaaatgtctgtgagctggattgattttccatgtnagacaangnttcacaatattcttgcagaaatggtgatgggggaatggtcatgggacaaatatgatgagattgttacacnaaattggtgcnaaaatangtggaaaatntgnggntgnttagcaggagctcagcngngtgtatnaggtaaganttnnatnttcgnagatccagaattttacctgnngcntcnnttaagggcaactgcnttttaataaatgtnaanggccncccggtaatagggggagagattaagtacacaggcgtgtcaaaaagaggggggtaaattggctggtaagcagggttaagggggaaagaaaatcggggttggggaaaaaggcttggattaaacgggcgcaggggttgtagaagggata

SEQ ID NO: 725730 - DNA, 117 bp, Homo sapiens
tctagaggagcttgttttaggtacagaggcaaaatttagaacgttactgaggttggtccaggcactcattcttccaaaggcctaggatggttattttggtaggttagttggttggtt

SEQ ID NO: 725731 - DNA, 637 bp, Homo sapiens
tgtagtccaatattttttcctttataaatccatactgtactcccatggctctagctacttatactttaaaattgggctgggcagccttgatgtgtttctaggtactagcagtaagttttctgaccttgcgcacagcgccaggcaaagtacagttatagaatccaaatacagatggccagacaactcgatgtgcatctcaacccgtgttcttccccatagaatggcccagtgcaggtgtgggggctgctccctctgcctcaccccgactccaccccacgtcagggattactccaggggccacttatggcctcttgacccattcccttccccacctttggagctctaggtgagagtggggagaagaaatgcgaccagtgggttggggaagatggtacgggatccattgcgagagagtgtgtctggcaccttgagattgcagggatcaggaaacatgtgggagagcccataaagctactggtgaggacaacaaatggatgtatagtgactatgacaatctagagagacactggacaccaaggaccccaggacgcaatgcccgaacagcagagcccactgtcttgacctggaagaaaaggccaccccttaggcttctgaaatgactaatggaatagaaaga

SEQ ID NO: 725732 - DNA, 478 bp, Homo sapiens
gttcgacggaagcagactgttgctaggtgacaccaaatccagtgtctgtttgagctctggatgatcagctacaagctgtttgtaggagctcgggagggcggttgttgggtacctaagagatggcgacattttttggcggtggcgaatgtttacctctgcttctgtcccctaacagcaagcagtgtgcgcccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccatgtccagagtctgggttctcttggtttgtggtgtctgaatccagcattcccatcctggggatggggctgtctttgcagagccctcttctggctgggcgagtccctcgctagtcag

SEQ ID NO: 725733 - DNA, 211 bp, Homo sapiens
tcgcgttttcttcgtagggaaagataagagagttcggtgaccataagaggactccattttcaccgctgaaatagaatgatcgcccttatagtctggctggcaaatcgttagaaaaagaagtttatttacatgtatgtggctatttccactaccaagatctagctgagcaagttcacacttcttaaacttcccagttcagcaacagctagtg

SEQ ID NO: 725734 - DNA, 178 bp, Homo sapiens
atgactggtcatttcttaacttgcaaactggtcttacctgctggcacatactgtgatgtcatttctggagataaaagttaatggcaattgcacaggcattaaaatttacgtttctgatgacggcaaaggcctcaatgtttctatctagtaagctctgcttgagatccattgtagttgc

SEQ ID NO: 725735 - DNA, 163 bp, Homo sapiens
cgggtagactgcatccttggcacactatagccaaatttcttgccatatgggcttgagtttcaacatgtcggagagcacaggaacctgaaagcataacttttctgttgaccctgatggtgggcccaagaagattctagagagtcaaacagcacaacaggttgag

SEQ ID NO: 725736 - DNA, 1689 bp, Homo sapiens
  misc_feature (872)..(872): n is a, c, g, or t
  misc_feature (968)..(968): n is a, c, g, or t
  misc_feature (1108)..(1108): n is a, c, g, or t
gttttttcgtgcgtcgtgctggtgatgttagttatcgatctctcccgttgtcgtcttctcgttttcgttctctctcgttttgttctcttctgcgtttggctgtggttcttgtctttgcttccgcctctttgtttttctctcttttttccttagtttttttgttgtcttgctgctgctctgtcggtctgtcgtgtattgtgtctgtgtgtgcgtctgtcggtggttttgtcgtggtttgttttgtttcttcgtttcgttgatgttttgtgtcttcctgttttgtctcttttgttgtcttcggtctttgtgtttttgcttgtctttgtctctcctgcttgtgtctgcttcgctcttttctctctgttggcgtcgctttgttctgttgtttctgtttccttctttttttttctgttcgttcttgtgttcttttttgttctttcgttctattctttgctgtcctcttctttttcttcacttcgtcgcttgtctttgtgtttgttctgccgtctatgttgttgtgtctctgcctgtctgcgttctcttctctattcctctcttttgtctttcttgcctttgtttcggtcgtttcgctttcttcgttgtgttctctctgttgttttcctgtctttcgtctgctgctgcgtcttccttcgttttgtctttctgtcttcttcttctttgtctctccgtggtctgttcctgtcttttgttttgttatcatttcttgtttgtgtttgtttgtctgctgttgttgtgtgtgtgtgcccccccccgcgccgtcgtgtgggggggtggttctaatattttaaaccccagcgagcgctcctcggtttttgtatgatggtggcacccctcgtgcccgatatttttcnccctgtggggggagacgccccccatctccccccccccgcgttttttgtgggaacccccccccctataggggatagaaatcacctcgcggggggctncggcgatattccacagaactctctcccgcgggagtcttttttagacctcttttaggtgtcccccccgcggggtgacctgcgtgatatacaccgcgatatggtgtgcacacacccgcggtatcacacgcgcctttatgtgnccccctttatgggcgccctatatttttataggggggaccacccctctttatgggacacccccgtttggtgaccccacaaaaaaacccccgcgcgttgggttataccgcgcttccgcgggaattttcccccgcgggagtatattttttctgagacaccaccgcggggtctcccacgctgagagtttctgagatagagatataagggggtaggagaaaactgtccctctccacatcacctcacacatatatttatattgagcgcacatttactcacacgtggagacaatagggcgcccacatatggagaacacataccccgagaaaccacattgttctcccgctctttgagggaggcttatcacatttttaaatggctccacataaataattgagatgagatgggagaggcacggtgagagttttgagatgaataaaggggtgagagaaaactggaaatccccacacacacccggttttgtgttgcttgttttttttatatggcccccgatttaattggggaaaattggcccctttggaaaattttcccccatattacccttccaatataaagcgccatggga

SEQ ID NO: 725737 - DNA, 303 bp, Homo sapiens
agaaagatttttttttaaaaaaaaaagctagaataacccaaaaaacccccttttggattatgcttccctcaaaggaggcaggcaggggggaccccccaggggctttaaaaccctgggcatgttttctttctcccattgggcaatggggacatggacgttccctggaacgggctttttctttcgtctttttttttttttttttttggcccctggcaagctgtgcgtgacattctttatggctttttgtatgtcaaaatcttcaaactaaactttctaaaaaattaaactttaataatgggccca

SEQ ID NO: 725738 - DNA, 246 bp, Homo sapiens
gggacgaggtgatgggtgcaatagggtgattaggaaagaaaaataatagatagttacgaagtcttgagaccaagaaatggattcatttctagatatcttctctttaataatcagtagtatggccgaaagaaaaaaaataagagggctgacaaatccgttctgttaatgggtgggtttgctttccatggtatagagacgggattatcacagtggtccatagcacctgactgatagtgagttagtgta

SEQ ID NO: 725739 - DNA, 383 bp, Homo sapiens
  misc_feature (17)..(17): n is a, c, g, or t
  misc_feature (166)..(166): n is a, c, g, or t
tggaaatggtgttaagncagggttttggttgtttgttgccatccctcaccctttgccatttccctttttagagaatgtaaatgatttttatgttaggccaaaataaacaacttatagggtacatatgttgttataaaaggtaaaagtgatgcatgccaaaccaaantaaaccaatttggattatttggtatttgggtaattttcacaaaaatgattgaaaaaagaatttgcagtttactgagggcatttcagttcctcctaccccctcaacaggactttgtccagactttcctccttttacctttgtgccttgactgtggttttttgtggcaaaaaactttggttggttaaaataatatggaacaaaggatcccctgaagtga

SEQ ID NO: 725740 - DNA, 312 bp, Homo sapiens
gtgtctgacctgtaatttttatgggcgtacatatgaatagcaagtttagttgaaatagttgatgctgtaatagtttatgctgtaatagtttatgctgtaatagtttatgctgtaatagtttatgctgtaatagtttatgctgtaatagtttatgctgtaatagtttatgctgtaatagtttatgctgtaatagtttatgctgtaatagtttatgctgtaatcagtttatgctgtaatagtttatgctgtaatagtttatgctgtaatagtttatgctgtaatagtttatgctggggttcctctagaggcgac

SEQ ID NO: 725741 - DNA, 243 bp, Homo sapiens
cgtgcacaggttaatcgcttcacttgataactaccgtgcgccacagttgtctgcttggccgtgttctacgccatcgctggggggcttatcctggagagggcctactactacgcctttgccgcacatcacacgtgcatcacggacaccacccgcgtgcgcatcatcctgtcgcgggtcacatcatccatcatctctttcatgttctcctacctctcgctcatcatttgccgtaatcttatcacc

SEQ ID NO: 725742 - DNA, 667 bp, Homo sapiens
ttgttttagaaaatagctttataggctaacattatgttaatgtcatttaatgtttgtcatttaaaatattttaaatgttttctgttagtttctttttgtatattctatgggtattttattgatacatgatagtgtacatttttatggggtgcatgtgatatttgatatgtgcatacaagtgtagcaatcaaatcagggtaatgggatattcatcacctcaaacatttatcatttattgtgtggaaacattcaaaccttttcttctagctatttatccattgtggatacttatatcaattctatatcttagctgtggtggaaataggaggctggccaataacatgtaggaggtgccagatacccacaaaaaaaaaaaaaaaaacaaaacaaaaaacaccacgctttgttgcggcgccccccgcggcgccccgagaaaagagttcctaagaccccacctgcgtgtgggcgcgcgcgcgcggcgcccaggttaggttaggaacccgggcaaaacccgggtcccaaaggagcccccggggccagccccacgctgcggtggctcctccccccaaaaaaaaaacccgccgcgggcccccgcgcgctctggaacacccccagaggcgcccggggcccccgggcccccccacggggccagaagctgaataacacg

SEQ ID NO: 725743 - DNA, 145 bp, Homo sapiens
actctcatacccgcgctacacaattatgaatatcagaaatcaatacctcttacatcatcactgtttcacagctatgcctgactaaatgacacttgaacaaataactacatatagcaacataacttacgctgaactttatacctcc

SEQ ID NO: 725744 - DNA, 227 bp, Homo sapiens
ggggccccgggggggccggcccccaaaacgggggggggtttttttaaatttgcccaggtcccgggggccccccccccccgggggccccccccccccccttttttttccccccccctggaagcccccaagggaatgggggccccgggggccggggggctttttttcccgggttttttttttttttttgggtaaaaaaccgggggggggccggggcctttgttttttta

SEQ ID NO: 725745 - DNA, 482 bp, Homo sapiens
  misc_feature (315)..(315): n is a, c, g, or t
  misc_feature (370)..(370): n is a, c, g, or t
  misc_feature (399)..(399): n is a, c, g, or t
  misc_feature (455)..(455): n is a, c, g, or t
agagggtttctatatcgaaggcaagaatctttagctcttcttccccctccattggtattaggcctttgtcgatgaggtatctctttgcaaatggaatatcgtattcgaagatgtccacaactgctggatgttctctaactttttctctaatagtgggaacatcttggggatgttccaaataaagtttccacacggtaataggcttgccgagaaactttttctcaaccttctctacatcaacaattctcacaatctttccatgcctttcccccgttattttcttaacttcttcaatctttgaatcatccctgagangagcgtaaatgtatggtctaaaagttctatcatgctctatcttaaatctcccgtnctcttttttgatagcctaatacaggtttnccttcttcctctaggagagacaaatgacagattctgacatttatatttgtgtattncctggatttatagtatgtgactttcct

SEQ ID NO: 725746 - DNA, 434 bp, Homo sapiens
  misc_feature (24)..(24): n is a, c, g, or t
  misc_feature (29)..(29): n is a, c, g, or t
  misc_feature (81)..(81): n is a, c, g, or t
  misc_feature (171)..(171): n is a, c, g, or t
  misc_feature (237)..(237): n is a, c, g, or t
  misc_feature (314)..(314): n is a, c, g, or t
  misc_feature (317)..(318): n is a, c, g, or t
  misc_feature (337)..(337): n is a, c, g, or t
  misc_feature (345)..(345): n is a, c, g, or t
  misc_feature (377)..(377): n is a, c, g, or t
  misc_feature (401)..(401): n is a, c, g, or t
  misc_feature (415)..(415): n is a, c, g, or t
aactcctaaaaccccccttccggnaaaanatcccccctgctggacccgaggaagcgctgtgcccctgagcctaagaaaggnaggtggccggatggaagtgggaaagtgaagaagacactgatttttaaaatatcaaaaatttccccttcctgaagtcgttcgggatgtgtncccttaaaaagaagatggaattctctgtagagcgtctcaatcccacttttaacccatggatgagancagactcccatttaccctgaaatagcagcttctcttgagaggagagtgacatggaagcaactccgtctgctgccgcngannccctcacactgagttcagntgtccgcnctccctccctcccatctgggggtagtgccttntgctgggtgttggagcagagtganggagcggaaaatanagacctgcacttttcgaaa

SEQ ID NO: 725747 - DNA, 1132 bp, Homo sapiens
  misc_feature (217)..(217): n is a, c, g, or t
  misc_feature (258)..(258): n is a, c, g, or t
ctgattattgtgtatcacggtacagcatcgtagggttcccctaaatcttgccctgttctacgtgtttatagtttgttatccccttactgagcggcctctactaggtggctgtgattaactgtcccaagcacggatagggaacgtcgaatgggttgagcctctggcagatcactttgtaacccaactcctgcctagatccctgatttcggcgtgcctngatcgtgggcacgcagaaaccttatgcataacgtgacctgntctctggcggcatgtcagtggtagacataagactctacctttaaacaatccaagtcagttccgtcattcactatcaacagatgccgaggctgtgatcacacttaggacgcgcagctcaatccgtaatcagtccgttcagtcgcatttctacgtctgtcgtccgaactcggacaccagttaggtgagtgtcgaagctcagagattctggggcagtaagatcaaatgtccattgtttactgattgcacttctagtctctcttggtctggttacctgtttatccaggaatatttgtatggccttttcaggctgcgtgacgtttaggcagacaaaccatgtagagtacgccccatatgccctgcaacggttcctgtcggctctcaatgtgtcgcgtgcttgtgaccaagtccgtacatggcgtgatctccaggctcctttcccttgtttgggctgccacaagaccatgctacccccagaagggtcaatgttggcgcagctggtagtagggctctgatgctgcttctacagagctttcagtgcttgagcaggagtccgacgcccattggatacacgctccattaagcgagtagggaccatacatgtttccggtctccctattcagaacccagttgcacagtgttgacacaagggggcctcagggttcccagtgtaccatgtcactggtgatatcctacgaagctcagtttgtcacgtaacgttcggggtcattccctgggtgttgacattgccacgcgcgaaatggctcactttccctgagcgaatgctgcctcctgattttagctgcatgacctccaggcttctggctttgacacttaattaagcccttcttcctggtgaacccggatactctccatg

SEQ ID NO: 725748 - DNA, 1527 bp, Homo sapiens
  misc_feature (3)..(3): n is a, c, g, or t
  misc_feature (1220)..(1220): n is a, c, g, or t
ctngtatgttacgggcctggcttctacgtggtcctcactatagagtcgcttcgtctctaagtagtgcgtctccgcgtgcgtgctgtgtgaagtaagattgttggctgataatccttggtgccccctgctgttgtgaggtggtgctgagtgtttgtctattggtgggcgcccggtgtgggttgttataatatatgagtgggttggggggaaagaatcgcccactaggtgtgcaaaaatatgttggtgggtcgcaccacagccacactttgtgtaggtgtggatttgagttttgataagaaaggggaatcttcttttgggggggccaactacaaagggtgggggaacgaaagccaggctgctctgtggctctctatgcgcagtggcgcctaaaaggcggtggtgtgctccaacacaacgtctgcccctcccctcagggggatatgagggggggggtcgttgtgcctctccccctccgcggagttttctccccgtgttgctttaggtgtcgcggccgccggcttgtgtgagggcgtcctcgtgtgtttctccctccccgcagtacgcgcgttgttgtatgacttctcccccggaggtcccaccccccctgtgtgagagtttgtgggggcgccccgtcgcgccccctttcgcgctataggcccccccccctcgtgagaccacatcccctctctctcacaggctatatctccctcacagcgggccacccactcgggtcgtcgcgctctctcgagagggagagagagagggagatagaagatagagcgctcctctctctcgcgagggctctttctccactcggccctcttctcggactctgtgtttctttcgctccacacacacgctgatcacccacgcgagactgtctctctgagtgacacctgcgggtgtgtccacacactctcacacagagcacacacccacctcaattgcgcacacagcgcgcccggagagccttctctctgagaggcgactctcggcgccacacgttgtcccacagggcgccttctcactctctctgagagggtgaacagagaatgtgttacgacactctcacacgctgctgcgcacacgcctctcacacagcacacagtgtggactctcacacaggcgagacacctctgatatgccccaacagctctcctctgggcccgcgcgcctctcacacacttcttgagaaactctggtgttgtcccagagagagnccctctgagagcccacaggccacacaggagtttgtgcccacaaatatgtttctctggggggcccaaccacaaatgtcacaggagagccgagaccctggggcgtgcacacacatcccctgcccacatctcccaagaaaagacctgttccctgtcacaggaatttgtttcccctcttgcctgttggccggtgacctgcttttggaaccacagaacacaggctcccgactccccgagtattttttcccggaccccttgagtgggccaacccaaccccggctccccagtatccataaaccccttttctgta

SEQ ID NO: 725749 - DNA, 632 bp, Homo sapiens
  misc_feature (408)..(408): n is a, c, g, or t
cacaggcactattcacagtgtggaagccttaggggaacatggagaaagaaggagaccacataccccaaaggacctaagaacactttaaaaagcaacatgtaaaatgatggaaattaatatagtacagaatatattccctgtgagatcttctttgtaatgttcatggtactgcctagggcggtgctgagcacacagcaagttaataaactgactgaattcatttacaaaaaaaaacaaaaatgaaaaataaaagaaaaaaaaacaaaaaaacaaaaaaatcaataaaaacaacgaaagaacaatcaaacaaaacgaaaaaggcggcggcgccgcccgcacagaacatacctcccgccgagcggaagccaccaaccagtcaaggcagcccaccacacctttgttttgganaagcagagctgggccgcccccatatgatggaggtccgattcctattctatcaaacagacaacgcggaaccgccgcggccgcgctctttatcacacccagctccgctgtgacaggggcacacaccgagccccatctcggccgtgcgcctttcgttgtgggagcagagacccagcactccatctgtagccggggcggcacacacttgatctgcggaccgaacaacc

SEQ ID NO: 725750 - DNA, 178 bp, Homo sapiens
agactgtggtcaatgactcccctcaagagccctgcagcaggagggacaggtgcaggagccatgccacagtcccgacagaagagcctagtcctgaaccgggcagggtcacccggggtcacaggaagagaccccaggagcagcacccaggagtcagaaacaggactggctggatgggatg

SEQ ID NO: 725751 - DNA, 440 bp, Homo sapiens
ctcaacgcttatacttcattagaatataatgatgactaatgcatatgagcaccatctttttgtgccaagatgcttttttgggctgccagctcaattgatcttcacaatgagttctatgaagtagaagagtagtattcgcatatcttgcacgttgggaaacaggttcacgctcaaggtgaagtcgtagttgggcacatagctagtgagtggcacggtcaagatagatagcaatcaggtctatctgtccctgcaggttgatcacctaaacaggcgtgacacctgtgcgtcaccgggcaggtacagagataattgaggtgttctcttcctactctctttaaaccgtagggattggctacactgggtgtggggtcgaggggtaatttaattgaccgtggtggatacgtgggctctgtagtagaaggatcaagcgttgaggggta

SEQ ID NO: 725752 - DNA, 436 bp, Homo sapiens
  misc_feature (2)..(2): n is a, c, g, or t
  misc_feature (368)..(368): n is a, c, g, or t
tnacatatccccaagaacatctaaaagcgttcccagtaacatttgcttagtccattcactctcaaaaacacgcccgtcttcctacctggaaacttctgttgagggatgcgatgaaggggagtgaggcgtttcagtgctgcctcagcccaatcctgattctccgtgtggcagcgcttcttgtgttctaggtcgccccacagaaccagttatgtgcttacgcctgtgtctctgtctgtgctgttcccttcctggggccagcaccagggctgctgggcaggcctttgtttgcagtgtgggaaacacccactctggggctgggcactatctgttcgagaatttaaaagtgatcataaatctgtatggaaagntgatgtgcttttcgttattaccatgcaccagcatttccagtcagtgttcgggccataacatcatctgt

SEQ ID NO: 725753 - DNA, 353 bp, Homo sapiens
  misc_feature (8)..(8): n is a, c, g, or t
  misc_feature (28)..(28): n is a, c, g, or t
  misc_feature (307)..(307): n is a, c, g, or t
  misc_feature (349)..(350): n is a, c, g, or t
tggggttncccccccagaaagaagggantccttaaagaaagtcctaggcagggggcaagtggcctcatgccctgtaatcccactttgggaggcctaaagtgggaggatcaccttgaacccccaggagtttaagactagcccgggcaacacagcaagatgccccatctctacaaaaaaatttaaaaattagctgggcatggtgtcatgcacccgtagtcccagctacttgggaggcttagctgggaggagttggagctcgagagttcaaggctgagtccaggagctggaggctgtagtgagctatganttgtgccgctgcactctagtctgggtgacaaagcaagacttnnttt

SEQ ID NO: 725754 - DNA, 175 bp, Homo sapiens
cacgaggaggcgatccgcactcatggagtgtggagcagcgtggacttcctgagtacctccgtgggtgacgatgtgtgagtacaacgaccctatcggaagaggacctgacaggagatcccagccggagcagagtggatttcctgtgccaacctgcaagcggcaatgtgcacgccaa

SEQ ID NO: 725755 - DNA, 286 bp, Homo sapiens
caggtttcggtctagaggatccagacgtccaggtatgcaataaaacttccactttgcagctgagacctctgtcatagctcacccatcccagtccttgctctattccttacccagagaaacaaaaccaggaatgagtagatggaaggggatgcagagttgcgcggctattccacgggcccccatccaactccagctcccatgcagcatcgtataggggtctcattatcccatgaccagcctcctcagccctgaagaagagaccctaccaaggcaagaagggacgtcg

SEQ ID NO: 725756 - DNA, 707 bp, Homo sapiens
ggacatgttcatggtcgtggacctgctactggggctggggacctgctgctacagctgacagacagaactgtgcagattctccgcatggtacacggtgaggctgtcatccatgctgatgcgagaagagggtggagccgggtcttcgattggcccaagcaaaggccggtctgcactgacgatctcaccttatgagctggagtgagatgatcctggagtccaggcccatgggacgaagaacgagagagagcgtctggccgaaaaacaagtcccgggcacaacgagcagggtacagctccggagtcgcgaggaatgactatcttcagagactgccgtcgagtgcctagtccgagcgaggacttcgtgattttgaacagagaaaagctgaagaggagccaggaggctcccgagggagcctctccccgcccctgagtccagggatgctgcggagcctgtggaggacgaggcggaacgctccgccctgccatgtgcggcccatttgcccctcggcgggagcggctaggccgggacgcccgtggtcctcaccccttgagctgcttttggagactcggctgccagagggagggccatgggccgaggcctgggattcacgttcccacccagactggctggctggtgcccacagtgccccggacacatttcacacctcaggctcgtggtggtgcaggggacaagaggtgtgggtgcaa

SEQ ID NO: 725757 - DNA, 539 bp, Homo sapiens
tagtgtgacactatgttctcggagaactatctctatcaccgtttactggatagatagcccataataggcacatagctctgggaggcactgaggatgcgcaactgcccaggggacgacatgggagaggcacacaggctaggggcagtgccagcatgggcagagcgtggacgtgactggcctcactgccctgatgctgccgtctctcctgcacgcagttggacaagctcaggatgatcattgagagcgtggtgacctcctcctacacgctcctgtccatgagcagtgtcagcacctgccaagttcctgtatcgtgagttatttacatgctaggtggatggagcatgtccgttccccatggcatgtgagcaggagcgtgtgcaagcccacacctcacagcccaagagcctgtggcggggcctgtttgtcattagggtcctctgtgtgtttatggcccggtatactagcagcagcacttaacgatttagctaaagagagatgtctcatgctagatggtgggctgctgagaaagctcagaggct

SEQ ID NO: 725758 - DNA, 716 bp, Homo sapiens
  misc_feature (10)..(10): n is a, c, g, or t
  misc_feature (55)..(55): n is a, c, g, or t
  misc_feature (63)..(63): n is a, c, g, or t
  misc_feature (74)..(74): n is a, c, g, or t
  misc_feature (98)..(98): n is a, c, g, or t
  misc_feature (124)..(124): n is a, c, g, or t
  misc_feature (165)..(165): n is a, c, g, or t
  misc_feature (172)..(172): n is a, c, g, or t
  misc_feature (186)..(186): n is a, c, g, or t
  misc_feature (191)..(191): n is a, c, g, or t
  misc_feature (197)..(197): n is a, c, g, or t
  misc_feature (210)..(210): n is a, c, g, or t
  misc_feature (218)..(218): n is a, c, g, or t
  misc_feature (229)..(229): n is a, c, g, or t
  misc_feature (242)..(242): n is a, c, g, or t
  misc_feature (244)..(244): n is a, c, g, or t
  misc_feature (269)..(269): n is a, c, g, or t
  misc_feature (274)..(274): n is a, c, g, or t
  misc_feature (281)..(281): n is a, c, g, or t
  misc_feature (300)..(300): n is a, c, g, or t
  misc_feature (302)..(302): n is a, c, g, or t
  misc_feature (315)..(315): n is a, c, g, or t
  misc_feature (326)..(326): n is a, c, g, or t
  misc_feature (333)..(333): n is a, c, g, or t
  misc_feature (343)..(343): n is a, c, g, or t
  misc_feature (382)..(382): n is a, c, g, or t
  misc_feature (389)..(389): n is a, c, g, or t
  misc_feature (414)..(414): n is a, c, g, or t
  misc_feature (420)..(420): n is a, c, g, or t
  misc_feature (422)..(422): n is a, c, g, or t
  misc_feature (434)..(434): n is a, c, g, or t
  misc_feature (438)..(438): n is a, c, g, or t
  misc_feature (441)..(441): n is a, c, g, or t
  misc_feature (445)..(445): n is a, c, g, or t
  misc_feature (448)..(448): n is a, c, g, or t
  misc_feature (451)..(451): n is a, c, g, or t
  misc_feature (477)..(477): n is a, c, g, or t
  misc_feature (492)..(492): n is a, c, g, or t
  misc_feature (495)..(495): n is a, c, g, or t
  misc_feature (511)..(511): n is a, c, g, or t
  misc_feature (529)..(529): n is a, c, g, or t
  misc_feature (569)..(569): n is a, c, g, or t
  misc_feature (601)..(601): n is a, c, g, or t
  misc_feature (612)..(612): n is a, c, g, or t
  misc_feature (649)..(649): n is a, c, g, or t
  misc_feature (654)..(654): n is a, c, g, or t
  misc_feature (694)..(694): n is a, c, g, or t
cttttcctcntcttctctgttgttgttcatcctcagggctgggtggggtgcagcncttgagtnccaagtgtgtngaggctcctggtcctgggtgtgcnggtggatgagtgggcacatgcccccncctggggtggtggagccgcttcagtggaggtggggcatgangcggtanggcacacgccggcngtgcncctgcnaggccaggccgtncttctgcnggcactccgcncatcccgggcctnanggtgcaccagcggcgcggtgaagtngaggnggtagangtggggcagcgggggtganancccgcggcaaggnccaagccaganccatgangaggtctccnagaaagtggggatggcggaccataccccaccacccaganaccagcngtttccgccctgtggctgtggaganggtctnangcccagccactntggngtnaganggnttntttcggaaagtgtttttctgggaatncgccccacggaagangtngtaaccaatagcattnatgaggcagaagacagangccatgggcaaccccaggggctgcgggtggtgcagcaggnactgggcctgcaggctgtaggtgaagggcacncaggccatgtncgcaaacgccagcgtgaagccaaaaccgttatgtgtnatatncatggtggtgaggacggcctcctcgtgccacacggcatcnaccacgtagagcgactggtagc

SEQ ID NO: 725759 - DNA, 251 bp, Homo sapiens
aggttacagcactgccgctgagctccaccttctcagatgagcagcagcgttagattctcataggagaacgcacctgttgtgaaccgtgcatgtgagggatcgaggttgcgctgtccttatgagaatctaatacctattgatctgttactttctcccatcacgctcaggtgggaccatccagttgcaggaaaacaagcttaacacgcccactgattctacattatgggtctccctctgttgtccaaggctgg

SEQ ID NO: 725760 - DNA, 156 bp, Homo sapiens
ggcagagtaggctgtggctcgtggacttcagcacaaccatcaacattgctgttcaaagaagattacagtttacgtccattccaagttgtaaatagctagtcttttttttttttttttttttttttttttaaaaaatacaatggggttttttttatt

SEQ ID NO: 725761 - DNA, 414 bp, Homo sapiens
cctggcttgctcaggtctccctattccttaagaaacaagaatactgaaattaggctaattagtaatcccacaatggtctcttaagtgttcaggtgaaaggaagaatcacacatccctccctctaaatcaaaagctagaaattattaagcttggtgaggaaatgtacgtcaaaacctgaaataggcaaaaaactaggccacttgtgccaaatagttagccaggttgtgaatgtgaagggaaaggtcttgaaggacattaaacatggtactccatgaacacacaaatgacacgagaacaaaacagccttattactgatatggagaaagtttgagtggtctggatagaagatcaaaccagccacaacattcccttaagccaaagcctagacctgagcaagccagggggtaccgagct

SEQ ID NO: 725762 - DNA, 237 bp, Homo sapiens
  misc_feature (85)..(85): n is a, c, g, or t
  misc_feature (89)..(89): n is a, c, g, or t
gggatactggacttctcgccccactacactcctttgtcttgactagtctggagttgagataggtgtgaagggcgagaaggcttcnaggntcaggtcatgaggtggatcagtttctttaagccgatgggtccagacttttcagccctgccagagaattcctaattccatctctcaggttttccagtggtaatgaaagctagccaagttggctatgctaaccaaagaaggtcaggtatg

SEQ ID NO: 725763 - DNA, 528 bp, Homo sapiens
tgcaagctccaggacatgcaagagatcattcccccctttggggaggaactggacgccctacgccccgaactggggcggccgaacatgtaatcccagtgctgctgggcctccaaaacccacctggagaaggaaatcaccccgtcccgacggctcctggggggggagagtgaagggacccgggaagaatcaaagtcgggcctgaaagtgtctgcaactccaaagatcaaggccataacccaggagaccctcaacgggagatttgttctttttcaagtgaatgaaatcccaaagcccgcctgggaccaatgaaagtttccccctgttgtaaaatcttttttcccccaagggaagtccttgcccagacccccgggggtgggttttaaaagatacccttggaattatcagacccagaaactttttttttttttttctgtaacagtctcccccgacttctcataatgctcttaatatattgcccttttctaatcaaagtgcgggtttttgggggtaaagctctactttcctcca

SEQ ID NO: 725764 - DNA, 757 bp, Homo sapiens
  misc_feature (28)..(28): n is a, c, g, or t
  misc_feature (74)..(74): n is a, c, g, or t
  misc_feature (88)..(88): n is a, c, g, or t
  misc_feature (98)..(100): n is a, c, g, or t
  misc_feature (104)..(104): n is a, c, g, or t
  misc_feature (116)..(118): n is a, c, g, or t
  misc_feature (122)..(122): n is a, c, g, or t
  misc_feature (135)..(135): n is a, c, g, or t
  misc_feature (143)..(144): n is a, c, g, or t
  misc_feature (146)..(146): n is a, c, g, or t
  misc_feature (148)..(148): n is a, c, g, or t
  misc_feature (153)..(153): n is a, c, g, or t
  misc_feature (156)..(156): n is a, c, g, or t
  misc_feature (184)..(184): n is a, c, g, or t
  misc_feature (186)..(186): n is a, c, g, or t
  misc_feature (190)..(191): n is a, c, g, or t
  misc_feature (193)..(193): n is a, c, g, or t
  misc_feature (198)..(198): n is a, c, g, or t
  misc_feature (201)..(201): n is a, c, g, or t
  misc_feature (236)..(237): n is a, c, g, or t
  misc_feature (245)..(245): n is a, c, g, or t
  misc_feature (256)..(256): n is a, c, g, or t
  misc_feature (288)..(288): n is a, c, g, or t
  misc_feature (291)..(292): n is a, c, g, or t
  misc_feature (295)..(295): n is a, c, g, or t
  misc_feature (305)..(306): n is a, c, g, or t
  misc_feature (310)..(310): n is a, c, g, or t
  misc_feature (314)..(314): n is a, c, g, or t
  misc_feature (317)..(318): n is a, c, g, or t
  misc_feature (333)..(333): n is a, c, g, or t
  misc_feature (363)..(365): n is a, c, g, or t
  misc_feature (371)..(371): n is a, c, g, or t
  misc_feature (378)..(378): n is a, c, g, or t
  misc_feature (400)..(400): n is a, c, g, or t
  misc_feature (412)..(412): n is a, c, g, or t
  misc_feature (439)..(439): n is a, c, g, or t
  misc_feature (450)..(450): n is a, c, g, or t
  misc_feature (452)..(452): n is a, c, g, or t
  misc_feature (457)..(457): n is a, c, g, or t
  misc_feature (470)..(470): n is a, c, g, or t
  misc_feature (482)..(482): n is a, c, g, or t
  misc_feature (502)..(502): n is a, c, g, or t
  misc_feature (511)..(511): n is a, c, g, or t
  misc_feature (513)..(513): n is a, c, g, or t
  misc_feature (521)..(521): n is a, c, g, or t
  misc_feature (529)..(529): n is a, c, g, or t
  misc_feature (557)..(557): n is a, c, g, or t
  misc_feature (568)..(568): n is a, c, g, or t
  misc_feature (570)..(570): n is a, c, g, or t
  misc_feature (574)..(574): n is a, c, g, or t
  misc_feature (618)..(618): n is a, c, g, or t
  misc_feature (648)..(648): n is a, c, g, or t
  misc_feature (692)..(692): n is a, c, g, or t
  misc_feature (735)..(735): n is a, c, g, or t
taatggaagaccaggcatagagattgancctaagacttatgtttctgaagaagaatctagaacaatcaaaaganaaacaataattgangatataattnnngttnactttccaaaannntccngacagggcaatcngaggtttnntntnttttnttnttgtttcaggtaaaatttaccaagattntntcanntncaganatntcctgacaagtttttttttttcaagctaatttttnngtgttttntttgttcattntgatacagaggggggggggggggggggggggnggnnggntggttggttnntttntttnttnnttggttggttttttngttggttggttggtgggcttgttggggttnnngttgtnttgggtnggtgggagggatgataattttnctgacttttttntgtctactacaatggagcagtagctgncagagtttttntntggtnaacacttagatgntaatttttctcncaaattagtttttgtttttnggggctgantncctttagngttcagantgtctgccactcacatattctttttttntcttttttatntntttnttctgcccaagtgatgacttaaaattactcaagaatggaaaaanacagagcgtcaaaggactagcagtgagtgntgaagccaattacacacagagagttggtctaaaacaattgtttnactatggttacaagacagaatatgtgtcaaaaatacccaaganccaagagacatacaacatcaaa

SEQ ID NO: 725765 - DNA, 762 bp, Homo sapiens
attacttatatggtataaattaaagttcaggcatttatggggagaaaaggccctccccaccgagccgatcatcggtgccacatctgacggagtggtgagaagttagtctgtgcctaccgcagtagtactgacgtcccgcttagcttgttcgtatactagtatagagttgatcacgtgatagatcgctcaacatggcatgctataatcttgccagtctgtagcgttgactccgcttttggtcattattgacagcttgagattttagttgccattatgttaaaaacatctaaataggtgtcagtttctcaggagtagattgttagtgttgacttttcctgtaaacgcagacatcgttcttggcctgccctgcattgtatacctagatttcattgttgtctctcatgcttcttgagttgcttcatggtttatgctcgcatggaaagctatcagtaacagtttcatgcttataccaaagaattaaatctgatctttaatatctgatattttcctggtactcgtactgataagggattatcgcgcaagtcagtcacagaattttggcaaataaattctagtctctccttagctattctgatgctttctcatataggccaagaactcattgcaaaacattttgcaaggatgaatgcctgtatttggtctaggaacagtacatttcagtctgatttagaattactggttcgcttattcctaacgcccaggaaaagcagctgcagcccaagtttgcctgtctttacaatg

SEQ ID NO: 725766 - DNA, 142 bp, Homo sapiens
cgatcctgcgcgtctagacgttgttgctcgcgggcttgaggtgatctggtgaagttttccagcgcggatcttttgtttcatagtgaaagcgcgcgtaccacagcacagtgccgttttctttgtcgcgaatctcgtactcgtc

SEQ ID NO: 725767 - DNA, 1000 bp, Homo sapiens
cccattctaatcgcaatggcattcctaatgcttaccgaacgaaaaattctaggctatatacaactacgcaaaggccccaacgttgtaggccccatacgggtctactacaacccgttcgctgacgccataaaactcttcaccaaagagcccctaaaacccgcacatctaccatcaccctctagatctaccgccctggagcttagctctcaccatcgtcttcatacgtatgaaacgccgccgcgtccccatacaccgaaagcggccctggtcagatcgcttcgaaccctagtgcggctccatatgtattgattctagaccaacgttctaggcctgagactcggtttatcgtcaaatccctctgtatcagtggatgatgacatcagagacgtcaagacgtacgtcggccgtgactcggagacactgcgagccagtacgccacaacaatctcgatatgataggttcacccctagcccatcattgctatcgtataccaacattgacgtaataagtggctcctttaacgctctcgcgcccttatcaacgaacacaagaacagctctgattactcctgccattcatgacccttggtcataatatgatttatctccacactagcagagaacaatcgaaccccttcgatcttgccgaaggggagtccgaactagtctcaggcgtcaatatcgaatacgtccgcaggccccttcgcccgtattcttcataggcgaatacacaaacattattataatgatacacctcatcatacacatcttgctaggaactacatatgaccgcacctctcccctgaactctacacaacatatttgtcaccaagaacctactttaaactccctgtcctgatgaattcggaaagataccccgattcggtagaacaatcataacctctatgaaaaagttcttaaccatccaccaagttctgtttgatattgtccatcctaaatccagatccctaaacttaaaaaaaaaaacggggttttcgggg

SEQ ID NO: 725768 - DNA, 320 bp, Homo sapiens
  misc_feature (156)..(156): n is a, c, g, or t
  misc_feature (164)..(164): n is a, c, g, or t
  misc_feature (203)..(203): n is a, c, g, or t
  misc_feature (205)..(205): n is a, c, g, or t
  misc_feature (270)..(270): n is a, c, g, or t
  misc_feature (299)..(299): n is a, c, g, or t
attagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagggtgcgtgaacgagtnaacgtaancaacgcatgcaggcgcagtgggagcgcgaggagctgagncntgggagattgcccgagagaggctggccttccagcgccagtctggaagcgggaccattggagcggngaacggctggagcgcgaacgatgcacgtngagcacgagcgcaggccagca

SEQ ID NO: 725769 - DNA, 310 bp, Homo sapiens
tgggggaggggtccaaagcttaaagctactttcccagtagttggccattttctccgaggtagttggggctggctctttcagtaatggctaattggtgtggtcaaatttgggtctacaacagtaggcaacagatgaagataagtgggtggaatggtctccagcactatgcatccctattttctaatttatgggtggtacactcacttttcagtaaatggtggtttcaaacgtgggtggttttttaaaaaacaaatcaatggtagggactggaatgtggaatgtagcaatggtaataaagttaattgggtct

SEQ ID NO: 725770 - DNA, 288 bp, Homo sapiens
cgtcgacgagagagagagagagagagagagagagagaggaagagaggaagaggaaaggctagagagaaagagagagggaaagaggagaggaaagaagaagacaaagagatggggaagaggagagagaagtgagaagtgagaggtgagaggacaaaggagtgagagagcaaggtgggggctgagcacccttttatggtcttcactgttgttaggtaactgaggagggagtcagatgtctctgagtagctccacaggatgtgctcaggggttcatagtggacaggtagac

SEQ ID NO: 725771 - DNA, 211 bp, Homo sapiens
ggagattcttataagtgggagacaaggaagggaacctgagctgcccgggctactgcccttacctggggcttcattggagtacacagagatgcggtccaactgcaggtcacttggccccgtggtaagtgccggtggggtcgatgccatgttcattactgatcacctcccagaacttggcaccgatctggttgccacactgaccagcctggat

SEQ ID NO: 725772 - DNA, 128 bp, Homo sapiens
  misc_feature (85)..(85): n is a, c, g, or t
tggtgaactggaataacttggcaaactacaattatactaaagttttatactggaaaattcaaatcagcttactcataatctccangatagctcttccatcattattttaattaaggggtaccgagctc

SEQ ID NO: 725773 - DNA, 1665 bp, Homo sapiens
ggggattttttaaaagcttcctaggaagagatgatctccgatgtgatgaatacgaataaaagggccctttaatgggcaaaaaaaaaaaaaaaaaaaaaaaaaaaaaaaaaaaaaaaaaaaaaaaaaaaaaaaagagagagagagagagagagagagagaagaagagatatataatatattataggaagagagagagagagagagagagagagggaggggggcgtgtttatctatgttcatctatctagctgaggggggcgcgatgcaataattgatgaggcgtagaacatcaagtatatatgtcagaggagagagcaaagaggagcgcaacaggattataatcaagaggagtagtatatatattactggagcacaagaccaacagagagggagaaaggaaaaacaaacaaaaacaaaagaagaagagcaaaggagggagacgacagagaggcccggaggcggcgaaccaaacaaaaagaaatagcgcgaaagccgacagagaccgacaaaacagaagacgcaaaattgtgcaaacagcccgacacacaggagagagcggagagagaatacaacaaaagaaagacaaaacagagagaaagaaaaaaaagacagagagccgcacagacaaagagaaagcgacataccaccctcccacatcactatgacatagaacaaggagagaggagaggagatagagagagagacggaaaaaaaaagaaagaagcagggagacataaaagaggccgagcaagacaaatagtagtaataaaaaaaccagagcacagggcagagacgaaaacttaacaaagaaagagaaaaaaaaaagagacaacacaaccaggcgggagacaggggcagcggcataaaacgaccggagggcgaccaagaagaaagaggaaggaaaagaacagcaggaagacaggacacaaaggaaaaagaagcgggaacagaacgagacgaagaacaaggagcaaggcgaagagaaaggaggacaaggaagacaacacaaaagaaagaatagaaaaaacaacagaaaagaagaagaaaaggaaacgagaacgaacgaggcgccagaaaagaagcagaacaaagacaagaagcacggaacacgagacgagaaacagcgagaaacgaacagagaaaacacaaagagaacacagaagagagagaaaaagagaaaaggaaaaaaagaaaaacaaaaaaaagaggaaaaaaagaaacagagcaagagagacaagaaagaacaaaagaagagagaagagaacgagggggaggcaaggaagcagggaggagggagagaagagaggggagagagcgaccggcaaagagcgacgggcgacaacgggggggaggagcaagagaggcgcgggacgcagcgagaggacagacgaacaccggaacgagaaacaacgaagcgaagaagaagaacgagagagagagcccctaacaagcgagacagaaagagacgaacagacaccacaaggaagagccgaagaacagagccacgaaagtcaaagacaaggacgaggagagaacagaagagaagagggaagcagaacggaagagagaaaaacaaagagccgcggaagaacgaacacgaaagagagacggcaagaccgaagaacgagaagagaagaaacggggagcaagacaggagatagtaaa

SEQ ID NO: 725774 - DNA, 302 bp, Homo sapiens
accgatcgctctctctggtaggggataagtggcaccaaggttgtgtctgattctgtcagtgtcaagcattcacggctccatcaaatctcagggaagcagtgattggaggacacaatttgacctattaacctattcatgcgttagtataggttggacgctcaatatcgaggttttactgactagatgtcatagctggtccctttgtctaccatgaaggcacaatcagagtgctccagggtggtgtgggtggtgaggatggagttgtagggctcaactacagctgtggaaacctggggcgccgg

SEQ ID NO: 725775 - DNA, 103 bp, Homo sapiens
cgcctgaatgtgtctgcgttctgttagcataatgtgaggaggtggagagacagcccacccttgttgtccactgtgacccctgttccatgctgacctgtgtttc

SEQ ID NO: 725776 - DNA, 420 bp, Homo sapiens
  misc_feature (2)..(2): n is a, c, g, or t
  misc_feature (53)..(53): n is a, c, g, or t
anaatcctgtaggtttacctttgtggaattttgaaagtaataatagacatatnagctaaagcaaaaccggactaatttgtaatgatttatttatttatttatttatttatttttattttttttttttttgggacggagtctcactctgtcacccaggctggagtatagtggtgcaatctggactcactgcaacctccacctcctgggttcaagccattctgctgcttcagcctcctgagtagctgggactacagcacctgccaccacacctggctaattttttgtattttcagtagagacaggtttcaccatattagccaggatggtctcgatctcttgacctcgtgatccacctgccttggcctcccaaagtgctgggattacaggtgtaagccatcgcgcccagccaattttgtgatt

SEQ ID NO: 725777 - DNA, 104 bp, Homo sapiens
cgcggacgtacactgaccacgcacgacacgcactggaccacgaccttgtacgaccgacggacggacacttcgcccactggactggacggacggacacttcgccg

SEQ ID NO: 725778 - DNA, 1161 bp, Homo sapiens
  misc_feature (281)..(281): n is a, c, g, or t
  misc_feature (657)..(657): n is a, c, g, or t
  misc_feature (748)..(748): n is a, c, g, or t
ggattaatagagtggctggacacatatacggtgaccttgacatggagctatctgttgaagcaccatgttcccaagcaggagcacaggcggctgtaccgtgagtgatcccatggggcgaccggccgctgtgaaactagtagagagcattaggcctgaacatagaaatgctccagggacacagaccatcgactggtgtgggagcttgtgactactgcgtagatgttcagtcaagggcctgctacagtcgttgacatcgagaactagctcgacgctctttatgntaggcaataatcgagacaaacgtacaacgttgtccgtgcgtagtacgtcgtgctatatagaggtcgagtggcactttcggtgcaaggactagacgttaacaagggccacatgatagagcatgtgtccatgggcaggcaatcccggcgtgccgctcaccatgtccggcccatggcgtgcatccaacgacatccgtcgcacctcaatgtgcacgtaccaagtgcgcgacatggcggaattccctgtcgagccggaatatggcgcaggaacaagaaaccactccgtggataacaaaaacgttctctaagtgggcctggggcgcccaggtgggcacggaacctatgggccggagcccgaattgaaaatccgggacgcacntacggaagccatctcgggagaggccaaatagggcggatatcgtgggcagtacccgccataagcgagccatgcgtgtgtcttaggcacaagnattcacccagtgtaaggatctgcactgggcccgtgtatattgaggcgcttaagagactatcggccccagggtctcatagttcaatagttccgtggggacttggacttataagccaccaacaagtgtgacgcacaggcacaagacagcgaaggagggccgcgattgtacacttgggttaacccaaggtccaaagtttccacacatcggggacgagtaacgaacgcggagccaagacagtataccccaggggcgtgcacacattgtgcctccggcggcgattaccaaaagtgagacactcgctcgtatgggtgcactcccgttggcccatttcaaagccgcgaagagaggccacaaatctcacgaaagtgtgagggacaccttgtggcttgggaatatcaccataggcgatcacg

SEQ ID NO: 725779 - DNA, 839 bp, Homo sapiens
gtgttaaggtggtcactgcaatgattgctgtgcctgcccatgatgtgctgctagatgtgctgcggaactggagtgatatgctgctgtgtttgctgttggttggcttgtggtgctcgtgcttggttgctgtgctgtgcttgagctgtggcctggtggcttgggtgctgagtgtgcacttggactgtgctgtgccagtgctgctccctgtgagcctggctgctggaagctggcaagaatgcctgaggctggagtgtgccctgtggtccagtactggtggtgcgagcgctgctgccctgcgccgatcgcgtcttcgtgtgggtgcttcagcttctcgggggcgctggtgctgtgccttcctttgtggtgcccagctccgtggcccgggcccctgctgcctggctgccctgaccgctgccgcaggatccagcccgtgccctatcgcctggagctggaccaaaagatttcatctagcttgcttgcaggcatatggattcacacttgctgtcctctaagactgcggatgttacgaaagtctggggtgatgggactcaacaaagattctcagcttggatttcacatggagcctggaaagataaaacgaggggctacgagtatgtgtatggagaccctcacccgtactccctgacctcttggacagacctcaatgagacaacgggtgctgcaaggtctcctgcggacgagctcactactcttgtgtagacttgacagggaaggagtcttcaggcattgggaaacaattcttatgggccatgttggagaaggttgttcgaaatgagattacagtgaaagttcaagagtccacaggaatcagaaattca

SEQ ID NO: 725780 - DNA, 276 bp, Homo sapiens
tcataagattaagctttatgacttgtagggtggtaggatcctgtgtcatgtctgggtgacgtccgcatcagcaggatgcattggggtatattgtctctcgattgctgtatgcaggccctggggtaatctgttgattcgatattacatatcctataattcgagggtgggcatccacgtgtttccccattggtaccagctcgtagccacgaggtgtcctgggtgcagactggtggacaaagtagaacgaaccttcttttcccgctctgcaggcatggg

SEQ ID NO: 725781 - DNA, 587 bp, Homo sapiens
gttcccactctgtcacgccaggctggagtgcagtagcacggtttatgactcactgtaatctggaactactgggctcgggtgattctcctgacctcagcttcgcaagtggctgggactacaggtgcacaccaggcatgcccggttaatttttttttgttttaatagagacggggactcattatgttgcccaggctggagttcgcgtaagtggtgcaatctgtgggctcactgctgacccaatcctcccaggctcgggcgagttcctgtccacctgcagcctcctgagacagctgtggactgaatgcttggtgccaccatgccttgctaattttgggattattctgtacagacggggtccccctatgttgcctaggttggttagggaaactccataggccgtcagagcgatcctccacacctcagcctcccaaagtgatttatctctaattagcccaagggtgctatctaaagccttacaagtgcttggaacatagcagtgtcgaaagtaacaaatatagatcccatgctgaggcgactgcatccagaccagctaaagtttctaaataggccacatagaccgagggacc

SEQ ID NO: 725782 - DNA, 1391 bp, Homo sapiens
cgggaacgcgccggcgtgagaataaggaagcagttgacgctgccgtcgtctactggcttgttacgagtgagcactgcgaacaccctgcatgtcgcgtagtgtgacgcgtgcacggtcatgacggcctcgatctgtgcgacccatccccccggcgcggagagaaccacccaccttcccccgcggctgctatgctcgtcaccacgtcctgtttcggccttgcacgcgggtcccttgaacgctcgcatgcgaagatcgtctgtggccgcccgcgcgacaagcgcaccctgcgcagttctgtgagctggttggacgcgaggcagctgttgcggcgtgctcctgcattcggccggaggcgccgtctccagcacgagttgcctgtccccacttcgcttgaccgaatcccgcagcgcgccctgtgagcggcgttagtctcctgcgcagggctccagtgacgcccggcccgcgtagcggcgggtgactgcgcccagttcgtgcctgatgtgcgcctggtccactgggggccgccgtcgcgataggcttcgagacgtggagagggcatctgcacgcgtgcgccgccatggggtagcgtcgtgccggacgcgtgccaaacgggacgccatgtggtgccttgttgcttcgcgtgctggcgtggttgcctggacagtagcagtttccgattcgcgcccccctttgtgggcggcctcggtggaggccatccccttggcccccaggggcacttgaggccgcattttcttgcgaaggggcaccgacttgtgtccatctgttgcgccaagctctgtgcgtgtccgttgtgggcggacgccggtgtgggcgcaacgacgcggggccaccacgcccccgcggttcgtttgccgccttgacgagcccccttttggcacctacgttttcaaccaccaaattggggggtgccccgcatagttgctttggccccgttttcgtctcgcccggttcccaacttttgtgtgggggccacattgtggtgtggtttcaaagccccccattaaagactttttggggcccattcccgtgtgtttatggcggccgacgagtgaccgcgcgcgtttgcgcggcatagaccgtgtgttcctgtggcaaaggggaattgtgcggccgtgggaggccaccgttgtccgaggtaaccctctgtgcccctgtgtaagtggcacgtctgttggagcaaacctttcccaaggtgtggccttgtgatgaacctatgtaggcggttttctgccccctgtgacgaggttgtactttagaccgcgaccacaagcgcgtgaaactggtcgcgtcacccgcgtgtgctcccgggccgcgccccgcgctttttatccccccgtggtttttttcggcaggccctttgctttcgcgcc

SEQ ID NO: 725783 - DNA, 114 bp, Homo sapiens
tcacaaataagagcagatggatggaacagcttcagttgaattcaatggacctgctgaagtcccatgatgtcacccaatggatccattcctcccattcatgtgcctccaggttat

SEQ ID NO: 725784 - DNA, 959 bp, Homo sapiens
  misc_feature (657)..(657): n is a, c, g, or t
tggatcggatattccttcctcatgcacacggaggacggagagacgaaggcggtggccatatcactggtgtcacccggagcaggactgtctagaaggacttaccgtcgcctacaccattcatcgacatgcaatggaggccgcggtacctgcacactagctacgccaacaagtacagcttctggctgaccaccattcgcgcagcgagagctaccagggcctcgccacttccgcgcaagacgcagctgcaagggcctggcactcataccgtcacgacacatcagcacgcgtgccagtgtgtgctatgatagaagcctgtgatgccgcccgtcagtagcctacggaagggccattgttggatgcttattcttaagttattacctctaaggtgccaagccaagaaatttggttagattctgttctttaatgaaaaagaaaaggtctaccagagaggagatttgtgcccctccaggcatggcagacgagcttttgatgagccgtgctcgaggcacaactgtcgaaccgaagcggggtgctaaagacacctacggagggtcccgtggaggggcacggccttgtgtccaacagaaagccaggaggcagaccttggtacccctcgtcagtcctggttagacgcgccgtcgtgtacaaggcacgggntatagcagttccgtcacacgccgcatgtaatccacttgcaattttcacaatgcccaggatgacaatttcacattgttcaaagctcctcttcctcggggggtgttggaccagtacgaggacaaaccagcaacgataggatgccaggccgtgggcagaaaggctcaagaggggctacagggggctcaggcaaccgttccccaaaacaaggggccccgttggggtggggccttgggcccaaggttttctacggcgaatgttatgccacagccatgttgtttcccaaatcgtcgggggagagggaa

SEQ ID NO: 725785 - DNA, 409 bp, Homo sapiens
cgcacatgtagatttctctgtgcgcgtgcgcgttccctcttcccccgccctcagggtccacgggcaccatggcgtattaggggcagcagtgcctgcggcagcatatggcctttgcagcggcggcagcagcaccaggctctgtaacggcaacccccagaggcttaagccatggcgcttctcacggcattcagcagcagcgttgctgtgaccgacaaagacaccttcgaattaagcacattcctcgagtccagcaaagcaccgcaacatgaccgcaatgagcttgctgagcaccgaggtgttggtgggggacttgatgtccccctttgacccgtcgggtttgggggctgaagaaagcgctatggctcttagacgagtacctggaggtggccaagccttccctcgggttctt

SEQ ID NO: 725786 - DNA, 114 bp, Homo sapiens
ctgttctggtgtcgtgtcacagtcccaattgtagggctgtgtcatggatacgattaatgagatcctgccatttcagatgcagacttttacatatcacaagggcacgtgggatcg

SEQ ID NO: 725787 - DNA, 878 bp, Homo sapiens
agcgggtcggtcccggaggcggcggcgcgtgcggagggtcacctcggttgggggagaagatggaatgagttgaggtcaggccctggatagtagctttgctgtgtctcaagatctgaacaggacagcagcccgacgagcccccggatcgtatccgcgagtacaaatgtccaagatacgagttccttgagagcagagtgagcgccgacggagggtaactgggaactgcggaaatccaagcggcctgggattatgtgaagcatgccgagacagactggctgaagatgactggtagcgaggggatggagagtgacggaagatagaataagaatagatgacagaagcaaactggacattgacaactgtctaagaagttaaccaaagagacagcatatgctaatcaattgatgcgtttctgaagtggtgtaatagaaggttgcctgtcagaagtgtggggcaggaagtggatatgtgggtacgtgatgcacctgataggaggaaagaagactcttatcgtggactccaggggtgtctaggagaatgactagcaggcaagagtggcataactgtagtcaacgaaggttgtatgcatgtacactgtctgggcacggagtgcacagcagcgtcgaagactcatagcaggcaacaatgaactatgagcacatgtctaagatttgggatttatcatagtgaaggtaaaggcagatggtacctaagatttctgtgatgatgaatgtgctgtgtggggggaacatgccttgtggatgatttggccagaatgactattccggattcgtactgtgatggagttcaagaaggttgagcagaaagaagaaggagggggaagaaaaaagcaagcttaatcctttgaaacaagaggg

SEQ ID NO: 725788 - DNA, 378 bp, Homo sapiens
ggaagatggcggccgttcaggcggccgaggtgaaagtggatggcagcgagccgaaactgagcaaggaatgaagctaaaggagacggccttaaagttttaaaaaggaaaggaaggcaggaaaggggggcccaacccagaaagggccttagtttgggaaacagctaaacccaaggccacttcttccttccaccaacccacaccactttaatttggtggggccccatagggaggagagctgtgccccaataaaatcacttcaaactcgcagataagcatttcataacctgaggatcagtggggagccccataccacacagtttccatgtggacatctcactcacttacttcatccaaaatatggtcaccttcagcctgggg

SEQ ID NO: 725789 - DNA, 292 bp, Homo sapiens
cagatgaagctaaaattcgatatttagtagttttcttgctgaaatagagatggcatttgtttttttattgtcattaaagtctattaagttaattttaatttgtttttacaaccaattactaaaaatggcattattattataatacatttgaaattccagaacagttaaaatcatggaaataccaagttgaaatatacttgcaatatgttcttgcaaccattactattttaagcttaattataatatattatccaatgaagcaattaggcattttataagcagataaattcac

SEQ ID NO: 725790 - DNA, 329 bp, Homo sapiens
attcgcggccgcgtcgaccaatggcgcaatctcggctcactgcaaccttcgcctcccaagttcaagcaatactgcttgctcagccttgctgagtagctgggattacatgcatatgccaccatgcctggctaattgtgtatttgtagtagagatggggtttctccatattggtcaggctggtcttgaactactgacctcatgtgatccatctgcctcaggctcccaaagtgctgggattacaggcgtgagccaccatcccggccgggaactccgtcaacgcggccgcgaattgagtagtagtggtagtgatagtagacgacccgggaatt

SEQ ID NO: 725791 - DNA, 153 bp, Homo sapiens
ggaagacatatttgactttcatttagaagacggcacattcttacttcttgaacaacagttcggcttttcttctctgaacgtggcctatgctaatgctttagtctttgagtattgtgatgactgagtgagaggagggatttgcttggggcagca

SEQ ID NO: 725792 - DNA, 1878 bp, Homo sapiens
  misc_feature (1684)..(1684): n is a, c, g, or t
tcgcggcgcggcacggggcggggccgcgggacgccaggaggcggcagcgcggcacgcctggcagcttagacttaaactgcccttaactggcactaacagaacaacactctggacctgcttaaacgacttgaacctactctgtaagcctactgccaactgcgacttcccatcacgctgggcaaaaccactgctactgctaaaaccaaacagctgctgcgcgcttcacactgctgaacgcacactgacccacactctgctctctgcacacactggcgccgcactctgctctaattcacacgctgcacgcgaactttccacgccccaaacggcctctgcactccacttgcactgcaaaccccaacctgcgccttaaccttgtccctctccaactgcaacaccaaccctgacacttctcccacaccgccaccctaacttacacaccttacacccccttgacccttcccaaaacctccatcaccccttgcaccaccgccaacaagaccaacccttcttcccccacccttgcccaccacgccaaagcacttccctccacaaagaccccaaatatcttccaacacttccaaacgcccatttggacttggacgccaacctttcttctcacaacccgccaaaactttcccgggccattccccttaaacatttcgtccccaaccccaacagtcccgcctttcccccgccctgtttcccgctctactggcgggccaaaataacgggtccaaccccgttgtgcgggagcccattactcataacccagggacggccactttcagtcaacgcggccgaccccttgtctaaacaagccaaagggggacaaaacacacccttcacatggcacgacaccaacccgccaacaccccgcgcccctcatcaggggcagcgcccccaccccaaaaaagcgccggggcaaacgacaaccgttttataaacgcccccacttgacgatacaccccgggggcccgccccccacccccaactgttggggcccaaaacaccccccccccctggtgcgcagtgcctaccgaccgcgcccgtgtccaagacgaaccaaacatgcacgacggggacgggcacccactccaacagcacaaccctcctcaaaacccctctcgggcgcgcctctctatccaccaccaacacccgcccacacttcctcaccccacaccgcctttgtggcggcgaaaccacacccgccccccacccaccccggtggagcaggcgacaaaacccccatttcgtaggcgccgggcgcaacaacaacccccgcccgacccccctcctgtgggccacccacccccacaatgcggcgcccaaaaccctcataactgccccagcaaaacaagacgaccccctctttctacaacccacttcttttcccccccacatacatccccccccaacaacagcctcttttttacactcgcacactcataaaacaccaaagcaagacgtcttattatatcgccacacgcccccacatcctgggaggccactgaatcactgtccaatcaccccacggcgatgttcaaaaacaaactcatctatcgcccaccacacccgacctccctccacccgcatcaaacgaaccaccatttacacttatcccccactaatccacgtcacaaccctgaagccgcacaaaaccactcttcttcctcccccgcanacaacaacctactatgaggccgccgatcgacccacacacatccctcttttcacagatgctcaacactcacttaaccacaccgcgcaacatggatgacaccccccacactcctacaaatcccactgcccaaaaatacacgctcattttccagtaccccaccaacgagagcaactaatcccatatcaatggagcgc

SEQ ID NO: 725793 - DNA, 443 bp, Homo sapiens
gagtggtgttgttggggggatgtggctctttggggtgtcaggccacggggtgagcccaagccacgaggtgagctggaacaagaagggcaagaaggtcaactctcagacgctttgagacgacttgagtttgatgtagagtgcatggggcagtgctagaggatccacgccgctgtaggacaccgcggggatgaaaatcgtgtacgatgtgtgtggcccacgaactcggattgggagagatcactagtccgatgccaacgctatactgtcctccgcagaggacctagctgcctctcctggcttccccgaacatcaacgatgggcccactagttgacaggtggtcggacgcggatcacggacagccacccatgctctgtgcagccatgcggcaacccctgaccctgacgatcacctgtgttcaacggacttccctgcctgtggatcc

SEQ ID NO: 725794 - DNA, 107 bp, Homo sapiens
acgtgcagaatggcacctcgaaagggaaggaaagaaggaagaccagtcatcagcctcggacctcagtggctgaaggagagaatgtatttggtgtctgccatatcttt

SEQ ID NO: 725795 - DNA, 183 bp, Homo sapiens
gttcagggttgttggaaaggattcaaactggctaatgggggaaaggggaaaccaaaagggcaaggggccaattacctacttaaaactgctcaattaagtaggggggctatggaaaggttgcccctcatgactttggatttaaaaacaattaactttaaataaagcaggttaaggtttttccca

SEQ ID NO: 725796 - DNA, 108 bp, Homo sapiens
attgattgtactggtacaggctcgtaggaagagacccgcactatactgatcctcgtcggggggaagtaatggcaatccccgatccccatcacgaattggggttcaacg

SEQ ID NO: 725797 - DNA, 598 bp, Homo sapiens
  misc_feature (327)..(327): n is a, c, g, or t
tgtggagagggggtctcagtctttcctcgggggcagtggcaacgaccacgtcctctgctgggtgatcacaagggcttgctgctctgtccctgcccttggggtgccccactctggatgtgggggagccacctgcctctactgggggcccagcagccttctgcattagccgccctgcagccagcaaaggagcggcggagttcctcctcttcatcatcgtcgtcgtcgtcctcctcctcctcgggctccagttctagtgactcagagggctctagccttcctgtgcaacctgaggttgcactgaagagaggacagaactagaggaaaggnctttaatttaacagcggggagggatggcagttaggacctcaagaggaacttcccttgggttggagggatcttcagagtgtgtccccagccccacccaagccccaagggaggcttgtcgagagggacgtcctcgggagccaaccccatgcaaagggaagaggggctctagcagttccagttccagctcctcctcttcatcttcctcctcatcctcctccttctttttttcctcctcctcttcctcttcttcttcttcctccttattttcctt

SEQ ID NO: 725798 - DNA, 226 bp, Homo sapiens
tgatctagaggatcccgtgtgctgggatcataggagtatagtagttcgcttggactgggtgaagtcttagcatgtactggctcggaggtggggtgctggctccggaggtcgccccaaccgaaatttttaatggcaggttgggtagtttaggaccggggggttggtaaggtacggttggcattaataaattaaagctccatagggtcttctcgtccggcggtccaac

SEQ ID NO: 725799 - DNA, 1302 bp, Homo sapiens
  misc_feature (291)..(291): n is a, c, g, or t
  misc_feature (351)..(351): n is a, c, g, or t
  misc_feature (436)..(437): n is a, c, g, or t
agctaatcaaggccatttaagtcccaagcttagctgtctagcttggtcggatagaacgagcagggttctatgcgtcgctgtgccaaggtagtagcaggagtgcagtgaagggactgaccgctcagcgagcacagcactactcctgactgggcatacatagtggtgctggaatcttaagactatcgccttttcataacgtaccaggggcatacaatttcatgcaccagaggattaactcctgaaccgtgcatctagaagagactattattcgggggcacacatacactcagnagactgaggctggtgttgactagatgtgctggcagacacttaactactcgaaactgtggnaagtctgtttgtgcaagatgagactctcttggtgctcatgcgctggatcaattacgaggacagcagctctttagtggcacctggnntagagtcgccacacgagtggaacctttagcctaaccaagctaggcttagttgagctatgcaacctccagcgacagagatagcggcgcaatgctacactcgtttccaaaatagttatgttgctagcatacctaaggctattagagagcccaaacaagaggcgatttagatagccacataatcgccatagcgataacaatgggttcaccgccatggggcagcctctttaggtagtaagtttgtggggatcttaattgcgccgacattttggcgccgataccctatgggtattgaattttccccccaaactttaacaggaacttttttaaaacaaatggtttatccattgttaaaacaattagtgtcctgggatatctttttctcaattaaattatgggccttacctttattatttatttggatggttaggtataattcctaagaaaaccaaaagaaatatagatatacaattttttcaaaggaaaaaaacaattggggggcacagttttgggccaggaaaacatttggaaacttgggcaggtcagccaaagagcaagttaacacttttcatttgggttgggccaaccttttatatatatccgggctaaatttattaaagggtttacgaggactttatttgtccttcctttaacaattttccccttggtaagaccaaaattttttcatataagccgattataatactctaagtggtaaacttaaggaaacaaaattggccgagggcccagcttgggtttttgtttgccaccccaaaaagaagctttaaccatggttcacccagttgcaacttttgtgaaacattaccccctctcaacactttgagaggggggccagatggccaatgga

SEQ ID NO: 725800 - DNA, 170 bp, Homo sapiens
aaaaaaaaaaaaaaaaaaaaaaaaaaaaaaaaaaaaaaaaaaaaaaaaaaaaaaaaaaaaaaacttatcgttaccggggaccttcgaccttgatgatgatgatgatgatgatgatgatgtatacccgggatttccgaaccgggacctgcagccgtcccagttttcctttt

SEQ ID NO: 725801 - DNA, 231 bp, Homo sapiens
cgccattagtgtcaagtatttcttcaacccccagtgatgcaaccttcgtagatcagaagtcggttgtcggtctcactggactacaatcaaggtgccagcaggactgtgttcgtttctggaaattctagaagatgatctgtttccttgcctcttctagctcctagaggtcactcacatcattcttcggccgtggccccttcctccaccttcaaagcccacaacattgattct

SEQ ID NO: 725802 - DNA, 1036 bp, Homo sapiens
  misc_feature (988)..(989): n is a, c, g, or t
  misc_feature (996)..(997): n is a, c, g, or t
atattctcagaccccctcgtccctcaaatctctctctccttgtttaccacttacctcccgctcatacgcccatttccgtgcccttttctgacaccccctggggtccgccacaatttcccagcctttaccctccggatactatccttcctctgaaacctgccaccgtaaaaggcctcaccgctccccactcatccaggaaatatcaacacatgtgtgtacatctgtttcagccagtttctcagatcaaataaggagccttgtttacccgatccccagcacttctattccgacaaccatttgaagcctccagagaagaagtaaggatggaacgggaatatatgttctgcgatattaccgaaaccgtatcgatcctcaggtacatcttcacgtgccgcatcaagccctttctggttccacagctgcctcaagtatcttcatattacagatctccgtacaggcagcgcagcccggtcagggcctccgccagcgggccttcttgacaccgcgtggcgagctcccggaccagcgtctcaaaggcctccgccggcataaaaatccgcagccgtctatcccgaagaagccctccggcgtgacgtttccgggcggggagaacatcactcgctccccctggtgaccgtgcgtcagggcttccggatgccgggcatacagcgtgaacaggcccagcagttcggataacgcttcccaccgtacggcaccacgaagtcctggccggtgatcagcaggtgcagacgggtgtggtgtaccaggcccccgggcgttctccgggtgctggccgtcaacgcggatctccaggcgcagcgtgccggcctcaatggtttccgtgacggcagaaataaccgggcgcagctcctgtgccagcgttcttgcctgttctgtgttccagtccagccgcgcagcatcaacgggaaaacagctttcagccgcggcagggtgaagatttctgccagcaccgcgtccggcacctccnncagccannacagtcgctctcgagataatcgtcggtcgaaaagtatat

SEQ ID NO: 725803 - DNA, 382 bp, Homo sapiens
gttgcactggtgctgactcaaagaaggtcatgcatgttcttctctgcgtacgcgcggcctgctcctgtcgggatctgcctgcttgacgtgccatgtgcagcctggtttccaaccaagatcctgggggactcctgtgtgcatgctcatctgatctccgttgatccacgtggtctgatgcctgtcaacaggaccagctgtgtttgatgatgtcatcacaccaagaggcatccccgtgagctgccccttggagtagtgcacttgaatcatggttgcagcacctgtgcctgtgcctgaatgtgtcccaagcatgctccatgggttcactgcgcgcgggctggtccagccagggattggttggttggtcttgtagtcgatccctgtt

SEQ ID NO: 725804 - DNA, 454 bp, Homo sapiens
cccggagggagaagcgcaggaaaggcagcaggggcacccgacgcttccagctgcccaggcccggaggggcgccccccataggggccccatggggccagggatccgcgccgccgccgggatgctgctgcttcttcttcatcgcctgctccgctgcctcccacagcctgcccgtgccaggaaaaggtcacccatccgccgcgaggaggagagcccggctgaccggctgcacatggggagggccgcgcggagggcagccgggtgggggcggggaggggccgaagttgccgggctcaggagactttcttcggcatggtccccgccgccgcggcccgagcggccgaggtgtccggccccggttcggggcgctgcccgtgacggggcgccgcgcccgtcccgcgcccgctagcgtccccacgccccgcgccccgccgcgcctcgggctcgcttgcggccg

SEQ ID NO: 725805 - DNA, 414 bp, Homo sapiens
  misc_feature (399)..(399): n is a, c, g, or t
ttaaatacatgtggaatttcccttataaaagtccccctttaatacctacattgaccctaactgctgttaaattgttttgtttccataagctgaagtccttactttaattattcaagatacagaggccgggccgtggtggctcatgccctgtaatgcccagcactttgggaggcccgagacgggcggatcacttgaggtcaggagtttgatatcaaccctggcgaacatggtgaaactccatctctgctaaaaacacaaaaatcagcccaggtgtagtggtgcatgcccgtaatcccagctacttcggaggctgagacaggacaattgctttgaacccgggagacagaggctgcagtgagctgagattgtgccactgcactccagcctgtgtgacagagngagacatcgtctcgg

SEQ ID NO: 725806 - DNA, 167 bp, Homo sapiens
tttttttttttatatttatttatattatatgctatattcttataataaagcaagctaaagaaaatagtaggaaaatcataaggaaaagaaaatatatttactactcattaagtagaagtggatcatcataagtgtttcatctcggccctccccttcccatctttcct

SEQ ID NO: 725807 - DNA, 203 bp, Homo sapiens
gtgttgagatccggcacacccgtaggactggtgtcccgctccggatgtcacatattgatgccgaacttagtgctggacaccgatcggcatagcgcactacagcccagaactcctgggctcaagcgatcctcccacctcagcctcccgagtagctgggactacaggcacgcgccaccgcgcccgggcctgtagcggggttgttg

SEQ ID NO: 725808 - DNA, 324 bp, Homo sapiens
aatacagacaagttaggtgcgccagcatctctgatgacagaagtccaatgaagaatgggacatggtcccaaggggagtttgcccaaggaaagagagcatcaacatacaatgggaaacaaccatctgacagaaattcactttattgtagcgcactctcagaatcacgaggatccattgtgatgagatgtaccctgaatataaggggctcagaaacagcggggatccgacttcccccgcgtgttttcagcagagtggaaacagctgtcatacgacccaacatctgcatcctcaccagcacccagcccttatcactggagctcagga

SEQ ID NO: 725809 - DNA, 357 bp, Homo sapiens
gacttacatttgctctttgttgttctgtctcttccattgtatttgggttctggttttgttttatgatttcttacctagaagaaatcgtagatagccattagtttttaaccttatggctctgtgtgtgctcccgttggttatgtgtctgttccctttcgtgccttctctccctcacaccccagctcatttaagacaattgctcagcctctcaggacatctgcagccctgctttttaagaatacattgagttttgaactcaaattactaacctccagccttgcaccaggatagatttaatgagcaaagttttgttatgtaaaaagtaaatctacagtgtatctaacatatggtcgacgc

SEQ ID NO: 725810 - DNA, 913 bp, Homo sapiens
caccacgctcgactaattttgtatttttagtagagacggggtatcactatattggtcaggctggtcttgaactcctgacctcaggcgatctacccgcctcggctcccaaagtgctgggaatataggcgtgggccactgcacccggttttatgtatattttgtagttttttattctttttttttaaaccttttagcttgagtgatctctgggttaatccattgaattaacgggagaaacttggttgaaagtcacacacacaacaatttggtttgggacaacccaaggccaaaacaaaagaacccttgcctctctcctcttttatattctttattattattttaatcagggaagggggaagacctcaactttggtgtcgcccacgtgtgtgataaattgtatgcgggggcacagcatcatcaaagttcaacaggtaagaagcccccaaccttttctgatttgtcacggcaatttctctgtggccttaccgcctcatggatatttgggggaccacacggtgtgccaccacacacaggcgtgtgtattttttctgtgggatttcacgagcaaaacggggggttccacagcgatatctgcggaagatggccctgacatccggcaagtgtgaatcccaccgcatgactcccaaagtcctggattcagggggtaacacttccccgggaaaaccggttctctatataagggccgcgcatacttggagtagcgtggtttcccgtacacctgtaatgcctttttaaaccccgtattccatgggcggaacgtatttagtactgcaacagtcgttaaccctgagcccggattattacgatggcgcggcacggagcaaggcaccctgtggggtgccttatgaccttccagaacattgcacctcgccgcgctacctgttcacttgtt

SEQ ID NO: 725811 - DNA, 175 bp, Homo sapiens
atcagaggatccgccggtaattttttggtattagtagagatggggttcactgtgttagccaggatggtctcgatctccggacctggttgatccgcccgcctcggcctcccaaagggctgggattacaagcatgacccatagcaccgggccagtattttcttttatatccgtattc

SEQ ID NO: 725812 - DNA, 165 bp, Homo sapiens
gtgacggtaaacttcccctcatactcagcctcacaagccccaccgccagctgagcaggctgcctgcccacccctgtgccccacagccagctggctgtgccagagcagagccatgccacatctgtatatagatggggattttccaatacagctggttcgtgataaa

SEQ ID NO: 725813 - DNA, 503 bp, Homo sapiens
cgtgagaagatctgagtcaagcacttctcctgcctcagcctccgagtagctgggactacaagcgtgcacctccatgtccagctaatttttgcattaaaggagacggggttacgcccaagtaggacaggatggcctcaatctcttgagctcgtgatccaccccctttggcctcccaaagtgctgggcgtgagctgctgcgcccagcttatatttatttttggagatgcagtctcagtctgttgctcaggctggaaggcaccatctcggctcactgcaacctctgcctcccaggttcaagcagtgctcctgcctcaggctcccgagtagctgggactacagctgtgcgccaccatgcctggcttagtttttgtattactagagatggggttcaccatgttggccagggctggtctcaaactcctcacctcaagtgatccaccttccttggcctcctaacgtgctaggattataggtgtgagccactgcacccagcctagaacagg

SEQ ID NO: 725814 - DNA, 307 bp, Homo sapiens
  misc_feature (25)..(25): n is a, c, g, or t
  misc_feature (36)..(36): n is a, c, g, or t
  misc_feature (78)..(78): n is a, c, g, or t
  misc_feature (120)..(120): n is a, c, g, or t
  misc_feature (155)..(155): n is a, c, g, or t
  misc_feature (186)..(186): n is a, c, g, or t
  misc_feature (188)..(188): n is a, c, g, or t
  misc_feature (202)..(202): n is a, c, g, or t
  misc_feature (268)..(268): n is a, c, g, or t
tcataaaagtcttccggtttgcggncagcaacgtgnctttgcccggcccattgcccgtaggtataagggcgctataantcctggtaaattccactgccaggtgctgctggtagttttctnggcgcgcttccggcagtatcccctcgcacggtttntggcacaacaaggccacttttgcaacttgcncncgcactcacgtctnccatgctatcccctaacgcggcatatttgcttctacccacagtgtggcattagatattccagtccngtccgtccgccacttaccccctctttattaaaaaaaaaa

SEQ ID NO: 725815 - DNA, 316 bp, Homo sapiens
  misc_feature (58)..(58): n is a, c, g, or t
  misc_feature (110)..(110): n is a, c, g, or t
  misc_feature (131)..(131): n is a, c, g, or t
  misc_feature (191)..(191): n is a, c, g, or t
  misc_feature (226)..(226): n is a, c, g, or t
  misc_feature (249)..(249): n is a, c, g, or t
  misc_feature (272)..(272): n is a, c, g, or t
  misc_feature (295)..(295): n is a, c, g, or t
  misc_feature (307)..(307): n is a, c, g, or t
  misc_feature (311)..(311): n is a, c, g, or t
cagatgaaaatggacttctttctctccccaactaaaggatattaaagttaggggaaanaaaagatccttgaaagtcatgataatttctgtccccctgggtctcattatanagttttcagcccttgggcctnttttaaaggatggtataaaatgactttcaacccctttgtgaatacatatgggtatataanaggttattgataaacttttgaggcagacatttgtntcgctttttttcatttttgttgngttttataaactgactgtttttntttgcttggatactgtgattccnaaataaatttcntccnagcca

SEQ ID NO: 725816 - DNA, 123 bp, Homo sapiens
acacacatgaatcatcctccccctcttttttatttcctcagtgtaccgggaattattagattaaggagtatggatactttgcatggcttagtaagtgtgtctgtgaatctagccatattctca

SEQ ID NO: 725817 - DNA, 394 bp, Homo sapiens
cattgtgacaatggcacatcgggacttggaccatggaacaccgactctatgggcccttggtaatccgtcactgcataatatggagagtgtatacatcgccaaagattcttctgatctgacattttgaaattgtgagagaaactagatcactgtaaacttggtcacaggcctagttcttgcaattctttgcggactttttactagcattatgccagataaacatgcagtctcagtgtgctctcgcatgtctaaatatctagtcctttctgtggttctcagccaagacataaaaactaggactcagagcacattcgaaaccagttatgtttcggaaagagggaaaagagtccccaagcccggatcttgtgctgcttttctcactttcgggaaaggg

SEQ ID NO: 725818 - DNA, 125 bp, Homo sapiens
ttttaaaagtgggggaaagcagggtggcagctttccagtcaggaggcaaagttttttttgaacaatcaaagcccttggacttttgctttttttactttgaaaaaaaaaatttgttgcccagctga

SEQ ID NO: 725819 - DNA, 750 bp, Homo sapiens
ggctggcgctgagcgtgtgctggtgatgtgctgtgggtgccctgcgggttcgtgtggcaacctgagtgcctgggtcgctggtgatccggcctgccatcgccgctgccgctgcactggagagcccgcgggtgatggagcgggaggcgttgccggtggtggcctcgagccccaggatgtgcagagttctgacgaaatgaggagccccgaagtggtacctcagaggcaacatgagtgagactgacggaagaggaaatttctcagcaagaacggcatgtgggggactatgaagtcgaagacgataccatttgggcttgaaccccagagccctgggtttgagccacaaaagcccagagttttgaaaccccaaagccccagattttgagcctgaaagcccggggtttgagtcccgaagccctgggcttgtgcccccaaagccctgagtttgcacaccagaagccctgaatcagattctcagagcgccatgagtattgaatcacagagacctaggtatgaaccccaaagccctggctatgaacctcggagccccggggtatgaaccccggagacctggctatgaatctgagagctctagatatgaatcccagaacatgagctcagaacccaaagccagaatttgagctcaaagttacaaattccagggaaggtgcggagatgttctgaacccgacgaaaagagtccttgaatatctcgggaaggagtaaccatggatacttcagccaggagtaagag

SEQ ID NO: 725820 - DNA, 152 bp, Homo sapiens
tcctggaccacggctagagttcccagtttggccttaaagggcattcatcccatctacttaatttaaatctttaccttcctggtccttcctcagatgggtgagctggagctacttttcccccaccacttgtaggggactgctgctctgtgtct

SEQ ID NO: 725821 - DNA, 541 bp, Homo sapiens
ggaaggcctggccaggacgtgaaggaacatgagcgagagcacaatcgcgatatgcgctgacgccaatgatccagtacaggagagtgggcttagcttacaataccgtggacaatattccaacatggtgcgaagagtacagatcacagctctagctcattctggaccaaggccatgcacagcaacttcctcctgaggacttaatcctcagacatatttttgtagacgaactgtaagacttaagtaatccagtgaaagcagccttacatatgcttaacactaatgaggacaatattgttgcatacatctactagaaaccaagcggcacaatcctggttgagccgaagtgtcaactagatgatctagcgaatgatctgcatattgagattgatttaagtccaactttgtatgaccaataaatgggtcagttgttgtcacgtgttcattcaccatcaattttttgaactttttacagagtgagtgttaccagatgtacaccaggtatcgtgtaaataccctcaagtagcttaatttactttttttg

SEQ ID NO: 725822 - DNA, 794 bp, Homo sapiens
gcttctaagaatattattacactagattactaactgtttgcgagctaaccgcataagtgcaagcaaggtaacttacagaaaactgaacgcggaaagctacatggggatgggactctctagtagtccccagtgcgaatgtgttagtagcattgggacactgattctgtacgtactatataaacttgtcataatatgaagagatatacaataagggtgtgctgtatatgtaagcgccgttacgcgaatggagcccccatcaaaggagacatactggggcctacaaatgaggtaatgatgatggcttctccttctgtaacttaatacaatgcgagacccctacatctctgcggacccttatggagtgcatgtagcgcatgagacggtaatgtacgcatctagaagacgcaactatatgatcaagactcaatatataccgtgggtatgagcaactgaaaatttgtgctacagagaacaggcggtggtggaccttcatggagccattatgggttctccaagggagtacggaatcccctggaatccacacagactcaccagtcaagagcagcaacgaggaagagagagagcctcacatgggtggagagagtgcctgccagagcgtacagttcgctcacacaaactgaatctccgcctcctcacagttgtcatgtaaaccccttgaagaggtgaggggcctagggagccgcatcttgtcatgtagcatcaatagtgtacctgtgctcaatatgatgcaaatggggggcccgttgcggactgaaatataattttttgaaaaa

SEQ ID NO: 725823 - DNA, 245 bp, Homo sapiens
tttcctaaaacctcctaagaagtgttaattattacagcacaaccttatgcattacgggggaaaaaaagcagcagcccaggtggaacaacgtgtcatggcacagagagcctcaggtttaagttagaaagacaattcatacactctgtttgtcccaccctcgggggtaagggacagtagttgttttttcttttaaaaaatttccgggccacgcacgatggttcatgcgtgtaaccccagcatttgga

SEQ ID NO: 725824 - DNA, 502 bp, Homo sapiens
  misc_feature (339)..(339): n is a, c, g, or t
  misc_feature (502)..(502): n is a, c, g, or t
taaaaaaaattatttttttttgtaacacccttatgtgtatatatctctcccatatattgtgtgtgtttttcaaaaaattttttataaaaaacccatatataaattctataccttctctacaaatatgaggcgttttatataagaaatttttatatataagaaaaagaaagagtgtgttctctctacttatatatatctctcttatatatagaccacacacactctgctgtgtgtctcctctctctgtgatgaagaacacatctcgcatatatatatttttatatatatatctctctactacaacaaaacacaagacacaacagagagagagcggcggcnctctctctctactagtagagtagtatatctctctctctgtgtggggggcgcgcgcacaagatgtctctcgtctcgcgcgtcgtctctcgcccgtgtgtcttgtgtgtgtagtgacaagagagaagagagcgcgtctctcctcatagtgtgtagagagcgtcgn

SEQ ID NO: 725825 - DNA, 130 bp, Homo sapiens
  misc_feature (5)..(5): n is a, c, g, or t
gccgnacctgtggtgtttactgtggaaaaaggttcgcttaacacatggacccgggggagacccccgcgatactacccatcagaagggttcccctattcggtgttcccaaattaggaaccacttagtgtga

SEQ ID NO: 725826 - DNA, 766 bp, Homo sapiens
  misc_feature (385)..(385): n is a, c, g, or t
agcggcatgagacataatctcctggtgtgccatttgctaagactgttggaaaagcacagtattagggtgggagtgtctcgattttccaggtaccctctgtcatggcttcccttggctaggaaagggaattccccaaccccttgtgcttccggcgtgaggtgatgccccaccgtgctctgtgggctgcacccaccgtctgacaagccccagtgaggtgaacccggtacctcagttggaaatgcagaatcacccatcttctgtgtcgctcacactgggagctgtagactggagctcttcctattcggccatcttggaacctccccctgttcagtgttttttgctgttgttgtttttttttttctttttttgggcacggggctcctcnacgtggtgtttaaggcgtggaagtgtgcaagtggtgggtgactcgcgagcctcacttacttctcttggaacctttccgaggcctcaactcgatccttccccacctctcaaaactccgtggagttagcctgtgagaacttaagggccacgtgtgcttaccgagtgttttggggcatattctcttttcttatctctttctctttttaaaattctgtgggggaagaagaattaacttttgtgggccgagtgttgtgcccgagggcgtggctctctcaaacttctcgagggcctcaaagtgtggactcccatctgcggccttgggccttccacaagaggtgggtggggtatattacccggggtggtgaagcccatgtggaattcc

SEQ ID NO: 725827 - DNA, 479 bp, Homo sapiens
agtctctcttgatatttcactagcctctggtatactcaactgtctctgcgggtgatacgacgatctccgggaataatagacaacgagcagtactatcactactgaccacggccgatcgaccagcgaagacatcgaacgtatggtccatgacgctgcagtaagtcacaccgctgcagatgagaagcaaagggacaaggtgtcatccaagagttcacttgagtcctatgccttcaagcagtgaaagcgactgtggacgatcagaaacttcaaggcaaaattaacgatcaggacacacagaagattctggccaagtgtaatgaaatcactcacctgggttgataagaatcagagtgctgagagaggaccaatttgcacatcaacagactagagctgaagacagtctgccaacccatcatgaccaagctgtaccagagtgcaggatgcatggcaggatgcatgcccgggggtcggacgtgggt

SEQ ID NO: 725828 - DNA, 405 bp, Homo sapiens
  misc_feature (47)..(47): n is a, c, g, or t
cgtcggtgttgtgggtagggtcactggctcacatggcattcagtggnactaggttccttccatcttgttgcccaacaacacttagagtgtggttcaatcacccaaagctggtcattggctttttcttgtgtccttgaccatggggaggagaaagagcaagtctaaggcaagcagattatttcaagtaggtgttgtagaaattgcatacgtcacttctattcatattctatatggcataacttagtcatacgggcacaccttaagctgcgggaagtctggggaaattatggtctctatctgggcagccatatgaacagttaaaattctatataaactctgtaacttacagacagagagaatgcagttatggggcaatcagtttgcagtctaaccaaaaacaccttg

SEQ ID NO: 725829 - DNA, 261 bp, Homo sapiens
ccccatctctacaaaaatgacccaggtgtggtggcacactactgtagtgccagctactcaggaggctgaggcagaaaaattacttaagcctgggaggtaagggctgcaatgagctgagattgcaccactgcaccccagcttggttgacagagtgagaccctgtctgaaaaaaaaaaataataataatccatcacatcaacaactaaagaggaaaaacagtcacatgatcatatcagtagctgcagagaaagtatttgccaa

SEQ ID NO: 725830 - DNA, 1582 bp, Homo sapiens
  misc_feature (1582)..(1582): n is a, c, g, or t
tgtgggcaaatgcaaaattttattggtaaaacggtacccattggctttaataaaaaaaaacaccgtcctcagcatcctcaagaaaggggcagctaaacgcttatataaggaggttccgggggtattctggtattggcaactgtacacaaatataaataatgttatcaatatggagggaagaatttacatatatgggcaaaatatcccactatatatgtaaaataccccacgcaaaaagacgccctgtgtgtgggcgctatatatgtgggatatggcgacatgtgagaagggtgccactctattgtggcgaaacacgtggatgtgcgatctggggacaatgtgagaacacagtgtgtgggacatataatctatttctctgtctcacatagaagaatgtggtgtgtctctcaacacacagattgtgtgtgagaccacagtgtgtgtgggcgcgcacaaacattacaactcttcccacacacaaggtctcgccacagtgtgtgtgtgcgcataaggtgtgaagaaaccacctcttgtgagagagagagctctgtgtgtacacagggcgtcttaattctctgtgggggtgcgcccttgaagaagggcgcgtgctctctcttctataaacatctatattctgtgggtcgctctatcacaactctataaaaaaccatctctcactatagtgggcgctctctgtgggacaacgactatacccgcgcttggggcagcacccctatcctcgtgggggggcaccaaagaccttcgttggggcctccaatgtgtcgtccacagagacgacaatataatccccccaccagggggggaatgtgcgctctccctctggtgtggggggaccaccaaacatgggccctatgcgctatgtgttgtgtgcgtctgtgggggggctccctatattcgcacagggttacagaaagataacctctattacaaccaagggtataatgtgtgacataacactgtggtcctcggaagagaaacatctttcaacaagaacacgacacagcaacacgaccactaagacgcaacaggggaggcgcacaaacaaaattttgttaaaaaaaatttctgggagggacaaggtcctcctccatctaaaagtgtgttggcacacaaacaattccgctttttgcaaaaataacaacctgtttcacccacccatttttccgccactaaaaaacgttttttattcacaccgcgttatccctttgtgaagacaccagaaaaacccgttggtgcgaaccttgaaagcacgcaattacactttgtggtgacagaaacaaagtcaatagaggcccccggtggaaaaaaaaaaggtgggggggagaaaaacgagggacccctcaccaatacggggaggcacgtatcagagggaaagggattccacagtatcttcgcgcccgggggagcccctcgtggttgcctctgcaagcccccggggcgcggtcgcaacccacatgccgggggaaacaactttggcgcaccaaacgaaggacacatcgggaggatcccaccccaggagaaaagacagtgagcgaacataagcagagacacaactacactn

SEQ ID NO: 725831 - DNA, 848 bp, Homo sapiens
  misc_feature (162)..(162): n is a, c, g, or t
  misc_feature (165)..(165): n is a, c, g, or t
  misc_feature (195)..(195): n is a, c, g, or t
  misc_feature (283)..(283): n is a, c, g, or t
  misc_feature (515)..(515): n is a, c, g, or t
  misc_feature (840)..(840): n is a, c, g, or t
ccttcctcaaaggtgacattgtcaggaagcttgtaacaaaaggctgcattgtgcttatagaaccggcagaggttcccgtcatcggggggcgtggccagaaggatccttctggccacgcagaacgtgcgtcagcttaggtataaatctggaatggtgctggcngtntctgccctgttgtttcactactcgtctctngtgtcgttgctgtttatctgggcatcgtggtctcgttggctgaagacaagtaatgtcttggttgtcccgtttgtagtatgtgcattgntgtttttactgagtttgaatggtgactactttctcgccaaattgctgtcttatcaggattcagagtctccaaatccgctgtcgggcctgagtaaggtcggggtattattgctgttcgtggcagcgttgttcttttcaaaacttccaaatgcggaaaaaaccaaactcatagtgttaggcgctggtttcaccatttctttttggttggtgtcagcggtgtcgtatgccggttngcgatttttggatttgatatccttcgcctttcccgttgcgattctcttgacctatagccgtctggccttgaaatttgacacaacaatcaaactcgccttcattatggcgggcgttttgagcgcggcgagtggctacaggaattttgtagccgaggagggtattgggccctctccgttcatgccttatcattttatcggctttccctatggagattagagaggcagcctcattctgcatctagtgaacagcagcagagcgtgtatctggctctcgatcattttatattcatgcggtcgtgaagggcctggagacgaagttgtgaantttagtaa

SEQ ID NO: 725832 - DNA, 163 bp, Homo sapiens
agaagagtcactaaagcagttacagaaatgaacggtagaattgtggcacaaagccattgtatgtagctttagcttcagcgcaagaagagcgccaggtcactcactaaccagtatatgcagagaatggcaagtacgagctgttcccaaccctgtaatcaatact

SEQ ID NO: 725833 - DNA, 281 bp, Homo sapiens
  misc_feature (75)..(75): n is a, c, g, or t
gatctgaaggtcctgttttccagcaatgggggcgtcgtcaaaggattcaagtctcttccagaggaccgcaagatnacactgatcccagatgggctccgtcgaggaggcggtcccaggccctcattgacctcacaaccacgacctcggggagaaccaccacctgccgggtctccttctccaagtccaccatctaagggtgcaggccccaacggccgggccccctgggcgaaacattccatcaattccaagagcaaaagcccctctaaaaaccagcttgaggt

SEQ ID NO: 725834 - DNA, 769 bp, Homo sapiens
  misc_feature (83)..(83): n is a, c, g, or t
  misc_feature (86)..(86): n is a, c, g, or t
  misc_feature (116)..(116): n is a, c, g, or t
  misc_feature (204)..(204): n is a, c, g, or t
  misc_feature (436)..(436): n is a, c, g, or t
  misc_feature (761)..(761): n is a, c, g, or t
gttggtcacacagtatgtctccctccttctgcccgcacaagcgttcgctcattctacgtatagtcctaggaatggtgctggcngtntctgccctgttgtttcactactcgtctctngtgtcgttgctgtttatctgggcatcgtggtctcgttggctgaagacaagtaatgtcttggttgtcccgtttgtagtatgtgcattgntgtttttactgagtttgaatggtgactactttctcgccaaattgctgtcttatcaggattcagagtctccaaatccgctgtcgggcctgagtaaggtcggggtattattgctgttcgtggcagcgttgttcttttcaaaacttccaaatgcggaaaaaaccaaactcatagtgttaggcgctggtttcaccatttctttttggttggtgtcagcggtgtcgtatgccggttngcgatttttggatttgatatccttcgcctttcccgttgcgattctcttgacctatagccgtctggccttgaaatttgacacaacaatcaaactcgccttcattatggcgggcgttttgagcgcggcgagtggctacaggaattttgtagccgaggagggtattgggccctctccgttcatgccttatcattttatcggctttccctatggagattagagaggcagcctcattctgcatctagtgaacagcagcagagcgtgtatctggctctcgatcattttatattcatgcggtcgtgaagggcctggagacgaagttgtgaantttagtaa

SEQ ID NO: 725835 - DNA, 112 bp, Homo sapiens
ctagaggatcccatatttctcatcgccagcaaagagcttgagttgatcaccctgacagtgggcttcggcatcctcatcttctccctcatcgtcacctactgcatcagcctga

SEQ ID NO: 725836 - DNA, 303 bp, Homo sapiens
  misc_feature (103)..(103): n is a, c, g, or t
caagttccagaagagggggtctcccggaaactttgagtctggtgataagaaatcctgccgcgagattattccccagtcaggagagcgccacttacgtagtganggatcgaggattgtaaggaggaatttaggagtgcagaaatttgacctggggatcatctgtgttgacaacaagaatattcagcacattaatagaatctacagagatagaaatgtcccaaccgatgtgctttcttctccatttcatgagcatctgaaagcaggtgaatttccccagcctgattctccagatgactacgattt

SEQ ID NO: 725837 - DNA, 106 bp, Homo sapiens
atagaatgagccggctccggtttggcactaccgcaaccgtgatttcttcggtttggggacggcctgaatctggcggtgcagtaccaggtaaaaacgatggcgacgg

SEQ ID NO: 725838 - DNA, 321 bp, Homo sapiens
  misc_feature (21)..(21): n is a, c, g, or t
  misc_feature (54)..(55): n is a, c, g, or t
  misc_feature (59)..(60): n is a, c, g, or t
  misc_feature (94)..(97): n is a, c, g, or t
  misc_feature (101)..(101): n is a, c, g, or t
  misc_feature (105)..(105): n is a, c, g, or t
  misc_feature (109)..(109): n is a, c, g, or t
  misc_feature (129)..(129): n is a, c, g, or t
  misc_feature (143)..(143): n is a, c, g, or t
  misc_feature (155)..(156): n is a, c, g, or t
  misc_feature (178)..(179): n is a, c, g, or t
  misc_feature (221)..(221): n is a, c, g, or t
  misc_feature (231)..(231): n is a, c, g, or t
  misc_feature (262)..(262): n is a, c, g, or t
  misc_feature (270)..(270): n is a, c, g, or t
  misc_feature (284)..(284): n is a, c, g, or t
  misc_feature (295)..(295): n is a, c, g, or t
  misc_feature (298)..(299): n is a, c, g, or t
  misc_feature (320)..(320): n is a, c, g, or t
caaagtagtatgtacatgacnattgcacttaaccaaaactattgtgtaaaacannattnnattcctcgagggttttaatttacactagtatttnnnnagantatntgtntaggtgatttaatggtactntaatactactaagnatattggctatnncaatgtaagctataaggtggtnnattcctaagggtatttatagttgatgataacatgaaactganataagataanatacaacgtgctaaatcttttatgtattctnactttaanagacaagtgcacanagttagactgnctnntatatgtgctcttaacttgana

SEQ ID NO: 725839 - DNA, 149 bp, Homo sapiens
attccgtctggctgatgtccatgggctcctggtaggctgaccgggaatgagtcaagtgatgcgcttctggtcgtcaccggtggccacctcggccaggtaggggtagtagtcacccttcatcttcaggtacaagacccggctctcggcgt

SEQ ID NO: 725840 - DNA, 371 bp, Homo sapiens
cttggtgcagtggataacaagcagaagccagttatgatgacaggtgatagatcctgaataagtgcacatttgttaaaattagaccattactaaaccatccgctaaagaaaatcatatatggggtcacaccatcctcacggtagtccaatagagcaaccatgccatctggattcatgttttcaccaataaagaactggtagtttttgaaattagcaaggatgtgcttgatttgttctgcagcccctgtcataaaaggttttactctttctggtctctgttcttcaagtttccctttgattgatttcatgtaatctttgatgtacttcttgtaggcttcttttgtgaaacttgtttcctgcaggtgatggttc

SEQ ID NO: 725841 - DNA, 520 bp, Homo sapiens
  misc_feature (446)..(446): n is a, c, g, or t
cacgagctcgtggtctgtacacaccgccggcgggagcgtgaacgcgcctctagagctctgagacgttcttgcgcttttagggccagaggaggatccccattaacacagggcaccaagggacccacatggctggttatataccattaacaaagaagaacacacactgtgaaacattattaaatcacaacttctaaaagacaccgcaagggctaattgctggctacaaaggcccccacacccttggagcacaagagcattattcgagtgcagaccacaccggactacaggccccaagaaggctttaccaacggcattacacgagctcataagagagctgtgcctgtttgaagaacgctcttgggtgggcatgacacagccgaaggtgagtaagggcccgctctaaggaccacacacgaggagagcgcgcgcgcccagacatgggccgncttgtggccaacccttaactgagaccgacctggtgtgccccttacactgagaccgacatgtgctgtgcataggt

SEQ ID NO: 725842 - DNA, 155 bp, Homo sapiens
cccatccccaacaccccagcccttgcaatctccaatctacttttttgttctataaatttgcctgttcttgtcatttgagtataattttaatattttatgactagctcctttgatgtagcttaatgttttcaaggtttatctgtgttgggcgataa

SEQ ID NO: 725843 - DNA, 464 bp, Homo sapiens
gctctttcacgatccttatgttggctggtggacacggcagcgttatgtgagtggatagtgaagtccctgacgcggagctccgtggccaagctcattctggtgtggctcagggccatctgtgctgttctgctggttctagtgtgtacctgctcagagtggcatgcaaggtctacaacatccacactagccctggcagacagtatggtgcgctgtgcggaccacgcgccttggaaagagaccaacatggcgcgcaaccagatcctctgaagacacctggagttgccacagggtcacgtggaccggccgcttcaagtacgtccgcgtgactgacatcgacaaaagcgccgagtatgccatcaacatgctcccgttcttcatcggcgactggatgcgctgcctttacggggagggctaccctgccgtgcagcccttggaacacctccacggccgcggaggagctctgt

SEQ ID NO: 725844 - DNA, 394 bp, Homo sapiens
gatgtgaatccacacagagttgtatccttctttcagtcagtgttgctccggccggcatatgcattccttaggccgctaggtatacgtacagcagtagatgccactcatgagaatgggtacgactgcttatagtcctttcgccctgcagtttgggtaaaccatcgttcggtgttttgtgattgtctcggccttcagggcgtgcagctctgctgtcgcagcgtggtgatcggttcatttctatatagccataggtatctcccgggcgcttaggtctaggactattactgtttgtggtttatgggtcgtctggggccgtattgccagtctttgtgtttggtttaaaagccaaaataagaaaaagcagcgtttttcaattaaaaaagaattaaaaaaa

SEQ ID NO: 725845 - DNA, 966 bp, Homo sapiens
gcgatgggcggggcaggcgcgcggggattggcgggatgcggcgcgccgagcgtgcaacctccttggacctgtggcgcacgctgtgtggacccaagccaagtccaggcagtgtggcccatgttttctgagccaggctgcccagcagggcccaacaactcatactgtccccagcatcatgccaacaatgccagcttatgcccggtgtgccagtggcaaacctacaccaactcctcacaacccttccggctaggcagagcgcagctataagccggcaagatatgcccaacattatatgccaaccggcactcatccaaatgagacccttcctggagaaccggggacccagcagacaatggaggacaagtgggcagtaggggaagtgaagcacagctggtgtagaaaaatgggaagggctatgaaagcaaaaagtggcaagaagtaggtaggggcaaatcatagaacacaggagccaattggccggaatagcaaaacacatacaaacgctggccaggggaaagaggtcaagacagacggacgaccaacaacgcctggatcccaccaccaagaccaacaattcggacaagaataaaatatagaattaaaaggcgacaagaaatggaagagaaggaataggagaacagttggggaaaggaaatggaaaacgtggaaagagaggaatattagcaaaaaattaaaaagaaggggtcaaacaccaaaacacggacccagcgctgaacccaaaacaaagagaatagggaagatataagctaggaggaggaaaatcaatatagataacacaatttggggagattatggagaaggtatcaagcggcggaagatataaccaaggattgaaatggagaaaaaaaagatgagaacagaacgagagaaaaaagagcggataagaacaaactgtagggagattagaggaaatatgtaaaaagcattaagagatatagggcgtag

SEQ ID NO: 725846 - DNA, 1196 bp, Homo sapiens
ctatgggcttttgcagagacatttttccacgggatgtctttgtaccctccctctttttatcccctctttctcctcgagaattatgtttccgtgattgtgtcccccggcttcaatgagtggaccactggtgtgttcttcaagggttcctttacacggttttttcgcggtggctccttttttgttggggccgctgtccacgtgtttctattgccccggaagaatggggcaagttctatgataatattctctggggccaacaggggcttttttggtttctcaccgtggggtctttaggtaaccgttctctgtcctttggtttatgccccccgtgatttggtggaaaaatccgattttaaggggctttgaatggtctcctcttcaaatgggggaactctgtgctctacctgtcccacttattttgggggagcccacacccacaaaaaaggggccgggcccccaacccaagtcaccccacaacccccccactgcggccacagacaattcttttgtccctcggaacacacacctgggcccttgggaggaccaccgcggggggacataactggaaatggggagacccccacgagccctcatattaccgggtttttgccccccagaatgttctggaagatatggtttgtgccgctggatgacccgcgttgtgaagaattgggaggccccactgtgccccagggagactctgtgccggggctgcaaatttcaccggggccttcaagcaattgtgaaagcttgaaacgaggcccctttctcttgaaacacccccggatctttccttcgaccacccattccaagaggccaccctcgggaccacagagacccctcggggcacggccacataaggggggaaggcgcaacacccactgggtgcacatgggaaggggccacgggcttgaagccgcgcgggttccttcctgaagcccggcaagaagggttgaagccttcacacacagccccttcttctggagggcctctttttaggggatagtttttttataaagcccagatagtttttaaaagcgaaatagtgtggtttcccctccatggtgaccgtgaggccaggacaccagtgcggttttacactccagcccagtccagtatagttcttgcatactgtaatttatattgcccttgggacacatggggccatatttagctacttaaaagcttttccacca

SEQ ID NO: 725847 - DNA, 346 bp, Homo sapiens
gaagaatgggttaaaaaagaaaaaagatggatccaaacttccaactacgggttctgggccaggaaaacttcataagagatgaaagccgccatcatcataattcattcggcaaaataatccacgcttaaacgaatgactttaatagtgcagcatgtgctatgtattcggcttccaggtggagctggtcccagccctggtgggggtttcattaacgggggtggatccaacttgaaaatgagtgggaatccgggtgacccacctgggcaggatcggcggtctgaggcggcagtgaagcccatctcacactcgcagcgatatgcaccggggacattaagactaaatgtgc

SEQ ID NO: 725848 - DNA, 389 bp, Homo sapiens
  misc_feature (215)..(215): n is a, c, g, or t
  misc_feature (304)..(304): n is a, c, g, or t
gtgtcacgtctcacaaaacagtgtctatcactaacaaaaaaaacgttaggtaaaaattttagcactctttttattttgtacatttactcgggacctgtgagaatggttgtcagaccaagtgataaatatctggtccctggtaaaataaacgattaaatagcaaacagtgtaagtagaagcagtaactcatacttaattctaaaacagaatccatngatgtgacagtattgaaatggctagaatataggatacaaggcattcctgatgctctccatcccaagggatagctgttagacacatagtnggggtaaataaagagcaaaaagcctaatggatttattattttggctcatcagaatgcttttctagtcgggtacagttgacactca

SEQ ID NO: 725849 - DNA, 999 bp, Homo sapiens
acccacgcgtacgcccacgcgtcgcggacgcgtgggtcgacccacgcgtccggtgaaaagcctagagatcgcccgtgcgcccctgggtgctgtgcacgccgccgtcttgcctgccctgaggcacgtgcctcgggatccgcgtgcacctcgtgggacccaggaggtgccccctgcctagtccctgccagccatggagctgctctcgtcgccaggacgtgtcatgatgcaactgtacgcgccggcgcagccaggccgctcgtcaacccggaaggagtccctactccctcgtggcgctcgcaagcaaaagtgacaacactgactcgtgaaggcagacaaagatgagaagaataagatggcggcgggtgggctccatagagaccaatctcctacttgcgcagtggtgcgcctcgaagcggctgttgccgcttgtgtacgctccacgctttctctccggtgtcctagacgcgttcggcgcccgcgataatagaccgagagtcaacgagatctctctatatagagagcatagcgagctgacatgagacaccagacacagtataaaacaaaaccggggcgcgaggcagcagtctgggtgtagaagaaagcatcttgcgccccaactcgcgatgggggggcgaccccccaaagggcgtgagaccacggggggagcacacactacaagggtctctctgcgtggcggtgcgtacggaccaatttagggttcggcgaacaaaacggcgcgaccctaatacccaggagaaaggactaccacaaaaggcgccccaaagggggggtagaccttgttttacacacaatcttgtcacagcgtgggtattgaacagggtgggtttacgaccaaaacgaggggggaatattcgcttgggggcctggcacttacgacagaacggttaacggacgtcgacacgggagaccaaatacagctttggactgcaaaacatttaatcataacacacacagggacacaaagggataacataaagg

SEQ ID NO: 725850 - DNA, 271 bp, Homo sapiens
  misc_feature (37)..(37): n is a, c, g, or t
  misc_feature (40)..(40): n is a, c, g, or t
tttggaaaggggcccttattaacattttaaaaggggnggnggggttttcaaggatttcctgtttttttcaggctcctaaagaaacatcagccatttttagatgggttttgttttggtcccttcccccgggcctcaagtgagccaaaaaacactgcctgccctctgtttgttttttcctaattttgcagggggaggttgctagtctagtttcctttttgaaaaactattttcatttttgtgaccctctttgtaataaaatggtacattttta

SEQ ID NO: 725851 - DNA, 987 bp, Homo sapiens
acccacgcgtacgcccacgcgtcgcggacgcgtgggtcgacccacgcgtccggacccacgcgtccgcggacgcgttgggtcgcggccgtcgtgcgcgtcgacggacagctgtgggtcgaatcagcacagtggcccgggcattgtagaacttgaaactagattgtgtaccctgcttaattaacacaatgtagagtcagtgttgacaaagtcagcatctaggccattagtctttacctagacatagcataaacttatgtaacataggtacataatataagagtaacggtacttctctagacaccagcaaagactgatagatggttgtaccactaatgaattcttacaaacacattactggcacatagctgcactaaacctaagtctatactatataactatactataggcaactttgctcgataaaaaccctcatagcctaagactcagatccctgtaccctacatctaccagtttcctaatcaattcacccatatttcactggtgcaacgacaccttcactagtccaccagttgatacaagaaactgactgtataacaccagaaactagatcttcaagggctaaaccgtattcgactatacagatacggccaagtatgaatgaccaagctaccaacactaaacaactgacatgtatacactgctttaaacgctagaggagtaaaagtcctaagacacgtacggcaagagccagcattaagagcccttggacaccaagcacaaactacctagtggcacttccacagtgcagcaaacctgcacagcacggcactaagcaagctacacctaatggtaaacagcacactccaaggaccacaactacagacctagatgttgttaccaaacacacgggcatacagtgagcatgcttcacaacacccaacaaacgtaatgaccattaacagacacattcaccgtcacgagtgagcacggtgacgtaacacagcgtctgtcaccgagaatgatccc

SEQ ID NO: 725852 - DNA, 321 bp, Homo sapiens
  misc_feature (36)..(36): n is a, c, g, or t
gtcggtaccgaaaacgatagaggcaggaggatcacnttgaactgggagtttgagatgctgcagtgtgccatgattgtgccgctgcactccagcctgggtgacagagcaagactctgtctttaaatttaaaaaaaaaagaaaagaaaaaaaatggtgtcctgtggaagagaaaaaggtacatggtagataagtcagaaggaggggggaacaactggcaaaaaagctcacctacgggttatatctgaaatatgaatgtctgacggtcttggctttctgatttattggctgcaatagagttaggaaacagctctgaataacccg

SEQ ID NO: 725853 - DNA, 299 bp, Homo sapiens
  misc_feature (110)..(110): n is a, c, g, or t
  misc_feature (139)..(139): n is a, c, g, or t
  misc_feature (149)..(149): n is a, c, g, or t
  misc_feature (189)..(189): n is a, c, g, or t
  misc_feature (251)..(251): n is a, c, g, or t
  misc_feature (263)..(263): n is a, c, g, or t
gtatgcctatatggtcaaggtacttagcacagtgcctggcatggagtaggtagcccacatctgaaaccttttttttggaggttttttgtttcagtgaaaagtctttcttntgggcccctgcctttcatccttttttccntcgtggcttngtcttcttattgacgttgtaaaccgttctttacatatccntttattttttggaccacgtgcaaagtgagcctttctttgcaatggacggagacgagactganaatgtgttctcntttatgttttcttttcttttatttttattttttttt

SEQ ID NO: 725854 - DNA, 538 bp, Homo sapiens
aacgattggtcctcatgcttcccgatagctgggaacaggaatgcaccaccatgcccaggtaagtttttggtagagggggtgtcttgtcgcatgttggccaggttggtctcaaattcctggcctcaagcaatcttccggcctctgcctcccaaagtgctgggattagaggcatgagccagtgtgcccagctgaaatgagtttactgtatcaattgcagacctatgcttctgtgactaaagttgatcgaggggtcattatgaaaggaacggggtttgctagctgactacagatataatatcatctagcaacctatgtggttgtgaacttagctgtccggtctttggctggtttgacatcgatctgagtcccacaccattgagacagaatcattcttggcttcctctccagtcaacagttcacagccatggactgcaggacactccggcttgagaacacttgaaagtggcgcattgcgcatcttgtagatggttccgtgccaccaaggtggtgaggaatccgaaaaatgtgacgagagaag

SEQ ID NO: 725855 - DNA, 531 bp, Homo sapiens
gaggtctgcagcgaattaggcacgaggctgggccttaaaagtaggttgctacattattatatcctcttcctcgtcatactgcccaatacctcatactaccctatttgtcctacgcagatgtcataatcatcacacagacacccacatgcctacctatgtcatggctgtcacgtttacattcttgacagcttcgagaaccttccactataccttcacttggccactccttatgcttctccatttaaaaccctttcacttacactcttcccaactcatgatcagccacatccctgccctaaccaccctttccctgcttcactccctctagcgaagcgtgactgtctgacttctctacacccccactactttcgggatcccaacccattacaaagtgcccaactatacctttcctacccccacctactgctcgggccagcgcagtctgccacacgaacgctggactgacaggacttgggacactggtggcttggtccaccttgcattaccattcccttcgccccttcttcttcg

SEQ ID NO: 725856 - DNA, 418 bp, Homo sapiens
tccatcgtggcttttactatctgcaccatgtctgctgccttactcaactccctctgcgtcacttgcccactatgccaatatgcatagtggcatcggccaaggatacaacacgagacagccatacagcagctactctaggcagaggtttaacaaaggtttttatctgcaaaaaccttgcggtctatgccaacactggagagaacactgtagatggtgacgtatgtaaatggaagagatctggggcccagagatatgaagattagataggagaatggacattagggtacaagttcatgtacaagtgggtcaaaagttaaaaaagaaagagtagaagcgataaggtagacaagtgtgatgctctcaagaatgaggaagaaaagacaaattatgtgtgcctacttggccttgccatatgcaa

SEQ ID NO: 725857 - DNA, 172 bp, Homo sapiens
gatatcccctgagagacactggatgacgctcatgcacggatcttccagcccaggagttagtctacgcataaagctaatgctttctgtgatgaactgttggaagaagaccctgtgtgaaacaggtcttgactgggacccacctggcgcagaccctgacaatccacctcatgcg

SEQ ID NO: 725858 - DNA, 363 bp, Homo sapiens
  misc_feature (116)..(116): n is a, c, g, or t
gagtgggcttttccgcaagaagcctagttgactcctggccgccttcctcactcgggagtctgggcaacctgcggtcattggcagttcaaggtctcatgagaggagtggattttttngtgcgaagcactgaccctaagccaggagacacactgctagggaggcaggctcgccgcctcatcttggcctccaggtacttatcttcgccaagctctttcgcgcacacgtggtccctttaattccccacaagaattttccacaacgaccctttttttcttttcttttctttctttctttcttttttcttttttaaatacggacgccttctgtcgcccaggctggagcgcaatggctcaagatcacagc

SEQ ID NO: 725859 - DNA, 342 bp, Homo sapiens
acgtcaatccagatcttctaagtcatcatctagttatcagctacagcagcctcccaagtccaggaaacctcatttgtttgtccagcctgggtcacaagagcaaaactccatctcaaaaaaaaaaaaaatttaaaattttagtggttttttggggggtgtcccatttggatccccttcatctttccttctctatttgtaagggtttttttcttaaggggtatttccagtctaagtgggctcacactcaatagtctcagcacttggggaggctgaggtgggagaatcattggaggccagcagtttaagaccagcctgggcaatatcagggtgagacctgtctct

SEQ ID NO: 725860 - DNA, 393 bp, Homo sapiens
tcctagcctcgtacagtgctctcctggccctgaaggtgccactccagtgcccaccagccttgtcctaataaaattaagttgtatcatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagtctgtggcagcggcccccggggaacgccagatgaaaagcaacagtagcgaaacacctaacaggggagggtggaccgagccaccccacaccggagacacacaagaagccagggaagcaaagtaggcgcacacagcgggggcacatggcaggcgaaaacgagacagggcgggcagaccacccagaagtagaag

SEQ ID NO: 725861 - DNA, 817 bp, Homo sapiens
tatgtgcagtgccgtcgtgtggggggcagctgtgctttctaggtgccgatatagcatcctgtgaccccgtcgcgccgagtgcctctcctgtgcctgaaggtgccactccagtgcccaccagccttgtcctaataaaattaagttgtatcatttaaaaaaaaaaaaaaaaaaaaaaaaaaaaaaaaaaaaaaaaaaaaaaaaaaaaaaaaaaaaaaaaaaaattttgggggggggggggcccccagaaaaaggctcataaagaaaccaatcggggagggcagggggacccataggcgagaaacaaagggggaaaaaaggtgtccaaagagaaacagcgggggcaaaaacgagggggggtgttaccaccacaaaaagacagcccgaggggaaaaacaagaggaggtacttatcgaaaaaaacaccagccaacaagggcggactactcagtaggaggaaccaccaccgagggaggcctaacatacacacgagggggcgcgcacacagagagaggaggatgcacgatatataaaaaaaaataatacagcgccccgctgcctgtggtgtggttcacagccagagagacaacgaaaaggggagacggggagaggagcgagggaccgaggaacggacagaagaggagcgacgcgaagaagaaagacaaaaaggaggagggaagggagggaggaggaggagagagcgctgacggagaagagcgcgcgcgaaaagagggggacggaagcacggaggggggaagaggaccagggggagaacgagagagaaggacgaggagagaggaaaacagagagcaagagcgcag

SEQ ID NO: 725862 - DNA, 526 bp, Homo sapiens
tcctagcctcgtacagtgctctcctggccctgaaggtgccactccagtgcccaccagccttgtcctaataaaattaagttgtatcatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaacaaaaaaaaaaaaaaaaaaaaaaaaaaaaaaaaaaagagggagagcgcggcgcggcgagcgcgcgcgcgccgaaaaaaaaacgaaaacacacaacgacacgacggcgggggggggcggcgcacagcagagcagggggaggaggagcgagcggctgcgcgactggaaaaaacagcgagagcgagagaagcagagcagagcaggggagagagaataccaacaaaaaaagacaccgacgcggggaagcgggagagaagaggaaagaacgaacacaaacacacaaggcacgaggggggcgaagcagagagagggggtggacaagcgaagcg

SEQ ID NO: 725863 - DNA, 127 bp, Homo sapiens
  misc_feature (82)..(82): n is a, c, g, or t
aggtccgtttcagtgcccactttagatgtatctgattctcctgactgattcttcccacgggacgtgtggagagtcttgcgcncatgattccctgttcctaccaataacgtacaataaaaacataacc

SEQ ID NO: 725864 - DNA, 590 bp, Homo sapiens
tatgtgcagtgccgtcgtgtggggggcagctgtgctttctaggtgccgatatagcatcctgtgaccccgtcgcgccgagtgcctctcctgtgcctgaaggtgccactccagtgcccaccagccttgtcctaataaaattaagttgtatcatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaacaaaaaaaaaaaaaaaaaaaaaaaaaaaaaaaaaaagagggagagcgcggcgcggcgagcgcgcgcgcgccgaaaaaaaaacgaaaacacacaacgacacgacggcgggggggggcggcgcacagcagagcagggggaggaggagcgagcggctgcgcgactggaaaaaacagcgagagcgagagaagcagagcagagcaggggagagagaataccaacaaaaaaagacaccgacgcggggaagcgggagagaagaggaaagaacgaacacaaacacacaaggcacgaggggggcgaagcagagagagggggtggacaagcgaagcg

SEQ ID NO: 725865 - DNA, 105 bp, Homo sapiens
aactagaggatccgtgcttacttgaggcaggagggtgtttcttctaccaactcactctgttctcctcccaggatgacattattgacgatgtggagagttttgttg

SEQ ID NO: 725866 - DNA, 410 bp, Homo sapiens
gactcgtgatccacccactcggctcccaaagttctggggcttacaggcatgagccaccacaccgggcttgggattattttctttctttcttgggtttggttttggtttgggagacagagtctcactctcacccaggctggagtgcactggagcgatctagtcttacggcaacctctgcctcttgggtacagatgctcctcatgcctcagcctcccaaggaggttggattacgtggggtggtgcacgacggggggataattgtggtattattatgtggtgtggtggtggtggtggttgtctgcggcgtcagagtctcattatgtcaccgaggctgtggtggggtggtgccatgtcggatcatattaacttctgcctggtgggttcaagcaatgctgcctcagcctcccaag

SEQ ID NO: 725867 - DNA, 182 bp, Homo sapiens
atgtattaggccctagtcactaagcctaattagtactattaaaagaacagtcttgattatttgattcttggttagagagacactgattggcagcacttatatatgcaatcaaaggccacctgaggtgtatactacttggggattccgtgcacgttaacgattactaggactatgcagaaacc

SEQ ID NO: 725868 - DNA, 144 bp, Homo sapiens
gctggttgaaagtacaggtctttttcaaaatggagtctcttatgtcttccctttctatgtagacacagtaacagtctgatctctctttcttttccctacatatcccccttttcgttttggcaaaaccaccaccatcatcatggc

SEQ ID NO: 725869 - DNA, 122 bp, Homo sapiens
  misc_feature (76)..(76): n is a, c, g, or t
  misc_feature (90)..(90): n is a, c, g, or t
atcagctgcctcgagtgtagccgctgcttccggcagagggggtctctggttatcccacaggtgtagacacacaggngaaaagtcccaccngtgctctagttgtggaggttgcttcgactccc

SEQ ID NO: 725870 - DNA, 699 bp, Homo sapiens
  misc_feature (73)..(73): n is a, c, g, or t
  misc_feature (108)..(108): n is a, c, g, or t
  misc_feature (162)..(162): n is a, c, g, or t
  misc_feature (202)..(202): n is a, c, g, or t
  misc_feature (551)..(551): n is a, c, g, or t
  misc_feature (560)..(560): n is a, c, g, or t
  misc_feature (569)..(569): n is a, c, g, or t
  misc_feature (573)..(573): n is a, c, g, or t
  misc_feature (599)..(599): n is a, c, g, or t
  misc_feature (604)..(605): n is a, c, g, or t
  misc_feature (630)..(630): n is a, c, g, or t
  misc_feature (637)..(637): n is a, c, g, or t
  misc_feature (641)..(641): n is a, c, g, or t
  misc_feature (644)..(644): n is a, c, g, or t
gtatcatttccgcaaggacccttggaaggcggggtgggcagagcttcagactatggaataaaactgcaatccntgcgtcccaacctgaggaccagatcttgtatcaanctgaccggtacaatgagagacccttggctaacgaggtgcccatcaaagaggagngggactacgtgctggtcttgaaatttgcagaggtctactntgcacagtcccagcaaaaggtatttgatgtacgattgaatggccacgtcgtggtgagggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacgnaccattaanaacgggtgncgtncgggccccggcacacccaacctctgnccgcnnacacgacgatcctgattttccctantggtggncttnggngtttttcttccaaccctcttctgcctctgccggttgtgagaacaaatgactatct

SEQ ID NO: 725871 - DNA, 179 bp, Homo sapiens
  misc_feature (29)..(29): n is a, c, g, or t
  misc_feature (151)..(151): n is a, c, g, or t
  misc_feature (167)..(167): n is a, c, g, or t
gacctacttgggaggctgaggcgggacanttgcttgaacccaggaagcagaagttgtagtgagccaagaccgcaccattgcgttccggcctgggcaataagagcaaaactcccgtttcaaaaaaaaaaaattgggccaaaatatgggtggncgtgcatctgtaagtncccagcctaatt

SEQ ID NO: 725872 - DNA, 966 bp, Homo sapiens
  misc_feature (966)..(966): n is a, c, g, or t
tacgggcatatagtcgacccacgcctcgcccacgcgtcgggcacgcgtcgagaaagtgtccaccccgtagtgactacactctgtctttgcctcaagcggcagcagcaaaggcctctgaactactgaggacttcggacctgttgtggggacccaggctccgccttagttccccaaattctgacccctggttctggcccgcaagcgccaaatgggggacagtgcctcagcgtatatccaaaagcccttagggtccccggtccccgcagtacaagccgatgtacaacgcaaggaatatatccaaggttgaaaaccaagggctatttagccccaaagcgtgtatacacaaattagggagcacaatattaccccagaaaatgccaaccagggcaccacagtgacaacacctgacaaacttaggctccaaaaattacacaactatataaagggccccgagaacccttataaaaaacccgagattgccctccacgaggaaaaccagtgtgtaccaagagagagcaatagacacagatataacaaagaggagacgaaacacaaaagttagaacaagacaaaaagaagaggaaaaacaataaaacaccacagaaagatgagaagtaagagaaaagagaaaataaagaacaagaggaacaaaaaaagaagcaatatgtaaagaagccaaatatgtgagatatataaaaagcaaaacagagactgataaatattaaaattatatcattacgatcacacctcctacaaacaccctcccacagcaccacaaaataaaaaaaagaaaaaaaaaatctcacataccacacacacagatacaaaaacttccaatcaatctcttacatcctctaacataacaatatacatcacattgactgtcacacacaatactaagtataaaacctccactcataacacatagaatacacaatcaaaagcaatcgcacctcccatcttccn

SEQ ID NO: 725873 - DNA, 1048 bp, Homo sapiens
aaggagaattcccgctgatccaagcctgtatcagatttattacatacttttctcctgaaagcagttaagatccatactttgaactgacatatttatttccattcgtgtgctaaggataatggtatccaccctcgatgcaatccgatccttgtgttagcttagggtggaatgtgatgttcagcagaaaactagcagcagactgaccatacggttgatacttggtaacatggccacatgtgatgacagttgagagaatatgctattgcatgagagtaaagttcctaatgtatgttgaatattgtcgagacttggatatggctagtcacgaatgattgctatgtgaaggtaagtgatcaaagatgtatattgatggtgtagattgggagtcaacagatgttgcgatgtattatctatgtagacagatttaatattccatgcactgccgaaatccttcctctacgcatactccagaagggggccatttgatgatggcattgcatgaacctcgtgggggaatatggatctttaaatgcctgagacagggatataggaaaatctggtaggagtctggcaagtgagctggagacgaggtaggattgatgtgtattgggaatgaaagtctgtgaagaagaaggtttatagagagatctatagttcgtggccggcgaagacaagaatcaaaaaaaaaaaaaaaaaaaacgattgtgcaagacgcgccaagtcgcacatctcgaaacagatacgactagaaacaactcggtctagacagacgaaggcacaccacagagaaagcacacagcggcgcgtacggcagcctccccacaagagaaacactgtggatagaaaccaaatgtggtgaggagcgcgcgcccaaagaatacacgcacgagggcagacacgaggtgcagtaaagcaaacacggagagagaaaggacggaggtggggccacaaaaaagaggacgccgaggggacgcaagatttaatacacgcgagggggggtacggcgaaacggacataaaggggggcgggacgataagggggggggggc

SEQ ID NO: 725874 - DNA, 417 bp, Homo sapiens
ggtcgacaaagtgctgagattataggcgtgacacgcatgcctggcaatcacacttaatttttaacctttgctgattttgttacagtaggtagctagtcagacatgaacagggcaggagagggcccacctccccaacccagaaatatcagatgaccatcaggtgatagtcaggcagttgctaattttctctctaaaataataattgatcacagccagcgccagggaagggccgtctcccagtagatggaaaacacatgaaactggtgatcagcagcttctcgataagatctcaggaagttgggtgagttggctcaagcatgcacattaagagacaaaatgacggggtttaactggtgtatgaccttcctctaggaacattctactagtaagggaagaaagccaaaagggactatgtgt

SEQ ID NO: 725875 - DNA, 736 bp, Homo sapiens
  misc_feature (47)..(47): n is a, c, g, or t
  misc_feature (51)..(51): n is a, c, g, or t
  misc_feature (117)..(117): n is a, c, g, or t
  misc_feature (157)..(157): n is a, c, g, or t
  misc_feature (163)..(163): n is a, c, g, or t
  misc_feature (180)..(180): n is a, c, g, or t
  misc_feature (224)..(225): n is a, c, g, or t
  misc_feature (266)..(267): n is a, c, g, or t
  misc_feature (272)..(272): n is a, c, g, or t
  misc_feature (335)..(335): n is a, c, g, or t
  misc_feature (344)..(345): n is a, c, g, or t
  misc_feature (349)..(350): n is a, c, g, or t
  misc_feature (379)..(379): n is a, c, g, or t
  misc_feature (386)..(386): n is a, c, g, or t
  misc_feature (388)..(388): n is a, c, g, or t
  misc_feature (392)..(393): n is a, c, g, or t
  misc_feature (409)..(409): n is a, c, g, or t
  misc_feature (411)..(411): n is a, c, g, or t
  misc_feature (417)..(417): n is a, c, g, or t
  misc_feature (425)..(425): n is a, c, g, or t
  misc_feature (427)..(428): n is a, c, g, or t
  misc_feature (440)..(440): n is a, c, g, or t
  misc_feature (442)..(442): n is a, c, g, or t
  misc_feature (450)..(450): n is a, c, g, or t
ggtgctgaaaatccgaagtgccgcggaaagtggaggtgagggccgcncgcnctagaggtgcccgtccgagaggcagagctgacaaggaaggtttcgagcgttgctggcaaagggatntcttacaacctccaggcatgcgtctttctgccctgctggncttggnatccaaggtcactctgnccccccattaccgctatgggatgagccccccaggctctgttgcnnacaagaggaagaaccccccatggatcaggcggcgcccaggnntgtgnaacccatctctgatgaagactggtatctgtctgtggggacacggtggagatcctagaaggcanggatgcggnnaagnnagggcaaagtggttcaagttatccggagngaaactngngtgnncgtgggagggctgaananaattancgtaattngnnagaccatggatnancggggaancatgatcctagtgaagcccccttgatcaacgcaaggttccacacttgtggatcctatggacaggaaaccatgagatcgagtggagatttactgaagacaggagagcgggtacgagtctccaaggatcaggagaattattcctaaaacggaatttccagagtgatggatgtcatgaaagtgattgatggcccaagaaatcagtgggaaatgttagaaggaactatgtggctgttaaagacttgaggaggagttgagaaggcatgggaatagggacggaataaagagg

SEQ ID NO: 725876 - DNA, 542 bp, Homo sapiens
cttgatgtcctgcaattgcaaagcctactaagcctgccttgccccctacaatcttacccccctcatacttcatttctctgtgttgacctgtgtctttttgttcctttcatgaagtacggaacattggtttccgtcactgagactctgatgcttacaagtacattgccccatctgtctgtctgtatatgtcattcatttttatgtctcttggttactttaatagtatctctccttttccccaggtactctttcattacctgatcaaaatacagaaatgaaggccgggtgcactagctcatgcctgtaatcccaacactttgggaggcagaggcgggaggatcgcctgaggtcgggagttcgagagcagcctgaccaacatgaagaaaccccatctctactaaaaatacaaaaattagccaggcatggtggcacatgcctataatcccagctactcgggagcctgaggcaggagaatcacttgaaactgggaggcggaggttgcaatgagcctcgtgccattgcactccagcctgagcaacaag

SEQ ID NO: 725877 - DNA, 394 bp, Homo sapiens
ggtcccacatacaggggtgcaagatctctgctctgcattgactcactgtgtgtctgtgggcaagtcagggcacctctgagcttcagattactcatctgttaaacagggcgaataatatgctcagcttattatgttctttccaggctgaaatctgacaactcctgagaaccacttaatacacagcaagagctcagagaatgattgagttgctcaatctttggtcgctacaatgatcactgtatctgatctcgtctccagtccaaggggtggagagcgtgcagccctgtggccaccagcactatttcttcttgcagactttcaaccctgggtttccgacaggctatttcctgttccaggaatctgggcggtgtgcctcactctccccacaggagtc

SEQ ID NO: 725878 - DNA, 805 bp, Homo sapiens
  misc_feature (499)..(499): n is a, c, g, or t
agcggggggttgcttatccccccactgggaacccaccactccaagctgcctgcagagcacctatactttctaatactattacctaatactagagagccagagacaccgtaaataaccttgttatcttatatttatgtatttaaaagatggttcataaatgtgtttagtgcttaccatgaaagacaatttttacccccatctccaaaaagaagtagaactgattcagctcacagaaggctgttaaaggcgccagagaaatatgtgatgcagtggcttaaagagactgccaggaagagtggggaaagttgctgcactcaagtcaatttgggaaatttcatgcagaacagccacccaatagcaaggcctctaggtaagtagggagaacgcctctggtcatgttcaggtgtttcgtctgtcaaggtgcttctcccggacagctatttctgcacagttcaacacgacttgagttggccatctcaaaacagctatagcctcagtngctgtgagggcacctcatggatgacagaggcaagaaaggcttgagggagagggggtgaggcagggggagcttggagccgtcattctctaaccctaagagctgtggacacaaagccgagcccaacctggctgctgcccgggcgggcaaggagagggcaccgaatgcactctccccagagcctcgcacttgcaccagttgaggcctgcgcccctctcttccccgcacaccatagcctcttttcttgagtgctctaccaaactactggctcacccctaggaaacaaacatttggtaacatcttcgaaag

SEQ ID NO: 725879 - DNA, 423 bp, Homo sapiens
  misc_feature (23)..(23): n is a, c, g, or t
  misc_feature (26)..(26): n is a, c, g, or t
  misc_feature (107)..(107): n is a, c, g, or t
  misc_feature (132)..(132): n is a, c, g, or t
  misc_feature (175)..(175): n is a, c, g, or t
cggcacgaggcttgaaaaaagancangataacagcaatgttcagggaacaagagagataaccttaaactctgaccaccggtgagctgggcagaacagagccatattnctcttctttcaaaagcaaatggganaatattgctgaattctttttctcagcaaggaacatcccgtganaaagagaatgcgtccctgagggtaggcctctaaaatggctgcttcggggggcggccatccttttatggtcgaagctgtagggatgaaataagccccagtctcccatagcgctcccaggcttattaggacgaggaaattccccgccgaataaattttggtcagaccagttgtctgctctcaaaccctcgtctcctgataagatgttatcaatgacaatgtggtgcctgaaaacttccttagcaattttt

SEQ ID NO: 725880 - DNA, 252 bp, Homo sapiens
gaagcccccatcgcatggtgtcaataggtactgtgctgcagaacttcttaataactaggcggctatcgtataactacgcctcacactcagttctgaaccccctaacaataagcaacatagcctaccccttccttgtattatccctatctggctgattgacagcgtatgtctgagcgattacatggtctgtgtgtcgtaccgtcgtgacttgcgcaaaagaatgtcttctctgtggcctacataaatatctta

SEQ ID NO: 725881 - DNA, 367 bp, Homo sapiens
cagcagaatggcattcaggaacagagaaatgtcttcctgctcagtatggactcttcctaggcacctcattaggaagcgtgctgagcactggagaaacccaacttctgagtgtacgggtatggaccatttgtgtttttcatctggtaatggttcatgaagcccagagtctccagggcatcgctcttgggttcccactccagcactccagaggagctgcgctcacttttgcctgagaatactttcacagaagatggccgcttcactcccagctcatcgcagatctcaaagaagttctcctcggtcacctccagcggggcgttgaagaagtgcagcacgttgctggggtgctgatatgccattcttgctg

SEQ ID NO: 725882 - DNA, 179 bp, Homo sapiens
  misc_feature (4)..(4): n is a, c, g, or t
  misc_feature (111)..(111): n is a, c, g, or t
aagnaagtactcttaggatcattatgatcctaagccagtcgagcccatcgtggtcatagtattgcgagactctaaataggggtatggtaaatacgctcacatcattctcancccctgacaaaacaataggctaaccctttcttgtactatccctattaggcataattataacaagctcg

SEQ ID NO: 725883 - DNA, 392 bp, Homo sapiens
tctttaagagacaatagatcactgccatccaggctagaatgcagtggcgtgatcacagctcactgtaaccttgaactcccaggctcaagcagtcctcccacttagcttcccatagcgctgagattacaagcatgagccactgcacctggccttctcttctactcttatcccaactcaattttatgtatactaatggattctgtcccaacttctttttatatagcttcatagagattctgggggtccacagtaaacacttggtagttgcttggaattaaagaaaacataattaccaaaaaagaaaaaaagattttttaacaacaaactagctaccaagtggtcattctacataataatcatcattaaacctcagtgtaataaagaaattgttt

SEQ ID NO: 725884 - DNA, 126 bp, Homo sapiens
cctctctcacgatgacccctatacgcaaaataaaccccctaaataaataaattaacacatcattcatcgacctccccaccccatccaacatctccggatgatagaaggcttcgcgctcactccatt

SEQ ID NO: 725885 - DNA, 410 bp, Homo sapiens
gaacacgaagactatatacaatgcaggtcaagaagagatgggagaaggaatgtcacaaaatttttggtaatacatatattttatagagaagtaatccatgaacctggcacacggataggtttatccaagcagctttacaaattactattaatataagttacatgcttgcccatctaaagtaactaaacccatagactgtaaaactatgtgtcaaggtaacgtgagcactttaatcactttacttatattttctaaagggcagtagtatcctctccttttcccgctatcatattagatgaagagacaagttccttcaacacaaattctgatatcggctattgtgagaatcccttgttgcagtcagctagaagccccctgcaccaagtctagtgccaaccaaaatgaccaga

SEQ ID NO: 725886 - DNA, 158 bp, Homo sapiens
tagattcctagagaacgatcacctaccgtacctaagcgacactactactgatctacattataagaaagataagagacaatatcagaacatgagcatacactcattcttgagagggtagaagctgagcctcatttctacatctgcattagctatatcat

SEQ ID NO: 725887 - DNA, 401 bp, Homo sapiens
tcatgttctcagaggaagatagcgctttcgcctgacaagcatataccaagcgccctctctcctcctcggctaacggcctaatggcactacacatctaaactacacctctcgggcaagccccatggccaccacagcgcgccaacgacaattgcgcgctgggacccacaagggcagacacctgggaaacacgggcttcccagcccaccaggcaacaaacacaaacttcctgcgggcaccaggcgggacacccaaaaccgggcctcttagattctcgaacgaccccattgccaccttggagtaacccgtgggaggaacaacgcaaacaggaaacccaaaccttcctcaacaagcggcaaaaaccgggaaaaccttggggggaacaggccttggggggatcgggt

SEQ ID NO: 725888 - DNA, 211 bp, Homo sapiens
tctagtaggatcgccatgggaaaccttcggtggtgtcagagtttttcacaagacttggtcctgcatttatcagatcctggctagatcagtccacaccctacacggctgtgcgactgcgtcgtgactctgagcctgcgcgtggtctacatgattcgagtttacctgctgcagggttggtacattgtgacctatgccttggcggatccttaga

SEQ ID NO: 725889 - DNA, 81 bp, Homo sapiens
ctagaagattcagcaaagtacttttgtgctcttggggaaagaaaccctactgggggatacgcgtacaccgataaactcact

SEQ ID NO: 725890 - DNA, 161 bp, Homo sapiens
tgaaacgttgtctggctctgttgccaggttggagtgcagtcgcgccatcttggctaactgcatcctccacctcccaggttcatgcgattcttttgcctaatccccctgagtagctgggactacgggcgcacatcaccatgcccggctaatttttatggggt

SEQ ID NO: 725891 - DNA, 640 bp, Homo sapiens
  misc_feature (17)..(17): n is a, c, g, or t
caatttcatcacacgantgtgacgaggaaaccccctgccataacccaataccaaacgcccctcttcgtctgatccgtcctaatcacagcagtcctacttcccctatctctcccaggcctagctgctggcatcactgtactactaacagaccgcatcctcaacatttttggtgggggaccccgccggaggaggagaccccattatataccaacacctattctgatttttcgggcaccctgaagattatattcttatcctaccaggcttcggaataatctcccatattgcaacttactactccggaaaaaaaagaaccatttggatacatagggatggtctgcgctatgatatcaattggcttcctagggtttatcgtgtgagcacaccatatatttacagcgggaatagtcgttgacacacgagcatatttaacccccgcttccataataatggctatcgccaccggcgtcaaagcattcagctgcctccgcccactccacggtagcactatgaaatgaccttgctgaagtgctctgagtccctggttttaatctctccttccacctcccgtggcctggcttgccatggtgttagctatcgttattcttggtcttcgtctgcaccgccctttccacgagga

SEQ ID NO: 725892 - DNA, 786 bp, Homo sapiens
ctgtgcgctctcgatcgggagtcccagccatgtccgacgagagagcaggtagccgaggcagtcgaccggggaagactgcctcttcgccgcctccgaaaaccgaggcagtcgatggcgacccccagcatcccgcggactccgaaggggccgacgccgtgcgccgcctctcctgccactcgcttgctgctgccatagtgctctacgcggcttttggggaggctcccgaccctacggtggaacgctcgcagagccgtgcccggttagtgcccccgagccctgtgcccggtccagcttgacgctgcgtctgcgggcctgcggtgctcggactgtctctgacctcatggctaggcaggggcttgttcgacccgtctcccgcggctctgcgctgtcactccggggcatggcacggcgcgcgcggtgtttgtgatcggcagtggccccgagggatgttcatgcgacccgcccatggcacggacacccgggggtgaatggttgttgcccccggtgtcccggggctttgttggacagggccacgaacgggctgaccttggtgcgccctcgggtcccgagcaaccctttcccttgaatttcccgtgatggccccagtggagccttttggccatttggcacaggctttgcgctggcccttttgggctccggtccgagcttttcccgtggtccacgtgccttattgccatgggtcccctctcttttggacggttcgcgtgcaaatcgtataacatgcgcccttgggcccccaaagtcgcctcttgggggccacccttg

SEQ ID NO: 725893 - DNA, 106 bp, Homo sapiens
aatgcacaggaggaagctgaggcgacattctggggcatcctagatgccttacctttaaggacgagggactttttcctggctgggggaaccaagccaccattggccg

SEQ ID NO: 725894 - DNA, 1379 bp, Homo sapiens
gcacgcgccctcatcgcggggtccgtcttcttcctgctgctgccagggacattctgcggccgcatgcagacagcacagcaaggggcccacaagtcaaccgtccaaggtgtcattattgacctcacgcaatttgtgagcatgacagcatgtcaggcctgggtgcatctattggtctcgttcggcaaagcactgtatccacacacaacagatggcatacattcttggtggccattagcatcaccggagcagcaccaggcattttggcctacgaacacaacgagcacacattcccatcagttgtaatcgaaggcactatccatgcatcacaggcgcggcagcacattccaccaagggggcagcatggccaccaggcaggcacaagcagcacatcatcacgtgtgcagagcgcctatcccacagaacagcagaaaacttcgacacacctgacacgcacgtacggggacctggacatgcggcctgacgccatgcgccacaacgacaggccaaaagaacaacacaaacggacagtccacacggagtcatatccatacgacgacacagtcacagcacagaccctgggccaaaagcacctgcggcacacgccactcggtcggatgatcacggccaacaacgctaccataagaacgcggacagtaggcaaggcgagcggcatgcgagagacacgcagaaggcgacgcacgccagcacaccaggaacaggagcacagccccgcgcgtcataacaaaacaccccgctggaaacgcggaactggtgccaccatcaactacaggccacgaaaccatgacgtgcacaaacgtaaatccggcaagcgacatggggaacgcacaaggccaccacacacgaggacaccaactccagcaccgacaaaggagtaagaatcacgaggaggccgcgccacgcgcggcaacaccaacactcgtgaccatcagcaagcaaagatcctcgaccacgcgccaacgggtgcaacaagcgagccaccacgtgggtaaagccatccccagggaccacacaagaacagggggggacgaacaccatgagcaacacccaggcaaccatgggcgcaccccccgaagcatgcaagtgggcaaccacacacagggccatggacgacgcagcggaggcacgcgacaggtccacgcacagtcatggcaagttgtccgcagccaaggaagcacccaagggagagcaacgcccacacacacgtggctacacacaagagcgacgctatatcaacgagacatgggagccaagaaacaaaacacaaaacagtgtaggaaggaagaaaagaccacagaccagcacaaccgcaaaaacaaaaaaacaaaacacacaaaaaactgcaccacacaacacaagaa

SEQ ID NO: 725895 - DNA, 104 bp, Homo sapiens
tcttacgtgccctgctcagttccaccatctttctgggtcctcaccatgtgcgctctgtgctccacctcccctggtgctgtgtctgcacatgggcctggtggtgt

SEQ ID NO: 725896 - DNA, 418 bp, Homo sapiens
  misc_feature (90)..(90): n is a, c, g, or t
  misc_feature (216)..(216): n is a, c, g, or t
  misc_feature (223)..(223): n is a, c, g, or t
  misc_feature (347)..(347): n is a, c, g, or t
gatcccgttcgtcgaccgctcgcgtcgcatttggccgcctccctaccgctccatgcccatccctcagcctatgcatgcccccttgatcangccattggcctcctcgtggccatcttccacaagtctccggcagggagggtgacaagcacaccctgagcaatgaaggagctgaaggagcttatccagaaggagctcaccattggctcgaagctgcangatgctnaaattgcaaggctgattggaagacttggaccggaacaaggaccaggagtgtgaacttccaggagtatgtcaccttcctgggggccttggctttgatctacaatgaagccctctagggctgaaantaaatagggaagatcgagacaccctctgggggtcctctctgagtctaatccagcggtcgacggacggggta

SEQ ID NO: 725897 - DNA, 454 bp, Homo sapiens
ccacctctgactccttctgctgactgggatccagctccaaagccatgcctgggaagagactcctgcctctcccaggatgactccgtcccgccacgcctctgctctcagcgcccacagggactcaccaagctggactttcatctaaaactagacacacgtgacgccagcggaccacagacccagtgcaaggggagctgtgtgggttgtgctgaaggtatgttaaaattcatacaggacacccaaaacaatcaatcttattgcatgataattttaaaataataaaaaagacttgtggcaagctgaaaaaatttttgataactttactaccaatggctaatgtgcaaactcctacaaattgagaaaaacaggcaaaaaatataaacaacagtttataggaaaagaaatacacagtttttaaacctatgaaggacagctttactcattagttaaaaaa

SEQ ID NO: 725898 - DNA, 803 bp, Homo sapiens
ttatttactacttttttcccgaataattttgataaatctctctgtttacaacacacttatgttatacattttgggggagagggtgatgttttcggggagattcacacacacacaaggggaagagagaggggaagagagcaggagaggaagagggagagggaagaagagagagagaaagagagagagaacgagagacagagagagacagagagagagagacagagacagagagagacagagagagacagcgattgtagggtagggtctcactgtatttctggttgacctgaaactcactatgtagaccaggctggcctcaaatttacagagctcagcctgactctgcctcctgagtgctgggattaaaggtgtgcactgtaacatctggctttactttgataactactattgacgttttaccttatacaagtcctagctctagtttctggggagagaggggacaactagaaagctcaacactgagtgagaaacagaataataagcaccacactggccaatccagctgagcgatgctctaaagggacaatgtgctgcggttgccgggcattttcctgttgtgcagcacaggctttttaacaaaagcgtgtgcccatgtagattgtttcttaatgcataggaaggcttcaccatgaaagaaatttccaattgtgtcttttataataccaagtagatatttgctgatacctactggtgtgaagtaacattggggatctttgtcaaaagttgaggactccctgaatgtattcccgggggtgtcagaacgggtttactggggagactat

SEQ ID NO: 725899 - DNA, 648 bp, Homo sapiens
ggtatataagtgcagtatgtcgccgtgaacgttctttttcagcagacgggtttgtcgcctagaacacaggtgtcgttgaaaatctacccctaataagccaaaatgtggaaaggaaaagactcatatcaacattgtcgtcattggacacgtagattcgggcaagtccaccatctactggtccatctgatctataaatgcgtgttggcactcgacaaaagtaaccattgatacataatttgtagaaggaggctgactgcagaatgggaatagggtctctcttcagagtatagccgtggcgtcttgtgaataatactgcaaaagctgagtcgtgacacgtggtatcaaccattgatatctaccttgttgggacatatctagcagaccatgtcaaagtactatgtgactatcattgatgcccctcatggacaccaggagactttatcaaaatagcatgattacagggacatctcaggctgattgtgctgtcctgatggttgctggctgggtgttccggtgaatttgccacgctgtgtgatctctcaatgcaatgggctagacccgagagcatgcccttctggtttacacactgggtgtgaacaaaactaatctgtcggtgtcaacaaaatggattccattgagtccatccta

SEQ ID NO: 725900 - DNA, 185 bp, Homo sapiens
ctgtccacataccagtggcggtgatctgggaactaacagtggtctctgagggcccctgtgcgccccaccaggtctggtattgaggctgcattcctgagtgcaggagggagtgtccctgtgagatttttgagctgggctctggctatgatcttgcttgcttctcagtacaccccgccgcccaacgt

SEQ ID NO: 725901 - DNA, 297 bp, Homo sapiens
  misc_feature (249)..(249): n is a, c, g, or t
tggagaggaggaacctcatgagacagttgggtgggggcagtgtaagaagaagggtgctgggtgcggtggctcatgcctgtaatcccactgctttgggaggccaagttgggaggatggcttggggtcaggagttcgagaccagcctggacctcataacaagaccgcatctctacaaaaaaggttaagagttagccaagtgtggttgcatgccctgcaatatcagctactcgggaggctgaggtgggaggntcgcttgggcccaggaattggaggctgtaatgagttgtgattgcacca

SEQ ID NO: 725902 - DNA, 474 bp, Homo sapiens
  misc_feature (52)..(52): n is a, c, g, or t
  misc_feature (361)..(361): n is a, c, g, or t
  misc_feature (429)..(429): n is a, c, g, or t
  misc_feature (453)..(453): n is a, c, g, or t
  misc_feature (470)..(470): n is a, c, g, or t
taaagagacggggtctttcttttttgcccaggctggagtgcagtggccaatnatagctcactacagcctccaactcctggtctcaagtgatcctcctgtcacagcctcccgagtagctaggattacaggtgagtgtcatcccaggcacctaatttttatttttttagtttgttttgtagagacgaggtctcactatgttgcccaggctggtctcgaattcctggcctcaagtgattctcctgcctttggcctcccaaagttgctgggatcacagacgtgagccaccacgctggcaaaactctttaataactctctctttctaattgtgggcaaaattcacacaacattaaactttaccatnctttaaccatttttaaagtgcacaggttagtaggttaagtggtcatgtggttgtacaaggcttcagcntcatcatttggcaaaatttgttcnttttcccaaacggcggncgtt

SEQ ID NO: 725903 - DNA, 320 bp, Homo sapiens
gtggccctctactgcaggggtgacagaaacctcatcgttacaggccatggtactgtggcgctccgtgatcttacgacgatttcagaagtccactgaacttctgattcgcgaaacttcccttccagcgtctggtgcgagaaattactcaggactttaaaacagatctgcgcttccagagcgcagctatcggtgctttgcaggaggcaagtgaggcctatctggttggcctttttgaagacacctacctgtgtgctatccatgccaaacgtgtaacaattatgccaaaagacatccagctagcacgccgcatacgtggagaa

SEQ ID NO: 725904 - DNA, 356 bp, Homo sapiens
agccccttcagccccttttcccctccccgggtgggcagggcagggccaccccactttacctccttagctttccctgtgccactttgactcaaaggctgggagcatagcaaaggggccaggcccaggcaaagcttacgggaggccccagctttgaggggagggggtccgtggtaaaggcctggggccggtaaaggctccccagggctcccttatgtcccccacttcaggggatgggtgtggatgtaattagctttggggggcagttgggtaaatgggtgggggctcctggtggccttttgctgcccaggccccacccccctttgggttccattttgttaataaaccctggctttgga

SEQ ID NO: 725905 - DNA, 949 bp, Homo sapiens
gagcccgcaccggaaccgcgatcaggtggccaggcaatccaacctaggcgtaaggggggaagaaggcctctgtcgcatgcgggcgcagacaagggggccccatcgcagcggtccagccgggacaacaacccggtggagctctcgacacgggctctcaccctccagaggaacgagaaggacgtagcctgctgccaaggtaaagggtgagacccggcgagagaagacccgggaggccaggcaccgggagaggccgcgaaggagaagcgtaaggcggagggcagggagtgaggagcagacccgatgatgagctggcccgagaccctggaggcgctggtcagcaaggcagaggaggagttcttcgacatcatcttcacagagctgaagaagaagggacggcagacgccacaaagcggacgccagggcctgccctctcctgtaccagcggagagacgaagaaaagacatcgcctgtcgtggggcacctccgtcaggccccacagataagacgcccatacgatatgaaagagccaaagagcagcgctggaagggaaaagaaacagcggcagcaaccaagtccagaagaagaccaggtggtcgaggagggagaggaagcagcgggggaagaaggggaggaagaagtggaagaagacttagctagaagtcagcattcgatgcggcgctatccctgtgtgccttcctttcccacgtgcttgaccgtcaaccagacttgcatggccatggcagggcctcgggaagaccttcaggagtggggaaaggtttctcctccatgatcgaccctcctcgtccacctacaaatcaggacagaaagtctctccactatgaaaatacatttccaggcagcttcctgaccatttgacacactgccaacgacaggagcctccaagtatgtgggagggacggcggacgagtaggcctggggctgcacatga

SEQ ID NO: 725906 - DNA, 1226 bp, Homo sapiens
tcagcattcacgaactgctggctttaggtgaactttcgaacttcgtgacctgaatgatgaacattaacaacgctgctaacgggcagaacaggacactgggaggtccgtgataacagcgacgctggcgaggctcctgcattactggcaaaacgttggccctaacaactgctggcatcatgaacggaaaagcaagctcccaggcaaaccgacggttacaacgctactcttggacgcagcaacatacgactttgcctggctgcttcagcagcacgcctgtattgcacaacacacgcaaccctccggaccgcagcgcacaggccagccccagcgcagcaacacgggcagccggcgaccgaccagccccatgtccagcacacggttcactttgcctcaaactgctacaccctgcttttcccccctacgcccagcccaacgcagcactttgcagcgagcgcaaccatggcctgcccgcacaagcgcacacgcacacaaattggcacaccttccttacccaggacagctactagccacacgcccgaaggcaaccacctatgtcacgggctccccccacacgcttggacaccgcacacgcccccagcatacgggacattcccatgggggagcttacttttaggcggaaccccctaagccctgcgctgggcccctccatacccctatgggcaagccttcctactcccacctccccccctccatgcctgggcttactccctttccagtgtgtatcccctcaatgcggccccttggtccacgtacctaccgcgtcgtccttggggcttggtctttgtgcccccgtcgggggccttcccgctggtcccccccgacttttccttccagtgtactcctttctcgcccttattctccctctatactttgccccgttttgggctttctttcaaagttggtttctggccacccccgggcaccgggggcgtcctacacgctgtcggggcatccatgcgctccccccactgggcgcctctcgcctagtacccctatggtggcttcacccggctttctgcggctactcctccagcttaagttaccttccgcggctttaaccctacggcccgctttgcgccctctccccacctctctcactcttcctctcgacctctctcgctccgcacccgccgcttacctcccgcacttcacctcgcgcattcgccccgcccacctttggcccgctgttcccttgcccgctcccc

SEQ ID NO: 725907 - DNA, 433 bp, Homo sapiens
ccagcgtcgcccacgcgtccggggacacgtggtacggaaccggtggccgtggcttgctgcgtggttaagcagggccgttgcctaggtgggccttccttcccaggtcgcccctctagtcatccacatagagacaggacgtgaccgagttgcgtcttccttccaagaagcttcgagaatctgcggtctggggtctgggttgacagatggcggcccctcacgtagccctgttgtaacgtccagtagatgaaaaatcaggagtcgcgtacacttcaagacaactcgcacagaatgcggtggctactccagacggtgtgatctgcggtggccggacgaacgacgacggcgaaactcagggacggactgactggacatgttgctggctgcatgactgcttaacggccgctatggggaggctctgcgggagactggctgg

SEQ ID NO: 725908 - DNA, 168 bp, Homo sapiens
gggagtagtccaatgatggtaaagggttacttactggttgtcctccgattcaggttagaatgagtgaggtctgcggctagtgagtcaactaaatgtgattgtgcttagatgtggtgaaatattatgctttgtatgtaatggatatattggaggatggggattattgct

SEQ ID NO: 725909 - DNA, 324 bp, Homo sapiens
tcgagccggtacccgatgtcagggataggctccacgttgaggtctgatgatcattccagctggtggtgttggagtgtcagtgatgattttattgagagaagtagccgatcaagaagagctcatgagagaggttgacaccttggtacagaatctgtaaccaataccatgatgttcaggctgtgatctgggctccctgactttctgaagctagaaaaatgttgtgtctcccaaccacctttccatccccagcccctctcatccctggagcactctgccgctcaagagctggtttgttaattattgttagactttccgtatggatgc

SEQ ID NO: 725910 - DNA, 597 bp, Homo sapiens
  misc_feature (42)..(42): n is a, c, g, or t
  misc_feature (65)..(65): n is a, c, g, or t
  misc_feature (68)..(68): n is a, c, g, or t
  misc_feature (70)..(70): n is a, c, g, or t
  misc_feature (81)..(83): n is a, c, g, or t
  misc_feature (85)..(85): n is a, c, g, or t
  misc_feature (95)..(95): n is a, c, g, or t
  misc_feature (180)..(180): n is a, c, g, or t
  misc_feature (185)..(185): n is a, c, g, or t
  misc_feature (187)..(187): n is a, c, g, or t
  misc_feature (191)..(191): n is a, c, g, or t
  misc_feature (221)..(221): n is a, c, g, or t
  misc_feature (234)..(234): n is a, c, g, or t
  misc_feature (269)..(269): n is a, c, g, or t
  misc_feature (324)..(324): n is a, c, g, or t
  misc_feature (334)..(334): n is a, c, g, or t
  misc_feature (340)..(340): n is a, c, g, or t
  misc_feature (351)..(351): n is a, c, g, or t
  misc_feature (419)..(419): n is a, c, g, or t
  misc_feature (421)..(421): n is a, c, g, or t
  misc_feature (428)..(428): n is a, c, g, or t
  misc_feature (436)..(436): n is a, c, g, or t
  misc_feature (483)..(483): n is a, c, g, or t
  misc_feature (488)..(488): n is a, c, g, or t
  misc_feature (494)..(494): n is a, c, g, or t
  misc_feature (497)..(497): n is a, c, g, or t
  misc_feature (525)..(525): n is a, c, g, or t
  misc_feature (527)..(528): n is a, c, g, or t
  misc_feature (534)..(534): n is a, c, g, or t
  misc_feature (557)..(557): n is a, c, g, or t
tgaattccggaagatccccacatcgatgaaagcaaagcaaancaccaagccatcatcatgtccangtngntaagagtaagnnnanaaagaaaggnagaaaaaggacaaaaactaatgatgacgaacaaatcaatcgcccaaaaagagggcaaaaaaaacataaactagaatgcctccccngaggntntaangagcctcaaaacaatcaactccactctcanaacagaagggggnaaagtcagaaaccgctgcccccccttaaacacgcnaagcagcctaatgtgcaacaacatcccaataaactaaacaggggaaacgggagcntaagcacccnagtggnaagaaaacggnaagctttctcaacccccgctctgaaccaacggagaaaacaagctcaaaggaaaacaaaaacgcccgtncncacaggngataacancaacatggggcagcagttaaggaaatcaggtgaggagcgaacctagnaacancagccnttnccaaaccctagcctaacccaaaacctancnnatcaanccggaaaaactagaaaaaaaagngaatcaaagctgcagcggaaactccacataatagcaggga

SEQ ID NO: 725911 - DNA, 249 bp, Homo sapiens
  misc_feature (145)..(145): n is a, c, g, or t
  misc_feature (202)..(202): n is a, c, g, or t
ccagtgtaagcgtcaggctgtgtactgctggaaggctggtgccactgtggcctcgccaggcccgtgacgctccctacagtgtattcatgcggaaattgtggtcacatatctcaggaaggatgtgatgcagacaccatactccatntacaccaggtaccgggcaggctggcctggtgggcactggggcccacccccatcttcnccacaccctgttcttgaggcttgtagaaagccaagcaggcccagggc

SEQ ID NO: 725912 - DNA, 289 bp, Homo sapiens
gagatcccgctgatcgcttagattttgggagaatattggccgaggacgattgtattttgccatgtgagaatatgagatttgagatgctggggccgaatgataccgtttgcctgtggtctcctctaaaactcatgttgaattataatccccactgtttgttggaggtaggacctggtgggagataactggatccttggagccgatttctcatccatgttttagtgccctccacttggtgctgtccttgtgatagtgagttctcaccatatctaaatgctacacttaaggc

SEQ ID NO: 725913 - DNA, 764 bp, Homo sapiens
taaggctttaaagtgaatcgttttaatttaaaacggggatccatcagagggggggaactatcagggtcaaggtcctaaagcagggcccagatgaaaggtaatactcaccagcacctcacaggggactcagggacaatgtcagcaacacaccagggaggggagaacaaacccgaggtaaagggcgacctagcgggggaggaagctgggggtggttgcactggcctctctagcaggttggctttaggtcgcacgggggctaagtctgggatagaataatatggggaagggaataactcggaagcgaggtctcctatgcaggcagtaaccctactccggatagggtggtatactcgccatggtgggtaaggagggtctgtaccagggacgactggagtgtgaccacaagggggaagtacaaccagcctctctcccttctttctggctctagaaaggagaagggggaccccttcccccagtatcaatctacatgcacgcggttcctagaagggctggtaaagaggcatccgacactctaacaagaacagaatagccccggtgacccaaataagaagacacgaacacagggcgtctctggagactgaaaaatccatcgtcaaatggggaaaaggggtacgcattctcatgacaacaacctgcacactacagaagccggggtttgacccaactcccaataaaaccccgggggggtaactgcccccgctctgaacagaacactgttaacggtcgcatccaaggagacccgg

SEQ ID NO: 725914 - DNA, 154 bp, Homo sapiens
gcccgcccccccccccccccccccccccccccccccccccccccccccccccccctgatatgcggcagtgcacgctgtcactttcctgcaggccgacctctagcaggactccccgccggcttactgtcggctggcggctaccgacgccctcgaa

SEQ ID NO: 725915 - DNA, 383 bp, Homo sapiens
atgccatatgagtctgaagagaagagccttgttgtgaactcagaaacatcaggcaactcatggatggaattcaacatattcattgactgctccatttcccgtctcacgtcaggatcacttgtgttgaccactttaggcagaagcacatatatcaataaaggaagaaccatcatcataaccattggcttcattagaaagtctgcccagccccactattcccttttaataaagtaagaaggtcgacctgaagatttcatttgcagaggatagtgcagcctgacaacctctgatgatttgatcgaattcacatatctcgctctcatttctcctttcgaagggatatccactctaacgggatcaaaaatgacagctgtagatacaac

SEQ ID NO: 725916 - DNA, 253 bp, Homo sapiens
ctgtgcgagagtgcttcagtactcaatttccacaaataattttcacccctctaagcatgtacatctacaaagatggatcctatcatagaaattaaaaaatcaattatgagctcatttcgacatacagaacaagatatggcacacgctggaagtcctgccacgtatcctttaatgatgctcgactcattgtatcacacaggaccacgcatgaacgtttcttcactcagaacttatacacggcattttcctgtaa

SEQ ID NO: 725917 - DNA, 169 bp, Homo sapiens
cgggtgccgctccatgcttagtggtccatctatgaatacaagagtcatcatcttactggaatcgatggacacactacagccgggtaaaagtccaacgcacaccacctcatgtccacttactaacaatctccttgtgaaggtcggggtcgcgcttccactacgactccgg

SEQ ID NO: 725918 - DNA, 2043 bp, Homo sapiens
ccacgcgtccgcggacgcgtgggctccttcaaggcagtaggaagatactaagcttattatctatggctgaagacaaacacaacaaaaacccacttaagatgttggaatctttgggcaaagaactcatttctggccttttggatgactttgtggaaaaaaatgtcctgaaattggaggaagaggagaagaaaaaaatttatgatgccaaacttcaagacaaagcccgggtcttggttgattctatacgacagaaaaaccaagaggcaggtcaagtctttgttcaaactttcctaaacatagacaaaaattccaccagtataaaagctcctgaggaaactgtggctggaccagatgagtcagtgggatctgcagctaccctcaagctttgccctcatgaagaattcctgaaactgtgtaaagaaagggctggagagatctatccaataaaggagagaaaggaccgcactcgtctggctctcatcatatgcaacacagagtttgatcatatgcctcccaggaatggggctgcccttgacatccttggaatgaagcagctgcttgagggtcttggctacactgtggaagtggaagagaaactcacagccagggacatggaatcagtgctgtggaaatttgctgcacgtgaagagcacaaatcctcagacagtacattcttggtgttcatgtctcatggcatcctggatgggatctgtgggactatgcacagtgaggaagaaccagatgtgttaccttatgataccatcttccggacattcaacaaccgtaattgcctcagtctaaaggacaaacctaaagtcatcattgtccaggcctgcagaggtgcaaatcgtggggaattgtgggtcagtgactctccaccagccttggcagacagcttttcacagtcatccgagaacctggaagaggatgctgtttacaagacccatgtagagaaggacttcattgctttctgttcctcaactccacataatgtgtcctggagagacataaaaaaaggttctctcttcattacacgactcatcacatgcttccaaaaatatgcttggtgctgtcatcttgaggaagtatttaggaaggtacaacaatcatttgaaaaaccaaatgttaaagcccagatgcccactgttgaacgactctctatgacaagatatttctacctctttcctggcaactgaaaataaaaatcacaggaaattcaaccatttatcagcttcaagaagcatttttatcagcacagcatccatgtttaaccttttgtctttcattaaagtgaaaacatatgaactgttctttggggtcctctaagaaagaatagaatttcaattaaaacaatggatggatggaaataaagtagaagaagaaaactggattttcttgttatattgcatataatgcctgcactttactgagtgaagagaactagtcatgacttgccctcagcagcagggtgaaaggagatggtgcacatctggagacaaggaccaaaaactgggtcacctgctcctttgatcactcatcaaaccttgcaactagaattatttggaagaatatttctaatttattatttaaccaacatcataggtcaagttcaattttttttcagaaagttgttatggtacctatgcatctttcttcttatccataaattaatttgctttcttgttgatgatttttcattccagatttccaagcttcaggaaaattttgttatttagcaaacacttggtaattgtctaaaataaattgggcctttgatttaagatggtataattgggtgtgcttgtatagaaagacagacattattagatacagaacatccaagagtgtgggaaatgtcagcaatgggaaagaaaatgttaaattttctggaaagtgaatgtcagtagaggaattttagcaacatggccatctgagccactgactaaggagatgtaccacttcaattacatacatgcagaatgctgaatagatatatcaggacatgctgaactgtattacaaataaaatgattctctagatatc

SEQ ID NO: 725919 - DNA, 262 bp, Homo sapiens
cgtataactctcgcatactctcactttcccactgggtatctcatgctgacgggctggctggggacaaccccagtgtgcctagtgttcttccctgccaggccctgatgccctgtcacaagtgactggcccagccatcattgcaactccaagccaagatgggctgttattgaatggaaggcaggcctggggcagaagcatcctagtctggtcttgatgacccagcaaggtgctcctggattttttggcggcgatatccaggacc

SEQ ID NO: 725920 - DNA, 115 bp, Homo sapiens
cgagatacatacagcgaacagctcaggtctgactatgcgtgctctagtagtgtctgcagttatagataatgaaatggaaactcaaaactttaagtgtagctcttttattttggtg

SEQ ID NO: 725921 - DNA, 540 bp, Homo sapiens
aacagtttattttaattgatcgcaagccatgagtggcaaggagactaaggacctttccacttgtgagagatgtggctggtgtttccccgactacaactatatgcatgggggctaacgtaggagcgcttatttttaatgctcacaaactgttaaggggagaggctgtacacgtttctttttaaggataaggcttttgccaagtgcgaaattatgagctttacccttctaggcaagggaggagttccaaatgtcggacttgacaccaagaggtacataggctggtaaatgctaaatggcaactcttttttgtgctttagcaggcttgtagaagggaaacactatcctaacgagggcgatgagcttcttgattatgccattctctctgagacgggtgcatgacgttgccacgtacgcttaggtgggtgcagggaaccaattgggttcggatgacccttccgagtacgtacgtgacaagccaaggttgttgctaatgctggagccggagtactgcttgccgggagatgcactaactctagagcg

SEQ ID NO: 725922 - DNA, 422 bp, Homo sapiens
  misc_feature (2)..(2): n is a, c, g, or t
  misc_feature (33)..(33): n is a, c, g, or t
gnttcccctagacaatccctacccaaccccctngcccccacaacacccccctctggtgcccccataataaagggaaaccaccttgtaaaaattaaaatgtgaagtgaaaatccaaaaaaggtttcccctgccaaggttgttttccctgaagaccttgggaaaataataaaattcctgtacctggaaattccacaaaggaaagggccctatttttcctaaaactgttcctaacagctgacagcaattttaagccacagcaggttggtcccagttccctgtataatatcatgagagattcatactcctatgcgaaaacctagcaatggtactaaatcatttattttgcatgaaacatcttgaattttcagaatatgaactttcaaagacggccatttatcaaaatgctaaatgtcacttttttg

SEQ ID NO: 725923 - DNA, 1251 bp, Homo sapiens
  misc_feature (1121)..(1121): n is a, c, g, or t
ggtgacgctgtgggtcgacccacgtcgtcgcagagtacgcgtgggtctcgagactgcatgggatggacccgacgcttccggaccctcatgtcggcgaccggctgggcacgcgatctagataaacgatgtgaaactcagcttccgaacctacgaactggggtccagagtgagacgctcagcacacaagggaacgagcgcgatgtaggccgattagaacccagtggattgtaagttacactccgtgacaatcgatcatgactttaagcattgaagcgatacggcacagttgcacgtgcaggccactttaagtacccacgataaggaaaacagagagattaattagacaatatcttgctcggaccagattccactatcaaatgtcgtgcataggcatggttccatgaagtttggcagtcgtgccatagatcccgcagaacttgcagggtaacacaaaccatgtgagtgttgcacaccctagatcccagcaaactgttgatcgtgactactttgcatattggaggaggatgcgcacagtcactgtcagcggatggggccaacgttgctattacatgtcaggggccctcccagtaagattgacaggtgcaactaggaaggtttcggtcaatcaattattttaaaaattccacggggtcttagaccaggcacgaataaaagcatgtggctttgaactatctatgtggcattttccacaaacacgtttcctctaattcaccgtatagaggaccacagacgttagaggagggcattacctacgttacacagagaggagggcatatttttgtcccagtaaccttggcacgatttgccgggaaggtgtggaatggcacgttccgcgaattcttattacgggagaacgaatacccacaccgccggaaacacagggcccacgctttgtgtggcacgacggctcctcgcggaccaacgcggggacttttttttggaaccgagaccacatgggggtttccagacatgtgtacacaccacgctggccattgcaaatcttaccaaagcgggtcgcaatgggcgaagtggacaaattatacggggccacacgacaagtttgagaggaaaacagccacagagaatgcaaaggtcatttnctatttgaacacccccgttggggcttattaacactagatgcccacgttacctttgaggtgcccagcgggtggcgtagagagtaaatgtataagagacgcaacggggccgatccggcaagaactgcaacta

SEQ ID NO: 725924 - DNA, 1100 bp, Homo sapiens
agcggctttttctctgtgcatcctcagtgacgcggggcacaggtctgcccgggggctaccatgagcccgatctggagcccacacgtgggtcatgccctggtgcggaggaggccgctgtaggcgcggcagttcacagtcggcaccaaaagtttggcagatctcagtgaggcgtagttgcatatccttgtgacggggtcttcaggaactgatatttgtgccagccagtttcctgtaataagtcatctcagaacaatgttaactccctgagctgcggacctcccaaggctcagctttggaggacaccaacaatgaggacacgcaaaaatgagcactcctgttgcagccctgaggacccgaacatggaggccgcagcagccagacccctaacactgaggcacaccgttctacacaaaccccgggactggacccaagacctcagtggcccacaggccaggtcctgaaggacaaccagcagcatatgctgtgagccacgttcctgcacaggatgcgcgggcagggatcagcgacaataagctgctggagcactccaaccctgagaaagcccaaatacttcccagaagcacaagagggccacgggcacaggtccccaagactgtgccagaagcgccgaaaaacacaaaggagccaatgaactaagagatcaagacctctgggcagaaaggagaaaacaagaaaaagggaccctgcacaatagacatcccaaaaggactggaaaaacacaaaggaagagggacaacgaagaacaaacagaggaacaaacaacaaccggcggcagagcaacaggcaccacgagacgggaaaagacagatagcgagaaagaaaacaatagaacacaaccatcacacacaacacacgaacaaacgagacagaaacaagcaaacaaaaggaaagacacacaagaagaagtaacacaataaaaaaggaagtgagcagaagaagaacagcgatacgaaaaacacacagacaagaggggaaagaggcgacagagaaagacaggacaaaacagaaaaggcaaaaacacaaagagagaaacaacaaaagacaagaagcagcaacacgacaaatcagcagaagccagc

SEQ ID NO: 725925 - DNA, 828 bp, Homo sapiens
  misc_feature (34)..(34): n is a, c, g, or t
  misc_feature (153)..(153): n is a, c, g, or t
  misc_feature (164)..(164): n is a, c, g, or t
  misc_feature (168)..(168): n is a, c, g, or t
  misc_feature (190)..(190): n is a, c, g, or t
  misc_feature (198)..(198): n is a, c, g, or t
  misc_feature (201)..(201): n is a, c, g, or t
  misc_feature (254)..(254): n is a, c, g, or t
  misc_feature (302)..(302): n is a, c, g, or t
  misc_feature (326)..(326): n is a, c, g, or t
  misc_feature (331)..(331): n is a, c, g, or t
  misc_feature (378)..(378): n is a, c, g, or t
  misc_feature (395)..(395): n is a, c, g, or t
  misc_feature (431)..(431): n is a, c, g, or t
  misc_feature (470)..(470): n is a, c, g, or t
  misc_feature (486)..(486): n is a, c, g, or t
  misc_feature (582)..(582): n is a, c, g, or t
  misc_feature (747)..(747): n is a, c, g, or t
  misc_feature (768)..(768): n is a, c, g, or t
  misc_feature (827)..(827): n is a, c, g, or t
agcaattttagatagagtaaattaactgattgtnttaaaatgttctttctaaatgggtccactctgctgcgctaactgttggagtattctaaagagtctaaatagtgatatttaaaagtacgaaattaagaacatataagttagataaaagtnattagtttaanaggncaatttaacaatgtgtgagttnagaatggngtnatgaaatattgataaaaggccaaaaattaagtttccataaagatattaaaggngtgtgagaatactttgatgcgtataaaagtagctgagtgtgaattggngccatggattagatggttaaatgnaaaanagtggaagtgagaaggaataactgaagatgcgtgtggaaaaccagtnatgtagaggtgtgagcntagggtggaggagaacagggattagggaattaagcncgctggaagagagcttcaagtactttgttggagttagcnccatttagaatttaanagatgcaaaatatactcactatagataagattaatgtttcttaagaaagtaaggcaaaaataattcagcatgagctaatggactgctaacagaganaccaccaggtacaagtgcacacacatgcttggtgcctggccagccttccacctagtcggggaggagctgtttctcttcctggccgccagggggcagttagctcatggctgagaagtctctcaagggttcagttaaacaagcttccaaatcaaactcatcctccanttgactgtgcatgtgtctcancttggtgggtgtgccagagtacacatcaaagtcatcctgagagctggtctggggctcgna

SEQ ID NO: 725926 - DNA, 382 bp, Homo sapiens
tagaagaaccccctagagtggctaagcatgtttttttcgtcattcatactgtaaagggaaatgacggggtttttgattcggcagttgtttctcgctctctcgtgagagtgctcactctctccccctctctcccttgattaaatagttcccaggctgtaggcccgaccatacagatagaactgatatccttaagccaacagagcaacactaaactaagccgatgctattgctctaatttaccagaagcttctttaagaaataaatgtaaagcagggactgaagtataatcctaccatctcatcagcaattggcactgcaatacattatcctggaaacaactggtaaacacagtaagcccatttctgggcttttagaaaaacat

SEQ ID NO: 725927 - DNA, 278 bp, Homo sapiens
ataggtggatattagaaaatgctataggaggagtcacactaatactatcaactatcagtcttcccacagcttcaatcactgtcattattctaatcctactcctcacttcacaattttaagttctgcaggtttatgtcaaaagcaacatttccaccaaatgtacttttcaaggcataataagggttaaaattctaggcagtatcaacacacccccataatgcaagtacataggtactctaacagatgtggactttatttgctcatatgggaattacctt

SEQ ID NO: 725928 - DNA, 139 bp, Homo sapiens
tgggtcgtctagaggaccccggacatttgcccaaaagttagaactcaccacacaccatagaatcatacaggagagcgaccctatagtgtaccgaattggtgccaaaaaccttcttgtaagaagtcaaaccttatcatac

SEQ ID NO: 725929 - DNA, 662 bp, Homo sapiens
  misc_feature (238)..(238): n is a, c, g, or t
acaggaacacccttttcccaaaaattatttcctccggttcagcgccggaagtggttgaaggggccccgccccactatccggccctggagcactttgtggacaacagcgtttttcacggccccgcaacctgggagaattgtgccagcgccttgtacgcaacgtgaagaacaccagagcaaatatgtgtttgtgttcctgggcctcatcctgtaatgtgtgggaacgtcccctatgttgntggtggctttggctgtttttttgggggcctgttacattttttatttgggccccttggagtccaagcttgtgctttttggccaaaaggtgagcccagggcatcagtatgttttgggtggaggaatttccttcccctttttttgggtgggtggggggggctcgccctttttttgggtgttgggaacccccctggtggttttgggttcccccacttcctttcccccaaattgaggttgtggacggggaggagctgcaaatggaacccgtgtgaggttttttttgggacctgccggcctcccgggccagttgccccccccctgcccatgcctttcttgcagggtttttttgtttgggcccccaggcccgtcccattccaagcccggggagggatccccccttttaaaataaaatttttatgggggtca

SEQ ID NO: 725930 - DNA, 756 bp, Homo sapiens
gtggctctggtgagggcacgagggatcaccaccagctcgcctgctggcacccgcgaacatgctggcatggttctcactcttgctgcgtctgtgcaaaccagcacggactgcttcggaaatatggtctaaatataccccgacagtgttcacgtcagtgcgcgaagaataacggttaatcaagctgcactaaatgctcttccttgagaggattatgccaaggcatctactgaatgaaataccatgatgactctttgtgtataacacaaacctttgaaaagagctcccgcacatccatgcctttgcactgtagaccctgtccccacaccagagtgtacattagcgacagatatgacgtactgggatatgcacagccatttaggcatatatccccttcagggagtcgaattacaattcactgccccgtcgtttaacaacttggcccatgggaatctagtgtcgtgcccgattttaattgcgttcgaaattatagctcttttgccaaatgcggtatatagaaagaggccttacactatactgctcgccaaatacaaccaccctgatgggaaatcgctagtcgtacccatcttattcggtaaaatacatgtcaatttctccaaatgcagttaatttataaacgcatgggccgatatcggtaaaaactttttaactaaagaatggccacgggatatggtaggcgtttttcctgttgaacaaggtccactttgaacggggcttcacttacgggctcgtataggc

SEQ ID NO: 725931 - DNA, 930 bp, Homo sapiens
  misc_feature (94)..(95): n is a, c, g, or t
  misc_feature (101)..(101): n is a, c, g, or t
  misc_feature (107)..(107): n is a, c, g, or t
  misc_feature (111)..(111): n is a, c, g, or t
  misc_feature (119)..(119): n is a, c, g, or t
  misc_feature (131)..(131): n is a, c, g, or t
  misc_feature (154)..(155): n is a, c, g, or t
  misc_feature (166)..(166): n is a, c, g, or t
  misc_feature (175)..(175): n is a, c, g, or t
  misc_feature (180)..(180): n is a, c, g, or t
  misc_feature (212)..(212): n is a, c, g, or t
  misc_feature (215)..(215): n is a, c, g, or t
  misc_feature (273)..(273): n is a, c, g, or t
  misc_feature (277)..(277): n is a, c, g, or t
  misc_feature (280)..(282): n is a, c, g, or t
  misc_feature (296)..(296): n is a, c, g, or t
  misc_feature (327)..(327): n is a, c, g, or t
  misc_feature (355)..(355): n is a, c, g, or t
  misc_feature (569)..(569): n is a, c, g, or t
  misc_feature (573)..(573): n is a, c, g, or t
  misc_feature (583)..(583): n is a, c, g, or t
  misc_feature (593)..(593): n is a, c, g, or t
  misc_feature (930)..(930): n is a, c, g, or t
gctggagtctcatttagacgaatgatcagcaatacgttttagaacatatgaactgagatgaaatggacatttttgctctaattcacggtataanntccagnatgatnatanatagagtnctgatgcattantaaaagcagccaaatagggccanngagaaaaatancaggactcngtacnggacctaactgtatcattagtaaggtaatatntcnctcatttcgttactgctgccattttcctcaccagtattccagagatggtcatagctcnttantannncacaagaacctaanaggaattagaatacagcagaatcggcctcangtgaagagcttaaaattgttctcctcgntagaactggactattgatcattaccacgtgacgttggcatctattactttctgttcccaatgtccttctagtggttcgagaatgttaaaacatccctaaaatctaaatcatataatcagaattctatagtgtcccactctatctgtaaagatcattggaagactttagactctattaattttaaaaggaatatttattagcatatgcagaattnctantgatgatatngtacagcttntaattcactttcagatcaggtttgaaatggccatatcaggtcggattaagtccaaacgtactgaactaccaaaaatgtaccttccagacgcacgttaaacggaccgggagacagtcaactcaacatgctaatgactcccccatgcggaccatacacaacacgcacgacagcccccctcactaacactatcaaaggactgcaatcgcggaccccagcacccaggcgggcgccaagggtgacagcggcaggcacgggcaacggcgagcccacaaaaagacggcagaagccacaggcaaacaaacgacggacgcaagcaacaaggcgcaacgcaaaactn

SEQ ID NO: 725932 - DNA, 834 bp, Homo sapiens
ggctcagctataggggacgctctcagctctcggtcgcatggcccagtttccttcaaaatgtctactgtacacgaaatcctgtgcaagcttcagcttggagggtgatcactctagaaccccaagatgcagtatgggtctgtcgaagctgtatactagatcttgtatgctgagcgggatgcttatgatcgattggaacagccatcaagagcaacaggtgtgggtgtgagggtccaccaatgttcatcattctgacccaatccgtaggaatgcacagagacagggattggttgcctatcggcgtaccagagaaggatgcaacaataggaacttgctatcgaggcacatgaagtcggcactttagtctggcacactgtggaggacggtgattttgggcgctattgaaggacatcggtggtacagatatgacgcattctggagactaagaagcttccgtgaaggggtcatgggagaccgatgaaggtagtctctgcattgatggatcatctgggtccagaaaccaagcgaggagactgtgaggagattaacagagtctacagggaaatgtgcaagagtgatctggagaaggacattatttcggataaatctggtgacttacgaaagctgatggttgccgtggcgaaaggggtagaagagcagaggatgggtctgtcattgattatgagatgatggaacaagatgctcggggaatgttgatgaatgctggttgtgaagagggaaaggagggttgttcccagggtggataaggagtaatgacgagcggagggtgcccatgtccagaaagtatttgaaaagtacaagaagttaagagtttga

SEQ ID NO: 725933 - DNA, 1226 bp, Homo sapiens
  misc_feature (534)..(534): n is a, c, g, or t
  misc_feature (633)..(633): n is a, c, g, or t
  misc_feature (771)..(771): n is a, c, g, or t
  misc_feature (845)..(845): n is a, c, g, or t
gaccaaggagccttttgtgggtgaattcaccgccgggggtgttttccccgcgggaagaatatttttgtcccccccggcgggggatatatatattttccgttttccgtaagaacctcctccacaacggcgcgctttttctcgccgggggcctcttctataaagagatggtgttgcgcacaacgtctcgtcttataatgggggagcatgggggaaaaaaatgcgcaagctcggttgttcttggcgcgtcccccctcgtggtgttttctgttggtagaggagaaaaaatttgcttatagggcgaacatttgtagtaccagaagaccacatgtgttgtagagagaagacagcacacaggtggagaaaaaacacataatagaacacacatataaaggcccttatatatagaaataaaagagatatgtgtgtgcgcacaaaatatttgagagaggcgcccgtgtttgtaaagatatttgtttataagtgtgtatgacgacacatatactcgtaacacacacacacgcagcattagagggnggtgtataacaaattttcgacaccacagggcgcttcttatacttcatagtgtgtccttctgtgggggtgtgtcccacaggtgatatttgttttcacaanatgtgggtgtggtcgtctctgctctcgcggcgcgtcgtcacatggtgatatgatatatgtgatatgttgatgagctcatatgctaagtgagactcagtatgatagtattgtggcgaacacactaagagtggtttatancttgtggcccttctctcacaactatatagagagatgttctctagaaataagtgtgctctgtgtgttctctgtgnggtgattccgtgatatttctctctatagatatatagatactagatagatgttaagatatgttgttagagagacacacacgcggttggcacgagtttctataaatgatgtgttgtctggtgtctctgtgtgtgtttttggtgcgtggggtggtggtataataaaagagcacagagttttttctcttttctaatgggttatatttaaaaacaattaagcggtgcgcctgtaaaataaattctcttggttaataaatgcgtcttggagaatggtgttgtaagagaagttgtaattaggagattaaggttttaaaaccttggtttgaaagccacattgttttggttatttttattaaaattagaaaaattgaaaaaggttttcca

SEQ ID NO: 725934 - DNA, 741 bp, Homo sapiens
  misc_feature (138)..(138): n is a, c, g, or t
  misc_feature (166)..(166): n is a, c, g, or t
  misc_feature (380)..(380): n is a, c, g, or t
  misc_feature (384)..(384): n is a, c, g, or t
  misc_feature (394)..(394): n is a, c, g, or t
  misc_feature (404)..(404): n is a, c, g, or t
  misc_feature (741)..(741): n is a, c, g, or t
aataaaggtaatatagactgcgttatttaaagaagcgaaattgtctaaacaggatttaagaaagatgatgaaagctcagtaactctaacgagaaagagaggtagaaagaagataggatacgacgagaatcggcctcangtgaagagcttaaaattgttctcctcgntagaactggactattgatcattaccacgtgacgttggcatctattactttctgttcccaatgtccttctagtggttcgagaatgttaaaacatccctaaaatctaaatcatataatcagaattctatagtgtcccactctatctgtaaagatcattggaagactttagactctattaattttaaaaggaatatttattagcatatgcagaattnctantgatgatatngtacagcttntaattcactttcagatcaggtttgaaatggccatatcaggtcggattaagtccaaacgtactgaactaccaaaaatgtaccttccagacgcacgttaaacggaccgggagacagtcaactcaacatgctaatgactcccccatgcggaccatacacaacacgcacgacagcccccctcactaacactatcaaaggactgcaatcgcggaccccagcacccaggcgggcgccaagggtgacagcggcaggcacgggcaacggcgagcccacaaaaagacggcagaagccacaggcaaacaaacgacggacgcaagcaacaaggcgcaacgcaaaactn

SEQ ID NO: 725935 - DNA, 217 bp, Homo sapiens
cctttcctttaaaagactgaattgattgaattatgctagatcgtgctataacaacaaactccaaaactggaggtgatgacatttattttcttctttctctctccactcctcagattcatcacctctccccatttagaacggatcctcccgtggtctgtgcctcctctaatctgactcaatttcccacccctccatgacttcctaacaccttgcacta

SEQ ID NO: 725936 - DNA, 489 bp, Homo sapiens
taaagatgggtcagatagaccatactgaagggtaaagggacagcagacagtaagctcaataggttagagcatggcactaatagagggtagagggaacgagtgagcaagaggatcaccctaagccgtgtgtagtaggcgcatactactgtgcagctgtatagagtactcatgggtacagggccctttgcattctaatgagacggaccgactcccccggtgtagtagcgttctactgcacgattagccagggccttgtctcctgcctttgaactgagtcagtggagctctactagaatactactacatggactagagagccgctggaaagatatccgtgcccggataatttctcatcgccagcaaagagcttgagttgatcaacctgacagtgggctatacggcatcctcatcttctccctcatcgtcacctaatgcatcaatagcaaagctgatgtccttctcatagcttcccccgggagccaggaactg

SEQ ID NO: 725937 - DNA, 303 bp, Homo sapiens
tataaaatagctttcgactatccacagctctgtaaatgcacctttctcatgtccaaataatactgaatcgatagtaccttcaggatagcaccgcagtcaccgcaatacaaggattatgcttgcccgatgataagagaatggatgatctgtgaaaacacttctttaccaacaccactttctcctacaatcaaaacggttagatcagtagctgctacttgtaccagccgtattgagtgcatgattcagcgatggggaattgccgataatgccaaacctgttttttatactttgaagatccataga

SEQ ID NO: 725938 - DNA, 235 bp, Homo sapiens
gggacacactcattgaaaggatattcctactcctttatattacttttttttttttgggggcggggtttaattcctataccccggcctagagggcgggggggggatcacggttaattgcagcctaaatttccagggctaaggggattttcccccacttaagttttaagagtggcgggaactaccagaacatgctaccaccccgggttaattttggaattttaagaaaagaggaggt

SEQ ID NO: 725939 - DNA, 411 bp, Homo sapiens
  misc_feature (1)..(1): n is a, c, g, or t
  misc_feature (5)..(5): n is a, c, g, or t
  misc_feature (228)..(228): n is a, c, g, or t
  misc_feature (263)..(263): n is a, c, g, or t
  misc_feature (306)..(306): n is a, c, g, or t
  misc_feature (349)..(349): n is a, c, g, or t
  misc_feature (361)..(361): n is a, c, g, or t
  misc_feature (372)..(372): n is a, c, g, or t
  misc_feature (374)..(374): n is a, c, g, or t
ntgcntaatcctggggtattcggcgatgaaatattgatggcgatatatcccgcgcggcaatgctgcaaaccggtgaagcgcagtttgctttccccattccttacgagcaggccacactgctggagaaaaacaaaaatatcgagttgatggccagtccgtcaattatgcagcgttatatcagtatgaacgtgacgcaaaagccgttcgattaacccgaagtccgtgagncgctgaattacgccattaaccgtcccgggcgctgngtgaaagttgccttttgcgggcttatgcaaacggcagctactnggtgtgggtacccgccaagtatcggcttacggggcaaaagttnataaaacccgtnggccttaccgntnccagtggaaagccgcgcggaatttaccttgaaaagag

SEQ ID NO: 725940 - DNA, 442 bp, Homo sapiens
ctcggctccacgtgggttgctgcctccaagggatcccaaagttcatctgtctctgtgatatatctagaggcgtcacctgtggggttctatgaggctcttggggctcatctctcccagttgtctcctgtctgtagaagaggaggcagttcaattgagacttgagataaagcttatgctccagaccccgtggattctggatcctgtgtatcctcaagactctgtcccatccacgaggaggtctagtagtaggcttggaagggtggcactggaacccacgcgacactagtcgtggccagctcggttcagagagcccagtaaacgcccttggcggaaggtcagtttctgccagctgaccttgagtgtgtcccacatttgcactgagttgcctcccggagtgagcgtcatggctgtaaatgggtactgtccataggtggtctctagg

SEQ ID NO: 725941 - DNA, 751 bp, Homo sapiens
  misc_feature (267)..(267): n is a, c, g, or t
  misc_feature (313)..(313): n is a, c, g, or t
  misc_feature (468)..(468): n is a, c, g, or t
tgggctctagagggggtaaagggggtgctatagggtacatacggaccctatttcaaaaatttaaggggaataaattctaggacagtggggcttagaaactggtggtttggctccacaggttttcaagagcatttgacctgtatgtatacccccgggtctgtgtagcgggtagaaatgtgtgttgggttataagactgtccgggagaattgctctctggttttataacgctctataggtggggagacacgtctcatagatgtcgcaanagacgtgtctttgtgagatgtgtacatttatttatcacacgaatgnggggcgcttacaactccggggatgtcactaacttcagatttgtgctcaacctgctcaaggagatgctccgcatgtgttccgccttgggtctcatagagaattacatgtgcgggagacatgtaatgtgtacgagatgttgagacaagattaatgtncccgcgcgtaaatccgggtgtgtaacctccgtaagtgtatccacatgtacacctattgtggtgtgcggccaattgagatcttgcgatgcgtcgtaacgggagagggagacttctgtatgagaccttcgagtcatgggtaatttgttaaacggagaatcgcagattaggagattggagatgtggccagatagaatggacctaaggattagaatgtgcggggcaggagaaatatgttccacgaacgggtgttcataatttccttgaagctgtcttgaaaactgta

SEQ ID NO: 725942 - DNA, 181 bp, Homo sapiens
tcataaccaatgatgtggaagtaacattgcaatgttattagctagcagaaaagagatgaactcaatattaaatcggcataaagggacacatcactggcagtatacacataaatatgattaacgggatgcatgaaaatcttatgcgaacagtaggtagcctggcagatgagtctagatgcag

SEQ ID NO: 725943 - DNA, 417 bp, Homo sapiens
ggggggtgcccaaatttatgcctttatatgtattagcaaaataggccctgcaagaaatcgaatctttaatgtggtataagatttgatgcataccagtaacgcgtctaaataggtctgctcaccagtcactaaacaccaaaaacagtcaagtgtaccatagacattgactcccagagttaattacaggttaacacgaaaagggtcaacctcattctatacccccaactcctgtgaaatgccataacacgtattgtcaaacaccttagtctctatgatcttgcgtggaggttcaccataaacagccagaatatcagtggttctttcatcaatagtcaatgcctctctgtgacagcattagaagtcagaagaaatccccctgagacttcaaaaatgcattcattccaagaaaagcttccc

SEQ ID NO: 725944 - DNA, 229 bp, Homo sapiens
gccacccgggggcttttttttttttcccccatttaaagggaaggggccccccccctctaaccccccccccccatttttgaatggccttttttccttgggaaagaccaggggtgggagggggggacaatggttggggtttccggggggggtcggttcttgtcccaaagggatttggggggggggggggccttcctttttgggaaaaaggttttttaatcccttttcccca

SEQ ID NO: 725945 - DNA, 1214 bp, Homo sapiens
gccttaggcttcctcaaggagcaggttcagcgggatggagcagctgctgtcctcgccccaagggggtctgatcctctgagtatgccctctttacgttctatccagtccttacgaatcgtgagtctgagcccctttagccttatcggcaaatgtggtagcggggcgtcatccatgcgcaggggccctccagctgctccagagaccttgcagggctcctaggcacagggttgaagtcgtcgtctgagcctgcgctccttcgtccccgctgcaacccggggcaggctgcccacaggtgcggagactctagcatgacccattgtatcacggcgtactggaggatggactgccaggatcaagccagggtccgagggaggcagcgctgtggtgaaggggacagtctgtcacgaagtcctggtgtcttgtcagacatatgcaataccgactagaggatggagtcctgcagtgcccgtctactattgcaggcagttcctactaatggcagcagtgctccatggactgaacctgaagtcggcatgtgatgggacacgccgtgcagagtgatgacgagtggagaaaagcacccacttgatgaaggtggcgcatgagtggcgccagggtgctcaagagatcctagtagcctagaggtctcagccccaagtggatagcgttgtgcgtgacttgctccaagagcgtgtcaagttcacctgcaggatccaacgtccagtgcgaatggcggcctaacaagagtgtcctgactggatggcattcgaggaaaacttgttggtggatgatgcgccgggtttcgcctctcaagtaactcttcaggctgtgctcctttaactaggggggcgtcccacaggcattttggcgccacaggggcaataccggtgacgccttaaagtgccatgcccaagtggaaagtcgcccatcagatggaccacaccttggatcaaggggttgccaaaaaggggaagtcaacgggaacgcctgtgacggccgggagaacccgaggctagccccaggcactggatgccagacaagagatcgctggggaatcccaggcggtgcagaccaggccgcgccctgtgaggggaccttcacggggccacactggggacgcccccaagtggggcgccctactgagacctaaagcgggcggagcccaagacggcgcaaaatatgagaggggtaggcatgggactcggcctcaacga

SEQ ID NO: 725946 - DNA, 126 bp, Homo sapiens
  misc_feature (110)..(110): n is a, c, g, or t
  misc_feature (123)..(123): n is a, c, g, or t
aagaaccgtccagagctgatgacgctggggatccgggatcaaattggcgggggctggctgtgcctcaattccgcaccataaagcttcaaactccctaaaaaaaagggaanaaaggggcgccgntcg

SEQ ID NO: 725947 - DNA, 124 bp, Homo sapiens
agaggatccccgcgtagcaacaagtctcgctaacatttgcagcaataaggagcctgttcaagagggtatgtgctactgtgaattccagttgctattattgcccgacgatctctgtctgctaccc

SEQ ID NO: 725948 - DNA, 103 bp, Homo sapiens
cggcagacgacggggcgccccgcccgcaaccccggaaacagacccgcagggcccgggccgaccggcgcggcaaccgggacaggccaacccaaggccggaaccg

SEQ ID NO: 725949 - DNA, 278 bp, Homo sapiens
ccagagtcaccaaggaggcatgatgctggcacagaaaacccttgtcagaaattcctattccttaattttatgctctttctttcattcttttctcacttcattgtcatacaggcaagtgaaaaagagtggaaagagaagaggcggtgtcaaaggaaaagagaaaaaatacacctgactcctgttgtttatgattgtcttgtcagttaacacctgggcaatcatcaaccatgtactttccttgagccaggtccttaaagaacccaagatgaaggaagtag

SEQ ID NO: 725950 - DNA, 545 bp, Homo sapiens
tcaccttctccaccgcgcatgtccccaacacgtgggaagtggaagctgagaagggaaggcagatgggagaaaccaataggaacttctcagtccttttttcctctttggggaataaaataggaatccattatgagtgctttgctgactgagaatgtagttgaaattattcttaaacatcttttattattactctcagtagcaaaatatcacactgaattcttccatacacaggcgtatttctagtcagtgtggagcaaagacagtcccgtttgctgctcctgtgagaggtcagtggtgacaggacagggaactgacctcttaagccagtgggagtgtttcataggcgagggtacaaggccccttagaaggttctgggagaggccttcctccagcctggaaactccagcaggaaatgcccttcactctgtaggtgctcgagccccaatagaggatgcagtgtggggtagtgctgctggcctagaccagcagaatggctgctgtacgatttcaaattcatgtggtggattcctacactttacagtagc

SEQ ID NO: 725951 - DNA, 537 bp, Homo sapiens
ggaggccctgattctgggggctgaggtccctgaccctgagccactgccagctctgcccccgcaagccccgctgtccctgcccacccagccaccgtccccattccatcacctgtgacttcagccacagcctgagctttgggggcagggaggacgagggtcccccgaggactaccccgaatccccatggcgcctgtggggcagtgctccccattccccagacctgtccaagaaggatctgggacgctcatgctcctggacgactcactgactacacgctggcctctgatccacgttctgtccagccaatgtcccaccgaggacactccaaaggccgagcaggaccgccgcgactcccaggcctttcacggcaatgcgaagggagggcagagtagtcgctgatgaacccgtaggacttgcacaccctggtgcacagcggaaaccagggcgccggcacttgagagagcttggagatgagccaaagggcaaacatcacatcaccagccgcgttcaaaggagcgcaatgagtgtaaaagaaga

SEQ ID NO: 725952 - DNA, 117 bp, Homo sapiens
gggtccatgtctccaggcggggcggtccccatgcactgcctgctccatcctccccactcctgtcttgctgtgctggaaactcaactccacccctttctatcttagtggccttagtta

SEQ ID NO: 725953 - DNA, 168 bp, Homo sapiens
gcttgaatactgccactgcccacaacatgagccgcgtggacatgggccatacccaactgctcattggctatcagtaaacacagccttgagctctgtaatacgtgtgctgctcacataccctgcatgactcgctatcacccgaagaaggaaagtgccagctactccacc

SEQ ID NO: 725954 - DNA, 254 bp, Homo sapiens
  misc_feature (124)..(124): n is a, c, g, or t
atatcggaggtcaattcatttctcaaaacagcagtaaaattaaaaattttcatgatttgagaagccttggcttgaaaggaaaaagtcctaatagtagaagaacccctccaaaacctggagtgantatatggatgcccccccccccccacacacatttgaagaacccgtatacataaaatttagacaaaaaaggaaggaatcgaaccccccaaaggtggtttcaagccaaccccatggcctccatgactttttca

SEQ ID NO: 725955 - DNA, 446 bp, Homo sapiens
atccgggcagtacggatgtgttttgttttgttttgtttttttaataatgtggcaaatgttttatttctcttgtatgcaagtaactgactctcaagtatttttaaaaacacatcattacacttaagtaagaatgttataacctacaacattcttacatatttaatattattgacatatttgaatattgtttattgcttctgccattatacacagaatagttttttactttcctgcttcttagacttttctctgacagcttagactttttacaaaatgagccatcccaccagttcctgtggaattcattgtttctcagtgtttgcaaagttacagaacattgtagtgcttcagcacatctccaaagggctccttcctctgccttcctgccatctttcctgctgttgtttttctcactgtgcctatctggcagagcaagattgtggtga

SEQ ID NO: 725956 - DNA, 1058 bp, Homo sapiens
  misc_feature (142)..(142): n is a, c, g, or t
acctcttaaacggcactcactatctacatgagtacacacatcaccctcctggtcatacacctattcgcctagtgcttcctccgtattccgtcagaacgccagacattaaataactcagaggtgtgttcacttgcgtaataanatataaagaccatacaaaacatacaatatacatacaaaaacacacaccatgaacaaaaacaacaataaacacataccaccattcgcgttgtactatcgcctatgaggacagtaacttatacacacagctccatcgtgccatacgcacaaacaggagccgtaagaagtcgctcagttgcagtagcgtcgtgtcaagtcaggccacataggccctcgtagtaacagccattctcatccaaaccccctgaagcttcaccgggcgcagtcattctcataatcgcccacgggcttacatcctcattactattctgcctagcaaactcaagagcgtacgaacgcactcacagtcgcatcataatcctctctcaaggacgttcaaagctctactgcccactaatagcttttggatgacttctagcaagcctcgctaacctcgccttaccccccactattaacctacggggagaactctctgtgctagtaaccacgttctcctgatcaaatatcactctcctacttacaggactcaacatactagtcacagccctatactccctctacatatttaccacaacacaatggggctcactcaccagcacattaacaacataaaacctcattcacacgagaaaacaccctcatgttcataaactatccccattctctctatcctcaaccgaaatcagttaccggcgtatcctctttaaagagagatacacacaaaaaaagagggagcggaacacaaacaacaaaaccaaagcgaggccaggcacagcgccccgaaacccaaagagaaccacgatgagccacgtgcaccaggcccctcaaccaaaagcgcgccccgcgcgagaacaacaagcgtagaaccaacgatggaacaaagccacacatcaaaaaaaagggagcacgcggggaac

SEQ ID NO: 725957 - DNA, 210 bp, Homo sapiens
  misc_feature (89)..(89): n is a, c, g, or t
aattgcaccacccgtaccgccaatcacggcacctttaatcgccccttcgaggccattgcgtcagaacgccagtagcagcaccaacggcnggcacccacttttgcaccttttgactcgagcattttttgcaccgtctcgacttggaacctttttctgttactgcaccaacaccagctgaccaacagctgctgccatttcagtcactgatta

SEQ ID NO: 725958 - DNA, 141 bp, Homo sapiens
tagctgttattagaagtgggctagggcatttttaatcttagagcgaaagctataatcactgcgcccgcttcataaggggatggccatggctaggtttatacgcatagttgggtggttcggtgtcaatagagtacaggcagg

SEQ ID NO: 725959 - DNA, 265 bp, Homo sapiens
tgtcttgggacagaacaccgtggactgtatacttgcattgagttggaagcggtttgcatttacgcctgtaaatgtattcattcttaattatatgtaaggtttcgttttgtacacaattctcgattctgtgacgagatgacaacaaattaaggtttgctactgttatgtgagaacattaggccccagcaacacgtcattgtgtaaggaaaaatagaagtactgccaaagacttcgtcctctactggcccccggtccgtatttacca

SEQ ID NO: 725960 - DNA, 326 bp, Homo sapiens
ggtcccttcagcttttgattttcaacacaaaataaggtttgctttctgtttttaacaataaagctgacttatctttgtatttgattctaccaagctataagccctgacacactgctatatttctggaacttacaatggtgttcggaatgtaggtaaaaactgagcaaatacttgtggaattaatgaaggtataaagaaataaacaacaaaccaaggaattctcacattgaatgtcactgttcctatcttttttttttttttaatattttatggaaagaggagctcccccaagggcccaggggggggggaacaggggtaacctgggg

SEQ ID NO: 725961 - DNA, 795 bp, Homo sapiens
caataacccctcggagcaggagctggagatgtgagcctcgcagctgttccctgctagagcagctgggcctggcctggggcagaccttgcggcccccggggtacagcagcagctggagctggagcgggatgcgtgctgcggctgggaaatccgcaaggatgctgaagctgaaggagggtgctgagaacctgcggcgggccaccactgacctgggcgcagcctgggccccgtagagctgctgctgcggggctcctcgcgccgcctcgatctgctgctccatgcagctgcagtgagctgcacgcccgacgtggtgcttcccgacccggctggacacccgacgatggcccccagtcccctggtgcgggtggacgccacctgctcggccagccaaccatgagccgacagtggcgggcctggagaagcagttggccatttgatgctgaaggtgaatgcaggggggcttggagaacattgatccaggagctacatgcaatggcgagcaccaaggaccggaagctgcgtgcgtgacagcctcagcagatgttgcagggaccagtaagaccaagattgagcatcatccgaatgcaactccgggcgggcgcttgcaaggccgtgccagctggagaaccagggaagccccggatgacaaccaaggggagtcctgaccctggggcgctgtggagcttgcgcatcgacagcttgcgggcaaccaatttccggagtggaagcacggcggtgggccgaagggtgccaacgaaggctactgagccgtgcacagccgctgcaaaggccccga

SEQ ID NO: 725962 - DNA, 331 bp, Homo sapiens
aaccctatcggccttgtcactggccttggtccctttgtatttttgttttggttggaaaaaccatcagccttccttggtcggcccaggtttgtttcaggcattttagtcggcgttttcccaagggccgggccaaaaacgggggttggccgcttgtttccacgctccttctgccccagccctttggtgtccccccctgcccccaaaaaatgttaacccagtggggtttgccccccccgggccccaaagttaccaaactccagcccccctgtttcctcctgcctggggtggcccttgggatggaaaggggtggaattaaacctgtcccccttta

SEQ ID NO: 725963 - DNA, 322 bp, Homo sapiens
acgaggattccggtcatggtgagtctccttgtcatcaacgccttgtgctgtgcggcagaagaccgcgcggaatcaggccgccgtagaacagcacatgggccacactggccagccctgcgacagcacaccaggtggctgccgtggtgaccgtggtgaccaggcgcgccgcgtcggccgtcttgtcagcatcgggacgggtcccggaccccagtaaggggcggaactccacccggttgccgtagtagacgttacgtccgccgagttgaacaccgagggccgctgcccaggccgactcgcaccagccaccgttgggactgggatg

SEQ ID NO: 725964 - DNA, 845 bp, Homo sapiens
  misc_feature (104)..(104): n is a, c, g, or t
  misc_feature (144)..(144): n is a, c, g, or t
  misc_feature (148)..(150): n is a, c, g, or t
  misc_feature (156)..(156): n is a, c, g, or t
  misc_feature (160)..(160): n is a, c, g, or t
  misc_feature (251)..(251): n is a, c, g, or t
  misc_feature (253)..(253): n is a, c, g, or t
  misc_feature (255)..(255): n is a, c, g, or t
  misc_feature (284)..(284): n is a, c, g, or t
  misc_feature (305)..(305): n is a, c, g, or t
  misc_feature (307)..(307): n is a, c, g, or t
  misc_feature (309)..(309): n is a, c, g, or t
  misc_feature (311)..(311): n is a, c, g, or t
  misc_feature (313)..(313): n is a, c, g, or t
  misc_feature (322)..(322): n is a, c, g, or t
  misc_feature (341)..(342): n is a, c, g, or t
  misc_feature (347)..(347): n is a, c, g, or t
  misc_feature (363)..(363): n is a, c, g, or t
  misc_feature (380)..(380): n is a, c, g, or t
  misc_feature (382)..(382): n is a, c, g, or t
  misc_feature (384)..(384): n is a, c, g, or t
  misc_feature (399)..(399): n is a, c, g, or t
  misc_feature (401)..(401): n is a, c, g, or t
  misc_feature (404)..(404): n is a, c, g, or t
  misc_feature (413)..(413): n is a, c, g, or t
  misc_feature (433)..(433): n is a, c, g, or t
  misc_feature (435)..(435): n is a, c, g, or t
  misc_feature (444)..(445): n is a, c, g, or t
  misc_feature (461)..(461): n is a, c, g, or t
  misc_feature (465)..(466): n is a, c, g, or t
  misc_feature (472)..(472): n is a, c, g, or t
taaagttttaaaacttttaattggcatattaaaaaaatggtgcattccaattaatttaaaactcatttgaacaaaaaaaaaaagggcactcgtgatttaaacgngcatttacagccgtgcaggacaccttggggccagcttggntttnnnctctanattncacgtgtcgtcccaccccacttttttccacccaactttctttcctttcaccaacatgtgcaaggtatcttttcctttccctgtgccagcananantaggattaaacagagattggagaaagggnagggggcgggcctttcgtggncnanangntctcttggnagtggtgaaaggggccacnnaaagntcaatttaaccttggnatccaaccttcttgtgncntnttttacaaaagtttnanacnagcttaaanagaaagttaaaataagaaangncaaggcttnnggtggaagtgttccangggnnaatatntgggggcggggccgcaaccgccctctccatattacagaaaatacgggccgtgtgaatgggccgtttctctcacagggttctacaaactcgggtatctctatttggggaaaggggcacggggcggaatattacccatcaataggcgggtcactcaggaggctatccttccagggttctcgagacccttatttcagaaaattttcgtcggactcctcagggccaatatttcgggggtttgggtccgagaccattgggtttcgggaggcggggaaaaaggccgaaaacagaaggggggacaacgaatttacaaagacaaaaagtcccgggtcatgggcgccaacggggcgactaaggttcaaagaatcccgacaag

SEQ ID NO: 725965 - DNA, 425 bp, Homo sapiens
  misc_feature (29)..(29): n is a, c, g, or t
  misc_feature (47)..(47): n is a, c, g, or t
  misc_feature (249)..(249): n is a, c, g, or t
  misc_feature (281)..(281): n is a, c, g, or t
  misc_feature (347)..(347): n is a, c, g, or t
  misc_feature (363)..(363): n is a, c, g, or t
ctgtcccctccactaggccaggagcagantgacccaagcgcctctgncgttccactagacccttcccctggagcaacagtggcagggtggcttttgggcatcatcttacagatccttaaagatgtgagccagccattctttatcgtgggctccatcagggcagaaactgtcttatctgtaataccaactcatacttaaatgagggggggttccaatttgatctactttgtctcttcaagattggtagcntttctttggggtcattggttttatatgtttcnataagtgttgaatgtccacagccatagagtatggtcttgtttagaacaaacactcattgcataggnttgaatcattgggtanagagggtccatcctggtacttctcttaggcgtaacttttgcccctcagagtccacctcttgc

SEQ ID NO: 725966 - DNA, 553 bp, Homo sapiens
  misc_feature (8)..(9): n is a, c, g, or t
  misc_feature (20)..(20): n is a, c, g, or t
  misc_feature (25)..(25): n is a, c, g, or t
  misc_feature (49)..(50): n is a, c, g, or t
  misc_feature (58)..(58): n is a, c, g, or t
  misc_feature (67)..(67): n is a, c, g, or t
  misc_feature (69)..(70): n is a, c, g, or t
  misc_feature (77)..(79): n is a, c, g, or t
  misc_feature (93)..(93): n is a, c, g, or t
  misc_feature (105)..(106): n is a, c, g, or t
  misc_feature (114)..(114): n is a, c, g, or t
  misc_feature (119)..(119): n is a, c, g, or t
  misc_feature (122)..(122): n is a, c, g, or t
  misc_feature (125)..(125): n is a, c, g, or t
  misc_feature (127)..(127): n is a, c, g, or t
  misc_feature (137)..(137): n is a, c, g, or t
  misc_feature (142)..(142): n is a, c, g, or t
  misc_feature (165)..(165): n is a, c, g, or t
  misc_feature (189)..(189): n is a, c, g, or t
  misc_feature (198)..(199): n is a, c, g, or t
  misc_feature (203)..(203): n is a, c, g, or t
  misc_feature (208)..(208): n is a, c, g, or t
  misc_feature (210)..(210): n is a, c, g, or t
  misc_feature (212)..(212): n is a, c, g, or t
  misc_feature (215)..(215): n is a, c, g, or t
  misc_feature (218)..(218): n is a, c, g, or t
  misc_feature (221)..(221): n is a, c, g, or t
  misc_feature (226)..(226): n is a, c, g, or t
  misc_feature (243)..(243): n is a, c, g, or t
  misc_feature (245)..(245): n is a, c, g, or t
  misc_feature (250)..(251): n is a, c, g, or t
  misc_feature (255)..(255): n is a, c, g, or t
  misc_feature (264)..(264): n is a, c, g, or t
  misc_feature (283)..(283): n is a, c, g, or t
  misc_feature (289)..(289): n is a, c, g, or t
  misc_feature (323)..(323): n is a, c, g, or t
  misc_feature (339)..(339): n is a, c, g, or t
  misc_feature (345)..(345): n is a, c, g, or t
  misc_feature (351)..(351): n is a, c, g, or t
  misc_feature (354)..(354): n is a, c, g, or t
  misc_feature (364)..(364): n is a, c, g, or t
  misc_feature (373)..(374): n is a, c, g, or t
  misc_feature (392)..(392): n is a, c, g, or t
  misc_feature (408)..(408): n is a, c, g, or t
  misc_feature (411)..(411): n is a, c, g, or t
  misc_feature (415)..(415): n is a, c, g, or t
  misc_feature (419)..(419): n is a, c, g, or t
  misc_feature (427)..(427): n is a, c, g, or t
  misc_feature (504)..(504): n is a, c, g, or t
tgaaaaannaaagcagtaantttantcttaaggtggcactttaaaaaannaaaagggngaaggcctngnnggggggnnngggggggggggtgngggggggggggnngggaaagnggggnagnggnanacccagaaangaagncccccccaaccccaccccggggnccaagcagagacaaggcctcaggntagcccagnngggnttccngngnccnggntgnacagngctaggccaaaagaccncnggggnngggncacggcccnctagagactgccgccattngggggncagccacaggccaatgtttcctgggcccaaagangggagggggccccccncccccncccctnggncagaaaatcngcctggggnnggggggggggctacccanccagcagcttcagggngcnctcncgcnccttcagngtcttccaggcctggtccttttctttcttggggggggtccgcttcttctgccgggcagccatgatcttgcgaaaggngtccatgacctcgttgtcagccatgcgcccccgctgcctcagctcctgc

SEQ ID NO: 725967 - DNA, 302 bp, Homo sapiens
tagacatatacaatcgagctcgtgtacccaggtatactaaccaaaccaaacaaccaaagcaaaccaaagcaaaccaaaccaaaccaaaccaaaccaaaccaaaccaaaccaaaccaagaaagccatttttgatttctctggtgttcgcgtgattaacatgggctgtgaaatggttttctgcagttcacattgtgcgcaatgatacctgtgtgcatctgtggatcatatgtatatactgtaagtgcttccctccccctcacattatattatagagtttccattctgaggttaggtctacctgg

SEQ ID NO: 725968 - DNA, 146 bp, Homo sapiens
gctagctccccagacaccactaacgcgtaaatgtgcctcctacctacctacctatacacacctcgctcaaactcatgacgaagacagggcagaggtacaggtccagtctctagtaggggactcaagaaaggtgaaaaagatccaat

SEQ ID NO: 725969 - DNA, 604 bp, Homo sapiens
  misc_feature (207)..(207): n is a, c, g, or t
  misc_feature (277)..(277): n is a, c, g, or t
cccagattccccacttataacatgacgtacttgtaaaggaatgtatttatctaggtgcttcttggaaaatgcagacaatgccttcaacaagaacgcggtcatgacccaagtctctgagtgtagtgcagctcacatgatattgctgtcccatatttgactccccacaattcttctcctcctctgatgaacgactttattggaggtcanggattgaactgggaaactgacagagagatgcatggcgtggacagaacgacggtgactccgtccacccggngctcagctgtgcttgcctttcacgttcgctggacattctgcttccctggtttttatttttttccaagagtctgactcttattaactttgtaactcgaaaaaatcttatttctggacgggatccagacgttagaagtagaagctcgcagagaggaaagtcggcgtctctccgcaattggtccctggcgcttctccttagcctccttaattctctgggccaaaagtttagcatattcgggagcctcttcttaatttttctgggaacgcggcttcttcagagcaatacgccgccgttggtgctgcaggacacgtggagtaacaagacgct

SEQ ID NO: 725970 - DNA, 459 bp, Homo sapiens
atggaatccctttcccgatgttgttttgacattgaacattgtttctgtttacattgattatatctgtaaatggccagtctctggaaaatgctccatttgaccaccagctccatgtaaaacctcttatccaccgagtagcatcagcttcttcctcctctagagaagggtcagtgatcagaggcagaggagcttattgtgcaggaacctactagaccccagtgagctcacagtggctactttagaaaatgccaccacaggcctcgattatatcacagaccagggaaaccctccccatgatacagagatttttgttgccagcatagtttgaggcagtcggcaagaacatcgctggtccatgccggaaaccctagtgtacaattctgggccctggcctctgatagcctcactgtgcagctgagcaatgccttgatctgcttaaggaccaaagaggcagagccc

SEQ ID NO: 725971 - DNA, 920 bp, Homo sapiens
  misc_feature (916)..(916): n is a, c, g, or t
ggtaactcctcagaaagatatcaaatctcagaaagaatgtcaaatcgaagatgagagttatagttaggattctaactactgtaaaagattttggcttccctcttgtggtaaacaaaacttatattctcacacatttcttatgttgctctacagacggactaatctgtagaggaagagcatttgaaagcgagatttactcagtgaggtacatggatacaatcaagttcattttgcggagaacaaataactggaaataaaaaaatcagtgttaatccttgtatcatagtcttaatactgaaaggtatgtctgatagatacatttatctcacaagtcaagaagtgacagattgtgcagcactgaagagtctatgacagctccaaatttgaatgtccctaaataatctacgctgaaatctaagatatactataacaagccggttttgatgggtgaaagacatattaagagcgatgggctctcaaaatgatcaaagtattgcttctctctgttgatattaagagacgagaattgttgcatgagttcacttaattactgagatattcagagcatttttggacctctctctgcgtgttattaccaggaccattgtattttaagactggcatcatcaaagtctgtccgtgctcaattccatatgagcaatacccttcctaaagactgaaatttggagaggttaccctagtaaaaatgggcagtggttaccgggggacctatgagatgttgggttacttaacgggcatcgggcaaggacaatggtaactcagtcaggcaaacggaggctgaggcgaaattattacaaggggtcgagcgcacaagagaggggatcgacacggcacacggggcaaagagagataacgcgcgacctctttttctatataaatattcctacaacaaggnggcg

SEQ ID NO: 725972 - DNA, 417 bp, Homo sapiens
agactccactgctgatcttgactgctcccaccctcttttgtagtttcagcaaaacaactgaccaggattccttcctggtaagagaccagtgatcacagagtggttctggccagtctacatgggactcatgaaggggtatgaagttccactgcacatgcacgtttctcttttcacaaatactcatgactcctcttatagcatattaaatacgtacattggccaccccacccagcataaattcctatttcctttttcccctcctttgaagtgtctgtttctggcttctggctagaggcgatgcttcccagactgtcagaatggccaccttgcaggctgcaaccctgtatgaaatataaagctctcctttccaaatttatgtacctcatcattcaaaagttaacaccaggttgggcagcc

SEQ ID NO: 725973 - DNA, 507 bp, Homo sapiens
ggaagaaagaacgtgccactgcctatcagaaaataacaaaacatgggaaatacaaccaccaaattccgcaatgcactcatcaatggtgatgaaaatttggcctgccaaatatatgaaaataatcctcagctaaaagaatcccttgatcccaatatttcttatggagaaccctatcagcacaacacaccgttacactatgctgctagacatggaatgaatagaatattagggacttttctttttggtagagatggaaacccaaataaacggaatgtgcacaatgaaacatctatgcatttgttgtgtatgggacctcaaatcatgatatctgaaggaacccttcatcctcgcttagcacggcctgtggaagatgatttcagaagggcagattgtctgcagatgatcttacagtggaaaggagcaaaacttgaccaaggcgaatatgagagagcggctattgatgccgttgataacaaaaagaacacaccccttcactatgctgcagcc

SEQ ID NO: 725974 - DNA, 199 bp, Homo sapiens
ccgcgtgcagcttgattgctgcaggtgactctacagtgatctccacaagccccgttatcaagaatggtgtggcatctcctaatgaagtatatttactataggatatgagagcccgttctgacaatagcagtgtctatgtttctgcaatggtatgaaaaggcacttgctgctgtaggagtagggtccattgttcgtgttc

SEQ ID NO: 725975 - DNA, 686 bp, Homo sapiens
ctccaaggctcccctatgcctgggaaggtctgatttcttgcaaagccaggagtcccatgagccagtccctcatgagtgaagtactggccatgtgctgccccctgcaggcctgcctttctcatcacctttctcatcaaacaggcaaagaaaaagcccatgtaattgaatacaatcacaaaggcagtatttagcagcattcatcccccattttatctcattctgccatgtccttccctgtctatagatgaatatgaaactaccactgaaagcaaatcattccaggaataaggaaaatatgaggcaagaaactcctagggaaagttcaccacctacacacacacacacacgagtcagaactgagtccaaggccagtcttgaggggaaaagagagaagagttgcattcattgcacacctgctatgagccgtgcattagatcctccattatctcattaccatcataatctctcaggacaggtatcaccaacacccattttacagatgatgaaactgaggccccaagtagtgaactcacaaagaattcataagtatatggtctgtttgagtctaaaggcttccctcttcacagatgattttccatcttttttaagtagaaattgcattctcaaatgaaatctcaggtcccgtgtataagagaaacaataaaagcacagctctctgatggaaa

SEQ ID NO: 725976 - DNA, 181 bp, Homo sapiens
atgctggcgttctccttcatctgttctgctcacgctgtacagtgggcgctgccataagatgagggcgctgtgatgttcggtttagtgctattacagggaggcctgtcctcaaggccagtcactgctcactgctgcttgcactcggctgggttttgatccttctttgggtcatagtctgggt

SEQ ID NO: 725977 - DNA, 827 bp, Homo sapiens
  misc_feature (1)..(1): n is a, c, g, or t
  misc_feature (100)..(100): n is a, c, g, or t
  misc_feature (154)..(154): n is a, c, g, or t
  misc_feature (157)..(157): n is a, c, g, or t
  misc_feature (162)..(162): n is a, c, g, or t
  misc_feature (168)..(170): n is a, c, g, or t
  misc_feature (178)..(181): n is a, c, g, or t
  misc_feature (204)..(205): n is a, c, g, or t
  misc_feature (213)..(214): n is a, c, g, or t
  misc_feature (220)..(220): n is a, c, g, or t
  misc_feature (225)..(226): n is a, c, g, or t
  misc_feature (236)..(236): n is a, c, g, or t
  misc_feature (260)..(260): n is a, c, g, or t
  misc_feature (266)..(266): n is a, c, g, or t
  misc_feature (279)..(279): n is a, c, g, or t
  misc_feature (292)..(292): n is a, c, g, or t
  misc_feature (295)..(295): n is a, c, g, or t
  misc_feature (307)..(307): n is a, c, g, or t
  misc_feature (311)..(313): n is a, c, g, or t
  misc_feature (316)..(316): n is a, c, g, or t
  misc_feature (320)..(320): n is a, c, g, or t
  misc_feature (323)..(323): n is a, c, g, or t
  misc_feature (326)..(326): n is a, c, g, or t
  misc_feature (333)..(333): n is a, c, g, or t
  misc_feature (336)..(336): n is a, c, g, or t
  misc_feature (342)..(342): n is a, c, g, or t
  misc_feature (371)..(371): n is a, c, g, or t
  misc_feature (390)..(390): n is a, c, g, or t
  misc_feature (425)..(425): n is a, c, g, or t
  misc_feature (440)..(440): n is a, c, g, or t
  misc_feature (450)..(450): n is a, c, g, or t
  misc_feature (506)..(506): n is a, c, g, or t
  misc_feature (588)..(588): n is a, c, g, or t
  misc_feature (625)..(626): n is a, c, g, or t
  misc_feature (628)..(628): n is a, c, g, or t
  misc_feature (643)..(643): n is a, c, g, or t
  misc_feature (653)..(653): n is a, c, g, or t
  misc_feature (823)..(823): n is a, c, g, or t
nttatatgtcttctgaaatacaaaagatagaataaatcatagcataaaagggaataagatatgataacatcatgatggccaattaatacacataaatcgnctttttctggacagacaccaaattacttaagaggattaagagataacttcagangcngcacnacccgnnngattattnnnnatttaaatactgatttccaaagnnctagatgnngaggtngaagnnagggtttggnggggcaggggcatggatctcagcngggacngaggggggggganggggactggggcnggngggggggggtgngccnnntcnagcngcncancgggganggncttggncaaaatctctagagggggggcttggggtngggggggggggggataggngggggcggttgggcatctgggggggggatcctatnggggctgggtggggngggggattgngtttcttacatgcagaacatggggtttttctatttgggtccatcaactcccaagcntttcaggcccacggaggtgagagttccttcaatgctgacaggtttgctatttctaacctatcatcgacagccttcaaggggncccgtcgaggcatcaaaactgctgtctgtgtctaaannancgtctgctcagtggncatgggtganatgtcattgatcgatgaagactgagaaggagtggcgttgctacttactgctgcatctgaaggctgatcttttacaacaccattcttgcttctttcttcccaatccatgacttctttgtaaattagctctttccattcttcaattgcatgttctctttcttccaactgggnatca

SEQ ID NO: 725978 - DNA, 202 bp, Homo sapiens
gatgcctgagaagtacatcctgcagggtgtcttctcagcttagaaggcaactaatgaccacattaaaaagggagcatttcataatatatataccttaaattggcctgggtaccctaaggtgttcgcgttgatcgaaaattgacaccccaaactaagtgtcctacttagcttctacaatagttaattcctaagaccctcagat

SEQ ID NO: 725979 - DNA, 892 bp, Homo sapiens
ggacgcgtgggtctgaccacgcgtcgattctctacatagagcccgacaaagacattggaatcggactataccctattattctggcgcatgagctggagtcctaggcatcaggtctaagcctccttattgcgatgccgagctgggccagcctagggcatactcttactaggtaagcgagcctacatctagcaatcgttatcgtcaatccagccctatgctatttagttaaatgaatcttcattctatagttatagtaccctatcatgaatcggcaggctgttggcgaactgaccttaggttcccctaataatcggtgcccccgatatggcgtgtcctcctgcataaacaacataagcattcttgacatcattaccgtcccttcttcttcactacgtcgcgtgcgtcgcaatctgcttataatgtggagagccagtgagcaggaagcaggttgaacagttctaccgctcccttagcatgggaactagctcctcacccctggagccttccgtagactctaaccatcttgctctcttacaacctagtcaggtgtctcctctatcttaggggccatcaatttcatgcgcaataattatcaatataataaacccctgacatgacccaataccaaagcccctcttggttctgatgcgtctctagatcacagtcaggtccttacttctccttatgctctccgcagttcctatggctgctggcgatcactagtactactaacagagcgaatgttaacaccagcttctttgaccccgcggggacgagaccccattcgatacaagacctattctgatttcgggcacctgaagttatattcttattctaccagggttcggaatattccttttggtattctattcgggaaaaagacctttggtct

SEQ ID NO: 725980 - DNA, 427 bp, Homo sapiens
catgagcaccacgcccagcctcttgacaagttgagtttgagagccctgataattcaattcttagtatgtacctaggagtggaactgcatggcgagatggttattctgttatgacattttgagcggactgccaaactttatccatagcggcggcattttatattccttgcagcaatgtatgagagctcacatatttctctgtcctttcagctgggattttatgagatgctgagtctttctggttctttactttctataaagttagagatgaattttcactcttgtcgcccaggctgcagtgcaatggaaccatctcggttcactgcaaaatccacctcccaggttcaaacgtttctcctgcctctgcctcctgatatactgggattacaggaacctgccaccatgcctagcctatttatctgctttca

SEQ ID NO: 725981 - DNA, 372 bp, Homo sapiens
gtaaggctaatatcgtaaagtgacgcgagtagcggtcataaccattgcggatgtatgaagctggttttattgcagagatttgaatacgtctgcgtgcactcagggtagtggactgacttagctcagatactgtagtagaggcatacatagatcacgaggagaccttgaacggcgttgctgattgtgcccaaactggtgatggctatgagtcagctgcaaatcgtgtgagcgtgattcggactctagctgtcggctcatcgtccactgctgcaacactatgcgtgcattatggcgaacagggtgactgcagatcaatagcacgtacctgagccaagctaatgtgttttggggacagctgacagccgacctcct

SEQ ID NO: 725982 - DNA, 192 bp, Homo sapiens
cccctttgaataaaaaggatgttaatgagtgataattattacagagaacttcccaaatgtagagaaagatatcaatattcaagtacaagaagattatagaacatctagcacatttgattcaaagaagactacctcaaggcatttaataattaaactctgaaaggtcaaagataaagaaaggatcctaaaagg

SEQ ID NO: 725983 - DNA, 135 bp, Homo sapiens
ggataggaagtacccggggcgtatgtggggacggggtacttacacggggttggctacgggtactacttgtctgggtcgcctacgacggtctggtgacgaactacgtgttaactgtccttaacggacgacgaccgg

SEQ ID NO: 725984 - DNA, 1374 bp, Homo sapiens
gctatcatcatagtgttggtgcctttctagcaacaggtatttctctcaccgccaaagttttatgaggaaaaagggtgcgcctcgttccacggaaacggcttcttgtaggttcctcttcgggaacggggtagtaaccacacccgttgttttctgttgactagccctgtgggtctcgcctcactaaattttttcccccctaatgatcaccctactcgtggggtgggccccttctgatgacgccttcgaatagctgagtcatttgtggagagacctgaaaatttttttgtccccccacatggggggattggggggaagctccccccatatcctccactgttggggcgactcaacattgtattgatgatcgcgcttggcgctataatacacctctggctgtgggcgcttgtttgtctcccccactggggggagaccttcctctggttcccaaagttggccgccctggtcaaggtgctcttcctactcctcacgctccaactgtgggaggctccttttggggaagacttttttgtgggcgaaacaattggggggggatatggtagaggtccccgccttccatcatggtccacgcaacaccctggcttgtctcgtctcgtggaaagttgtgggaaactccccacacatgcatatgcccacaatgcgtaggctcttaatgtgtaatcccctcctcccaccgtgtctgcttggctccccgctcacagggaggtcactcacattgcacagagtgtgccccctctttcactgttcacataggccacactgtgggagttgcggccgggtctctgatagtgaacaccgcggcgcaacaggccaacagtgtgcacactggtctgcacagtgtcaccggtgtccacacgcggggggggaacgaggcccctgcgggtgtttctcggctctgagagtaagtgtgtggagagcctccacttgggcgtcttgtctctcccacacagcttttggaaaactctgttgttttgagaaagattacacaccacagaagggagaaaggggaagagagccaccctcggtgaacttttgtgccacaccctgcctcactctctctcgtgttctgagaatgtccacttccccctctcacagctttaaggggaatagcaccctctggtgtccctcttcctttctcacacttttgcacatgtttttactcgagtcacttcgaataatgctaaccgctttctcacgctcctcgaggccctctggaagaaggaagggactgtaaacgccttcacagtcacgcttcttctggggatgaaaactcttaaaatgctttgtatattttttccattagatctcttcttcagaagtgtctatagaacccctctgaaatcttttaacttctga

SEQ ID NO: 725985 - DNA, 187 bp, Homo sapiens
  misc_feature (138)..(138): n is a, c, g, or t
aagtggtgcacgcatcagtggtacagcttactcttcacagtcagcaagctttccagggatgtcattttttgtattcctgtgtgttttatctagaaagattcaagaagaatattacagagtgttcaaaatgtccccggnttgtttggggatgtttacaggtaaacatagacgaactggtggataatta

SEQ ID NO: 725986 - DNA, 298 bp, Homo sapiens
gcgggattcttcgctcacatcctgtgtcttccccacgcggcttctgtgttcctccctctgctttcctctggcctccttgtcctcttgctgacttccttcttcctctaaccccgccacgactcaaccctggggtcggggcacagtggggaaggggcctatccacctgctcttcctagtccttggcacagctggcctaaggtgggcagaactaataaggaagggaactggttaaggaagtctgcacttgctttgaacttccctctccttggttaataaaccaccaaagcttgtttttcca

SEQ ID NO: 725987 - DNA, 733 bp, Homo sapiens
  misc_feature (271)..(272): n is a, c, g, or t
  misc_feature (274)..(274): n is a, c, g, or t
  misc_feature (276)..(277): n is a, c, g, or t
  misc_feature (280)..(281): n is a, c, g, or t
  misc_feature (692)..(692): n is a, c, g, or t
acaaaaagcaaagaccccttctccatctctggattttaaaaactggaaaaggatgctgagaggattgagccaaagagccagtcctgggacagtcactgtggccagctagtggtgtgctttgtctggccacgctgggtcctgctgctcgctccaaaggggcaacatacttgatttgcagccctggcagaatcatatgattaaagtgtgggagggcggtggtgagggaagtatctccccaaaggaaagaaggggtatggaacaggtaaaattnncngnngtnnacaaaattgtcttaattattttccccaaaatgcatagccagttttcccaatcctagtttttctctatttacttaaaatgccatctttattatatatcatatagtaaattatctgtcttttcatttgccagtgccacagtgtcttcatttttttaaagctttaaattaaaaaggaaaaatcagagcttattcaactatctggtcaatggaaatttaacagtgatgcagtagttttagaatgtatacaaatttttccagcctgggcaatatggcgaaaccccatctctgcagaaaatacaaaaaattagtcaggtgtgctggtgcatgcctgtggttccagctacttggaaggctgagatgggagaatcacctgagcctgggggttgaggctgaggtgaactgagattgtgcnactgcactccaacctgagcaacagaatgagacctttctcaa

SEQ ID NO: 725988 - DNA, 675 bp, Homo sapiens
  misc_feature (271)..(272): n is a, c, g, or t
  misc_feature (274)..(274): n is a, c, g, or t
  misc_feature (276)..(277): n is a, c, g, or t
  misc_feature (280)..(281): n is a, c, g, or t
  misc_feature (634)..(634): n is a, c, g, or t
acaaaaagcaaagaccccttctccatctctggattttaaaaactggaaaaggatgctgagaggattgagccaaagagccagtcctgggacagtcactgtggccagctagtggtgtgctttgtctggccacgctgggtcctgctgctcgctccaaaggggcaacatacttgatttgcagccctggcagaatcatatgattaaagtgtgggagggcggtggtgagggaagtatctccccaaaggaaagaaggggtatggaacaggtaaaattnncngnngtnnacaaaattgtcttaattattttccccaaaatgcatagccagttttcccaatcctagtttttctctatttacttaaaatgccatctttattatatatcatatagtaaattatctgtcttttcatttgccagtgccacagtgtcttcatttttttaaagctttaaattaaaaaggaaaaatcagagcttattcaactatctggtcaatggaaatttaacagtgatgcagtagttttagaatgtatacaaatttttccagcctgggcaatatggcgaaaccccatctctgcagaaaatacaaaaggagaatcacctgagcctgggggttgaggctgaggtgaactgagattgtgcnactgcactccaacctgagcaacagaatgagacctttctcaa

SEQ ID NO: 725989 - DNA, 297 bp, Homo sapiens
ctagaggatcccctgtacatctatgcatgtcaaaactttgacatcttcttttcattttccactttcttcttaactttacttctctttttgtccccccccaccatcttacagaagttgaggccaagggagactggtcggcacctgaagaaacatggcaaactgccctgtgcttacaaaccaaagtgttccccccaaccccaaatttgtctaagcactggccagtcttgtagagggcatagtttactacaacccaattctgggttttttgcttcttactttaaaaatagatggtaccag

SEQ ID NO: 725990 - DNA, 752 bp, Homo sapiens
atgcggagattgtgtgtgcctgccccacccagcctgacaaggtgccccggggacaggacgggcatggcattgtgtggaccccgggagctagaagaggcctctccctgctgatctgagtgaagagcgtgggagtttagtccagcgggcagggctgcattttggggtactaatagcacacaaatgcctgggttagcaggttgcacagtcaggtattttacttctgtgtttgtgtctggagcaaaccctgacatctcagtttcttcattggcttggggtggtactgggtccccaaagcatctctcattttataagtatccctcttataatattagagagggcaaaaagaacataagcataagagcatccccagcagacgatgttcattcagtgcctctgaacggctggagggctgcttgttgctgggtgagactcggaggggaaccgactcagggtcacggaactgatgacatcccacggtgggtccacagtgaagaatcttaccccgctccactgtgggacgccttaacagaccttacttacacttacgctttcgcgttatctcctgacaacaatacacatggagaccacaaattccttcttcggtctagaggaatgacaccaactcatttatgcaccttgaccccgctgggactcagaagagaccaggacggtttctgcgggaagcagtaggcacactcgtgtgctttgtctcatcctctgacttgttttcccacatttttaacaacgagcaa

SEQ ID NO: 725991 - DNA, 560 bp, Homo sapiens
ggaacaaaacacagtgtgcctttgaaaatgaaggttgaggctgggcacagtgattcacgcctgtagcctgtagtcccagaacttttaagaggctgaggtggggaggatgcttgaggccaggaggtcaagaccaacctgggcaacatagcaagaccccttctccacacaaaattaaaaaaaataataataggctgggcgtggtggctcatgcttgtaatcccagtactttgagaggccgaggcaggtggatcacttgaggtcaggagttcaagaccagcctggctgagcatggtggctcacgcctgtaatcccagcactttgggaggccaagacaggcggatcatgaggtcaggagatcgagaccatcctggctaacacggtgaaaccccatctctactaaaaatacaaaaaattagccgggcgtggtggcgggcgcctgtagtcccagctacacaggaggctgaggcaggagaatggcgtgaacccgggaggtggagcttgcagtgagccgagatcgcgccactgactccagcctgggcgacagagcgagactctgtctc

SEQ ID NO: 725992 - DNA, 222 bp, Homo sapiens
  misc_feature (48)..(48): n is a, c, g, or t
  misc_feature (215)..(215): n is a, c, g, or t
tgtgctgcggtcgtctagaggatccggaaaatcacttaacaatcactnacatcacttaacaatcacttaacaatcacttaacaatcacttaacaatcacttaacaatcacttaacaatcacttaacaatcacttaacaatcacttaacaatcacttaacaatcacttaacaatcacttaacaatcacttgaatgtgaagtgatgtgttccccgcnagcgggg

SEQ ID NO: 725993 - DNA, 352 bp, Homo sapiens
  misc_feature (217)..(217): n is a, c, g, or t
aggccaggagtttgagaccagcatgaccaacatgtcgacaccccgtctctgctaaaaatacaaaaactagccaggcatggtggtgtgtgcctgtaattctagctacttgggaggctaaagcatgagagtcacttgaacccgggaggcagaggttgcagtgagccgagatggcgccattgcactccagcctgggcaacaaagtgagactctgtctcanaaaaaaaaaaaaaaaaaaaaaaaaggggttttttcccaatttccccgggggggggggacccccaaaccccccgggttttccttttggggcccttttagggccaaaattacctttgtgggggggaatggccccctg

SEQ ID NO: 725994 - DNA, 1292 bp, Homo sapiens
  misc_feature (71)..(71): n is a, c, g, or t
  misc_feature (191)..(191): n is a, c, g, or t
  misc_feature (522)..(522): n is a, c, g, or t
  misc_feature (526)..(526): n is a, c, g, or t
  misc_feature (627)..(627): n is a, c, g, or t
  misc_feature (830)..(830): n is a, c, g, or t
ggcccgcctgatgtctgtcccacgccgtgccggctctcaggcgccggaagtgagctgcgcagcgccgttgnagcggcggacgcaggaggcgctcgtggaggacacagcagcatgggacagtcaggtaggtcccggcaccagaagcgcgcccgcgcccaggcgcagctccgcaacctcgaggcctatgccgngaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccanccanccctcctggtactcaacagctttggcccccatggtatgcatgtgaagctcatggccaccatgttccagaacctgttcccctccatcaacgtgcaccaaggntgaacctgaacaccatcaagcgctgcctcctcatcgactacaaccccgactcccaggagctggacttccgccactatagcatcaaagttgttcctgtgggcgcgagtcgcgggatgaagaagctgctcccaggagaagttccccaacatgagccgctgcaggacatcagcgagctgctggtcacgggcgcggggctgtcgganagcgaggcagagcctgacggcgaccacaacatcacagagctgcctcaaggtctgtcgctggccgtggcaaagcatgctggtgcccagtctgagttgcagtgcggctcaccgagatcggccctgcggatgacactgcagctcatcaaggtccaggagggcgtctgggcagggccccctgatgttccacagttttgtgcagcaagacggagcgaggagctgcaggcccctcctggaagtcctggagtaagaagctgcggctgaagcgcacaggcggcccgcaggcccgaaatgttcatcgcaagcaagagcagcgggatgccccgaatgaagagcctggagggctgaagaaggccggccgggtatgaaaagaggcctccgtgaccctccggcgggactgtgttgccttccgggcaagagaaaggtgccctccggggaagcgagccgggaaaatcccgcgggcct

SEQ ID NO: 725995 - DNA, 474 bp, Homo sapiens
cgttaaaatcattcagtgagtagttcacagactgaggtgatcttctgaggtgatcttctgattcatcgccgcgcattaaccacaatgtatatgcgcaaaataggtgccgcaatcgcttgcgccgtcgcacccaggccaacccaccctctttcacttgaattctgccggtggatatgaactcattggcggcgagttgcctttacacaacaacagccggaggaaaatatggacgcggaaacgaagaagcgctcggtggagctgacggttggcggcaagctgcgcagcttcgatatagacgatccggttcttcccgactgggtggaggaaaacaagctttccgccggtgattttccttacgacaaaaagatgaagcgcggggaatacgacgccgccctcgaagcgctgcaggtggagctggtcaaggtgcagttctggctgcaggcaaccggcaaacgggtgatggccgtgttcgag

SEQ ID NO: 725996 - DNA, 1312 bp, Homo sapiens
  misc_feature (71)..(71): n is a, c, g, or t
  misc_feature (191)..(191): n is a, c, g, or t
  misc_feature (647)..(647): n is a, c, g, or t
  misc_feature (850)..(850): n is a, c, g, or t
ggcccgcctgatgtctgtcccacgccgtgccggctctcaggcgccggaagtgagctgcgcagcgccgttgnagcggcggacgcaggaggcgctcgtggaggacacagcagcatgggacagtcaggtaggtcccggcaccagaagcgcgcccgcgcccaggcgcagctccgcaacctcgaggcctatgccgngaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccagaagcgcgcccgcgcccaggcgcagctccgcaacctcgaggcctatgccgcgaacccgcactcaacagctttggcccccatggtatgcatgtgaagctcatggccaccatgttccagaacctgttcccctccatcaacgtgcaccaaggntgaacctgaacaccatcaagcgctgcctcctcatcgactacaaccccgactcccaggagctggacttccgccactatagcatcaaagttgttcctgtgggcgcgagtcgcgggatgaagaagctgctcccaggagaagttccccaacatgagccgctgcaggacatcagcgagctgctggtcacgggcgcggggctgtcgganagcgaggcagagcctgacggcgaccacaacatcacagagctgcctcaaggtctgtcgctggccgtggcaaagcatgctggtgcccagtctgagttgcagtgcggctcaccgagatcggccctgcggatgacactgcagctcatcaaggtccaggagggcgtctgggcagggccccctgatgttccacagttttgtgcagcaagacggagcgaggagctgcaggcccctcctggaagtcctggagtaagaagctgcggctgaagcgcacaggcggcccgcaggcccgaaatgttcatcgcaagcaagagcagcgggatgccccgaatgaagagcctggagggctgaagaaggccggccgggtatgaaaagaggcctccgtgaccctccggcgggactgtgttgccttccgggcaagagaaaggtgccctccggggaagcgagccgggaaaatcccgcgggcct

SEQ ID NO: 725997 - DNA, 407 bp, Homo sapiens
atggaaatgtttcaacgtgcgcaagcagttgcggcggcgggcagaggcctactacagatgcacactcacccttctgcaagcaagcctctttgcacccggtgcacttcaccatttggtcttacctgggagtgaaaagcacatcttacagccatgcctaactgccttcttgcggtcagactggcggcagaggagcatcgtcgattcttcaggattgccctacgggacctagctcacagatgacactttacaaaacccaggctgggccaccagccacctcctccaaatcaaaaacattctatacttgctcactccctgagcctcaagacaccttccgagtgtgtgctctatccccttccaccctcagcggatgatactctcgagacacctcccgagtgtctgctccctcc

SEQ ID NO: 725998 - DNA, 251 bp, Homo sapiens
ccagaggcaccaaggaggcggaggatgcagtgagctgagatcgtgccattgcattccagactgagcagcaagagcaaaactccaccttaaaagaaaaaaaaaaaaaaaaaaaaccaaccaaacctccgaaattcccctggggaaccctttttttggggggccttttaaaaggagggcaaagttttcccaaaaattatagggccggaaaaccgctaagttttaattcaaggaaaaacattccaaaaaaaact

SEQ ID NO: 725999 - DNA, 263 bp, Homo sapiens
ggcaacgcccctcttatctgttagtagtatagtgatgcagcagctaggactgtgcgagataggagaatgtaggactgctgtgattaggacggaatcaagacgaaagaggggcgtatggtatttgggttatgggcagggggttttatatttgataatttgttgttgattgaaatttgatgggcccttatgatagaggggacaacctgctagtgtgtaacgggagacaggtgggttaggtctacgtgaggctccagggatgggat

SEQ ID NO: 726000 - DNA, 241 bp, Homo sapiens
gcacaacgtcagagttagttacatatgtatacatgtgccatgttggtgtgctgcacccattaactcgtcatttaacattaggtgtatctccacttcttacgggagttcttaggggaattctggcacattttgctgggagttgaggttagtacgacttttaaatgtctttacttctcataactctcacagttacttcagagcaaccacagatagtgcaacagggtatcaagtaagagaaata

SEQ ID NO: 726001 - DNA, 733 bp, Homo sapiens
  misc_feature (417)..(417): n is a, c, g, or t
tttttctgtgggcgaggggcggccggtctcttcaactaagctccatgagggcgcaaataactggccctcaagcggtcgggcgacagctgcggcttagcgctttgtcatccacaaatccactggcagcacatcgctctccgcgtcactaaaaactttttttggggggctcgattcttgcgcccacccctgaataagcgccccccaaggctgttcccgttgacgtatttcaacaattacatacggttctccgcattaagcgcctaatggcaaaagttgtgtgaaaacatcaaatctaataccccactgtacagactatccagaacgtccacggcctcggcctttagagggtgaaggaagacaacccacacacagctagacccgaaaaaagaaggcctattcgttttagggcagtttgcnaaataactattccaaacacgggaacaaggccgtatcaaccacaccgtcctgaacaaatgggaaaaaattagacccccattacttttaacgccgaattctcagaatagttgggagttaattaactccatcccccaaggcaggggtactaagtgaaatattcctcattcttttcaattatagcacgccaccacaaacctcaaaacatattaacgcctagaaattcaaagtgacccaattgctttcacttttgattaagagacccaagtgaaagaactaatggtgtttcctcttggagacaagggctttacaaatctgg

SEQ ID NO: 726002 - DNA, 814 bp, Homo sapiens
agcgggggactcagaggctgggatcagtggtatatggaaccctccttttagtcctctcggatgccctgggccctgacccagacctggtggggctcccactccttgaagtatttccacacttccgtgtcccggcccggccgtggcggagccccgcttcatctctgtgggcttacgtggacgcaacgacaaccatagttcgttgcgcttcggacattacagtacgccgactggagatccgaggatggatgacgcagggcagcacagagggatggcatccaatggagggcgtcgagaataatcgggggatcgggtagcatcactggagcgccagcggtacaccgatacaggatttctccggagtggaatcgtgcgcgcaagcttgcgcggatacttacaactccagatgcgatggccgggtcgtcatgacccttgactaggggatgcaatggatgcgtagtctggggaccgtagagggcgcgtcctccgcggtgttatgataacatgttcgaactaacgcagggtccatggagttatcatcacccctggagattgaaggacctagcggctaccggagcaccagcaggtggagcaccggcgggtcagattctctcgcagcataagatgtcacaatgatagccttctgaaggcgggaggcaccagagaaagctgacctggaaaatagacatgcgtggagtgagtcccacaaaatggcgtggcccaaggggcagggaccgccgtttcacctgggtcgccaaggaacccgtgaattaaaaaccccaatttgtgaccgagaggccccccaggtgccggccgg

SEQ ID NO: 726003 - DNA, 423 bp, Homo sapiens
tcttgtggcagacttgaatttacaaaacccttctgatttctatgctgggatagcccttgttagttctatcaggtgtgtgacgggtatattataacttaccctcccatcatgaacattatactgtgtctattcagaactcagccctgctaggagaagtaggatcatgagatttttagacacagaggacgtcctagaaatccttgatgtcagttccatctctggcttcgtggagtgtcttatacctcgcgcgcgtgtgtatggttgaatttggtcccagaagctcttacacctgctggccctctggtctgtgtagctttcccacagtagaggtttgtaccaacgtgagagaagactcacatgcctctggcacagatcctttctgatcttcgggatactgctcctgcccgaaagtctttctgaatc

SEQ ID NO: 726004 - DNA, 121 bp, Homo sapiens
agatgttagaggtgtggagggcggcagaggtttgaacagtgcatgtgagggccactgtccatcacacagagactgctttggtgtgaccgacgttgaggtcccacctgccccactgtccata

SEQ ID NO: 726005 - DNA, 233 bp, Homo sapiens
actctagaggatctgttttctgtctggcttcttgcattctgggactgccaatgtctgtgacttgcacgtactcccctgcctcaacaagatgttttgccaactgccaagacctgcctgtgcagctgtgggttgattccacacccccgcccgttagccgtgtccgcgccatgtccatctacaatcagtcacagcacatgacggacgttgtgacgggctgcgccaaccattgagcg

SEQ ID NO: 726006 - DNA, 725 bp, Homo sapiens
gctcgagcctggcgctttcgcggccaaaatgagttcaaagtgtggggagggttcctcttcccgggacgcagccttcccgggtcattggcagacggtgccccgtcttagacatgagccgctgaccaccccgtgcagcccgatcgtggcgcaggatgccgcctggtccttcgcagtactggttgcgctacttggtatggaagccactcactccggcactcgcgcgcctaacagcttgctggctctaagccggaagaccatgactaggcccgtgcgaccctcgagaccagacgacgtcagcgtggatgtgactccccacgatcgacaccccatggggccatgcgggcaccgcacctgccctgcgcgggcaatcgtacgcctataaacggtctcttgaagatacccctcagcatattccgtagccatatcgaccaatcaacgccacattcatcaaacgcgcaggagcatcgctccatggcgcccaatgttctacaacatcccggcagccgtgaaataacccagtccacaccctttcaggtaatctcaggttccttaccagccggttgcgggatactcccggcgtccgtctccaacaacgtcacccctttagaactccattaggctccacaccaacgaagagctacgcgctgaggctgccctctccagaacggtggctggtggctcttcgggtgcctccaattcaattgctcactgcccagcccgcaatg

SEQ ID NO: 726007 - DNA, 803 bp, Homo sapiens
  misc_feature (803)..(803): n is a, c, g, or t
gtgcctgagctgcaagaaccctgcgcagcccagagcagctgctggagtgggaatctgatggctgcgtgctcctggtggattctggctctgtgtgcctgcatgctgctctgctctgctgtgggatgtgtgatgctggtgccctgccctgctgtgtgtgccctgatgcccgtcctgtgatcctgccccgctcccctgtgtccctgccccctctggagactcctctgtgttttgcatcttggtgtgtgttctagcctgtgagtgcctggtgggaccgcagaagagtccatgagagctgcccaatagctgaggcagctctagcttagaccttgcgttgtcagaggtgcattgctgtgcctctgtcatgtggtcccctgttgcgccctgtagagtgcgaagttcattcgcccatagtgacgcatatcagccacgttaaaagggcacattgcggtacaagagctgatcaaccattgagggttcgagaagtgacgcgcagatagctagagcaccccatggagacccctagtgcacccaaaacccgtagcggaacgaagctgtctttgaggaactttgaccctgagactagcaggaaggggcaagaagcagacccaaaccaagcctggcgaaagcatgcagccggcgcgccgccaaagagtcagggggatcggcgaaccacccccggagccggcggagaagaccggccagcacgaagagaccccagggcgggacccctgggcacgaaacagagcgaccctagagcgggcaaggaaaatatcggcgcagacagcaccatgcagccggtacan

SEQ ID NO: 726008 - DNA, 1117 bp, Homo sapiens
tcagatttacaaatttatttttaaaaaccaaaacaagggttaaaaaagtccttcatttccaaccctgccggggggtgtgggtggggaataaaataagctcaaaaaggtgcctaacctctttcctgcaaaggacacggcaggtcagaggctaggcccttgccctttctgccctgcctcctcctcaggtagctcaaatggctgctaggaagtatttataggcaaagaagtgtggccagtgggaggccaagagctgccttcttcacatcaacagaaactccagctgtactttccccttaaggaagttctctgagcctcaccatctgggactcccagggtggcgcggacaggcatggccaggaggctcagccctcgggggctatgtggctacagaccaccgaagtttcctaaaggctcttggtgacccaggagggcggtcagggggaactctcacagtgcgggaaggggtgtctgggacaaggaactctctgaaagccgccgtctactttcctagaccttgcttctagcgctgaggttagccatatctgggatattccccaatcctgaggctcgactgagagtcccaggacaaacgccctaaggtggctgttggctacaaacacaccttggaagatgccacaaaagatacgcccttggccatatctgttacggccaggttcccaacaaagtcacagcagtcatacaccaccagcgttaagggccttcttggtccccagcgggccacgcccccgttttgggcccccagtttcttattctctcacccctgtcagaagcgtgataggggggaacacacaccctggtttggcctgcacacacaggtctaatgggcgaagagcgctgacaacggaagaatttttaccagcggctggaaaacacacgctgacggcacagcaacggcagggagctataagggccccacaccagggcgtatggaattgcccgtgaaagaaccccaagtacggtgggcagcgcagagagaattaaccccggtaaaatgtggagccacacagcacgacaagcgaggggcaaaatattggccctagataagaccacgcccgccaattcagaaaaccccgcgtggtgaccacgacctcggccc

SEQ ID NO: 726009 - DNA, 881 bp, Homo sapiens
  misc_feature (26)..(26): n is a, c, g, or t
  misc_feature (90)..(90): n is a, c, g, or t
  misc_feature (110)..(110): n is a, c, g, or t
  misc_feature (193)..(193): n is a, c, g, or t
  misc_feature (256)..(256): n is a, c, g, or t
  misc_feature (289)..(289): n is a, c, g, or t
  misc_feature (320)..(320): n is a, c, g, or t
  misc_feature (325)..(325): n is a, c, g, or t
  misc_feature (447)..(447): n is a, c, g, or t
  misc_feature (451)..(451): n is a, c, g, or t
  misc_feature (510)..(510): n is a, c, g, or t
  misc_feature (569)..(569): n is a, c, g, or t
  misc_feature (598)..(598): n is a, c, g, or t
  misc_feature (614)..(614): n is a, c, g, or t
  misc_feature (625)..(625): n is a, c, g, or t
  misc_feature (723)..(723): n is a, c, g, or t
  misc_feature (729)..(729): n is a, c, g, or t
  misc_feature (738)..(738): n is a, c, g, or t
  misc_feature (740)..(740): n is a, c, g, or t
  misc_feature (744)..(744): n is a, c, g, or t
  misc_feature (751)..(751): n is a, c, g, or t
  misc_feature (764)..(764): n is a, c, g, or t
  misc_feature (801)..(801): n is a, c, g, or t
  misc_feature (845)..(845): n is a, c, g, or t
ccacctccttcttttttttttttganaaggagttttgctcttgtggctcaggatggagtccaatgacgtgatcccagcccactgcaaccnctgcctcctgggttcaagtnattttcctgcctaagcctcctgagtagctgggactataggcgtgtgcaaacatgcctggctaatttttgtatttttagtaganacgaggttcctccatgttggtcaggctggtctaaaactcctgacctcaggtgaaccgcctgcnttaaaaaaaaagtggtgggattacaggcatganccaccacgcccggcaggagacccagcctctnaagcntaaaactcaaatccgaagtactgtgggttgaagtaatggataaggacgtaaccatctccgccgccgctgccgttgcccttgccaacaggatggaaggaaacaatgttgaaaggcccaaagtnaccnttgactttcccaaactcttctccaaaggccaaaaggaagaacctggcctcaaacttgcnaatcctgggggaggttgtggttacatccatggcttcctgaccaccgcccaggaccacanggtcatagttgggggagagggcagctganttgacaggacgttctnttcggaaagtnttctgatgttcaagagttgtggagttaaaaagcttggctgttttgttcttggacgcggtcacaaacatggtcatgtccctggataactggatgtcgtngaactnccgggagtncncctnaacattnaccaacacctctncagatttggcactatactggttgagccctccactctnatggccagcgatgatgcactccccaggggtcccaaacagcactngtgattttagagttattgcaagggatctcatgtggg

SEQ ID NO: 726010 - DNA, 711 bp, Homo sapiens
cgcggctagagtgatgacagatggatcacagccgagatctaccagagtcaaggaggaattggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcagtaaaatactagcaaaccgaatccagcagcacatcaaaaagcttatccaccatgatcaagtgggcttcgtccctgggatgcaaggctgattcaatatacgcaaatcaataaatgtaatccagcatataaacagaaccaaagacaaaaaccacatgattatctcaatagatgcagaaaaggcctttgacagaattcaacaacccttcatgctaaaaactctcaataaattaggtattgatgggacgtatctcaaaataataagagctatctatgacaaaccgacagccaatatcatactgaatgggcaaaaactggaagcattccctttgaaaactggcataagatagggatgccctctctcatcactcctattcaacatagtgttggaagttcttgccaaggcaattagacaggagaaggaaataaagggcccaaagtttttttttaaaggtctatctaccattaatgaaaatcaccagcaata

SEQ ID NO: 726011 - DNA, 236 bp, Homo sapiens
tcagcttacactacagcccagtgggtaccaggcaggctccctttcctggggaaatgaagcacccagaccccgcgcccgctgatctttgcttcagatccttgaatcacctgtgggacttgaggactcgggatctacaggacgcctggagaagggtggtttcctgccacccttgctggccaacggaggcatcatggaggtgcggatcagccagggggaattttgacactagccattcg

SEQ ID NO: 726012 - DNA, 131 bp, Homo sapiens
gccagattccaggtactaggcgctgtggttaagggtctgtacctcgcattacatgctgttgtgaactctgcttcctccggagtactttcagctggcttaaacttcaggggtacttggtggcgctcgtgcct

SEQ ID NO: 726013 - DNA, 868 bp, Homo sapiens
ggattggcctgcgctaggctcgcactccggactgcgcctcgcagtgcgctgggtgcggtgcccctgtgcctgcagcgtcctgccggggcggcgcggcgcggagtgtggcctgacaggctccgggcctcagcagcctacagcccccggcccagcgcgcttatcctgacaggcaggcgccgcagccgaagccaccctgcccgaccaaggtctctcgcttggcgggagaacggaaaactcccagcttcctgagttctacagttcctgttgcttcagacaatggatgagcaatcacaaggcaatgcaagggccacctgttcctcagttccaaccacagacggccttacgaccggatactgggctatactacattagccaacttctcgaatacacccagaaccattggtcgcggacaatccagctgaagctcactcgacgcagccctgctctcttgcgatgcgagctacccagcatagcctacacaccacaccgcctgcaccactactgggactcccactgcgactgccacaaggcccgctgactgcacttgcattcacaccccacacctcacatcctttctttaccccccacctccaaccccattcccacactgtacctcacaccatctttactgccattcatcccacttgcacacactccatgaccctaaacacactcacctacccggacgaaaccctacggcacagcactaggccatggcgcggaacacccttattcccacgccaccctgcattccaacgcacacttctctcaccgccacaccccaacaaacgacgggccctaaggtctccctagagcacctaaacctggatctcgggcaccgctaatttccacgtaccaagcaatcatg

SEQ ID NO: 726014 - DNA, 283 bp, Homo sapiens
aataggcaaccgaatggaccaccattttatagttgagttcaggcgcacgcattgaaagaacagcagtgagaacaagagaggggtaagacgccaccgcactgcttgtgaacgtgctaagcgtaccctctcttccagcacccaggccagtattgagatcgatactctctatgaaggaagcgacttctatacctgcattacccgagcacgatttgaagaactgaatgctgacctgttccgtgacaccctggacccagtagagaaagccctacgagatgccaaacta

SEQ ID NO: 726015 - DNA, 245 bp, Homo sapiens
ccccgttcaaccctggggttagtatagcttagtttaaactattcagtctattcgctcattcgttaattcactgctgtttcccgtgggggtgtggctaggcataagcgttcttgagctgcattgctgcgtgcttaatgcttgtcccttttgatcgtggtgatttagagggtgaactcactgtaacgggtgatcttgcatgtagtattcttactaagagctaatacaaaggctaggaccaaacgggc

SEQ ID NO: 726016 - DNA, 195 bp, Homo sapiens
  misc_feature (192)..(192): n is a, c, g, or t
  misc_feature (194)..(194): n is a, c, g, or t
cccttgggtttggggggttcccctttgggttttgtccgggaaaaggccctccctaaagtttttcccccccccacccccctggcctttgccccccaaaccattttttaggttttaaaagaaaaacaaaaaaaaatgggggttttttgagaaaaagaaaatttttaaaaatttaaacaaattttttttgagaantna

SEQ ID NO: 726017 - DNA, 177 bp, Homo sapiens
cacgtcatacagggcgcgccatgtcgtgcggtatgtggattcgtcccggccaatggcagcggcgcgcttgcgatcactggcgggaaccgcaccactccccccgcacgccgttgcacagccttcagccatacgcccgctacacagagcgttcccacccgatccactgcacagacatgg

SEQ ID NO: 726018 - DNA, 289 bp, Homo sapiens
ggctgtgctcttagaggatcccttttgcggtgcttttcccaaccattccttcatgataataaccctcaaaaaactgggaatagaaggaagatacctcaatacatttaagaaccacatacaacagacccacaggtattatcatactaaatgggaaaaaaaactgaaagcttttcctctgagatctggaaaatgacaaggaggtccactttcaccaccgttattcaacatactactggaattactggctagagcaatcagacaagagaaggatataaagggcaccgcaaaa

SEQ ID NO: 726019 - DNA, 85 bp, Homo sapiens
ggggacggggggggggggaatttttttttggggtttttttaaaccctttggggtttaaagcccaaaaggggcccttttcccagga

SEQ ID NO: 726020 - DNA, 1021 bp, Homo sapiens
gggtaatgaagtatttcagtttagtgaatagatgacctgtttattacgttcctctacctctgaaattcgttatgtaatatgtagagttcggatgtgtaacttgacggcgtgcgggggcgatgtgtgttcagtgatttgattctcttcgtaggagtcgtggagggcgaaatatattgttattcagtgtcatttattccacttagagtctgtcctagaatcctacaaggcaaatgactcatggtgtgaagcagataaaactaagtagagaatgccattcatcaggataaattcagagccaccagaggttttacaagtattatagatactctagagctcagttctccaccggttggaggtactggtggaaagagatggtatcatttggagcaaatggtaggatacgtttacctccttcgtgttaccccactccatcccctgctttagatcagtaactttgtacaacaagtgctttaaaccgcccttaagatctctggtcacgttggtagtgacctttggaaagccatttcttggagggagtggctctttaaaacaggggcaagagtagacggggtcggggggatggacccaagtggtttttggtgggctaaaaagactttatgttccaacaggatagtctaagtaaggtagctaatgtgtaccaaacggtgggggtttacggaagaagtggaagttgtaacccgcttgatggccttgtttgggtatcgaaactaaggcttttctagggtaactgggggaggcttggcttttatattcctttgggaaaggaaggttattatcgcccaggttggagaaagcttgggaaaaatgctaaacaggaaaccagtggtaaggaatatggggttcactaattccaggtctaatatccagaggagaaactttccagtaagatactttgaagtaggggcacagatggttgtggcagttaaaggtttcttcccaattaactgtgtggaatatggtaaataggttctatattaaacggggagggggcacaataatg

SEQ ID NO: 726021 - DNA, 334 bp, Homo sapiens
aggggatttggcccccgggccccaaaatttgggcccagggggccttaaaaactgctccttatgggtgggatcgatggctggtcccccccggccgggggtgccctgcccccctgggcaaatttgcccaggcccccctttatgcccttttttaaacccacagctaccttaccccccccctttggaaggaggctggtttcccccagtttccccatccggggttccctggccccctcgtccaaacccccccccaagtttccgtgcaacgggctccgggtccccctgtgggttccacctaggggtttttttccaaaaaaataaagtgaatttagggtga

SEQ ID NO: 726022 - DNA, 577 bp, Homo sapiens
  misc_feature (64)..(64): n is a, c, g, or t
  misc_feature (144)..(144): n is a, c, g, or t
  misc_feature (181)..(181): n is a, c, g, or t
  misc_feature (226)..(226): n is a, c, g, or t
  misc_feature (449)..(449): n is a, c, g, or t
  misc_feature (500)..(500): n is a, c, g, or t
gatctaaggatccccacggggatttggtgcaataaatggaagccttaaaacatttcattttttntataaaagaaactcattagtttacttaataaagacagtaaaatagcagcaagtaccaagacatggtgcatttcttttatntaagacaagttacttcatttacatcagagtaagaaangtaaggactggctttcttgaatacttaaatatagctcgaatcacnggtaagatatggacatatctccccaacggtacatcagggaggagtgctttcattagttacagaaaatgcagaccctcagacagccagcatgaccacaacattgagcaataagagaaatgaagcatttactttccaagcattggccacagaaggtaagggagtcttaacatggggggtggtctctcccctccataagtgaagggtggtgcttggtggaggcatntcagagaaattattgggcatgccactagtgatactgagggtcaggggtgtnggggatgattgagtcgagctagtgaggcttgtgtaggtgaccatcccatctgtggagatgaatagtaagagttgcag

SEQ ID NO: 726023 - DNA, 360 bp, Homo sapiens
gctcgactcacttattaaatggatatagatataatgattcttctgtgaccacttccgttctatataccatattaactttagtgtgtgatgactagtaatggttagtagagtgttaactttaagcaactggatagtttaacaagtgagattcacaatctactcaaattctcaaattcacttcaatacctaaattattccagacctaaattatttatttcatttgatgtggtttaattaaagatatggaaacttgaaggaagaaaactgctgattttgactctgaggtccttattacaactcttcccaagcttggtattaagtatcaattatcagctgccaaatgtctctagatataagcac

SEQ ID NO: 726024 - DNA, 105 bp, Homo sapiens
cagcttcgaaaagtattggggattacagtagttagccatcgtgcctcgccttttaaattttagaactttagggctacctgaaagttgcagagctagatcccccta

SEQ ID NO: 726025 - DNA, 106 bp, Homo sapiens
gaaaaaaaaagtgaactagaaaatgtggtctctgatcttaactgatttataaccttaatgagatggcaaccacaagacaatgtgaacaagtgcaaagtatttcacc

SEQ ID NO: 726026 - DNA, 1111 bp, Homo sapiens
gcccgacaggccggggttactgtggcgaccacgaggagcagctttggctgctatggaggagcccggggttaccccgtcaaccgtatttggggctgctcctggaggagctacgcagggttgtggcagcactgcctgaaggttaggatgtcggctttagtgtgggacgagagaaaaagcttgctctaatgctttctggactaattgagagaaaaaagtaaactacttgaaaaattgagccttgttcaagaagagagtatgaatggctatgaagtagagtcgatctttaaaggatgccagctttgagaaggaggcaacagaagcacaagagtttggaggtagaacatcaaatggcaagctgtgaaaagctgaacaggtccaattctgaacgttgaggatgaaatactctgtctagaaaaagagttaaaagaagagaaatccaagcattctgaacaagatgaattgatggcggatatttcaacgaaaggatacagtcgtctagaagatgagtcgataatccctcagatcacaagtagctgaagccaaaatgaccttcaagatctctcacatgacctgacggaacgactggacgatagcactaacaagatgcttttgaatgacacattctcaagttcaggaaaggcagaaacagctttgcagaagctgagtatggacagaacagtgagtggccttaattaaaccaggcaacggtcacctttggacgaactccaaaggtaccatggcacgaacagcgtgctaatctgctcaagaaaggcccatcaagactcgggctggacgctggtacacgtcacaggtggggctgcaacgctgtggaacaccataacggagggtataactgactcaaaaagacacgggacaagtggacaagtggaccgaccaagaataactccaaggatgccgcgagaacgagcaagcgccgagcaagtcatccccgccgccacgcgtgagacacacaatagtcagtccaccagtatgcaaacgaacgcaaagaaaacaatacgggcgaactgcgccagaccaacgacgaacacaacaacgaggagatcaagtgaccacaagaacgatccacagcaccgtgccgaactcggtcacc

SEQ ID NO: 726027 - DNA, 145 bp, Homo sapiens
cgcacctgagagagaagacctcatctggatgccaggcccagtgaattcccataccaaccacagaggccctgttgattgagagttaccccccaggagccgcccccacgctgccacaccaagtggccacacataggggccccacaag

SEQ ID NO: 726028 - DNA, 360 bp, Homo sapiens
  misc_feature (2)..(2): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (59)..(59): n is a, c, g, or t
  misc_feature (80)..(80): n is a, c, g, or t
  misc_feature (91)..(91): n is a, c, g, or t
  misc_feature (96)..(96): n is a, c, g, or t
  misc_feature (101)..(101): n is a, c, g, or t
  misc_feature (105)..(105): n is a, c, g, or t
  misc_feature (108)..(108): n is a, c, g, or t
  misc_feature (131)..(131): n is a, c, g, or t
  misc_feature (135)..(135): n is a, c, g, or t
  misc_feature (188)..(188): n is a, c, g, or t
  misc_feature (199)..(199): n is a, c, g, or t
  misc_feature (211)..(212): n is a, c, g, or t
  misc_feature (224)..(224): n is a, c, g, or t
  misc_feature (228)..(228): n is a, c, g, or t
  misc_feature (264)..(264): n is a, c, g, or t
  misc_feature (271)..(271): n is a, c, g, or t
  misc_feature (288)..(288): n is a, c, g, or t
  misc_feature (300)..(300): n is a, c, g, or t
  misc_feature (319)..(319): n is a, c, g, or t
  misc_feature (338)..(338): n is a, c, g, or t
  misc_feature (353)..(353): n is a, c, g, or t
angctgcagaaccaacgtggtggccgaaccncctncntggataacaagaaaccagactnttatgacttggagagttggcngaatgcaatgnagtgngcaanacanttngaaaaaaatgtgaaccagccacnactngaactgcacaaacttgccactgacaaaaatgacccccatttgtgttaccccantgagacacaanacctgaattagnnggtgaaagccancaangattttggggaccacgtgaccaacttgcgcaatttnggagctncccgaattttgcttggnggaaaacccctntgacaagcacaccttgggngacagttaaaatgaaagcnaagcctttggcaaantccccca

SEQ ID NO: 726029 - DNA, 764 bp, Homo sapiens
  misc_feature (13)..(13): n is a, c, g, or t
  misc_feature (61)..(61): n is a, c, g, or t
  misc_feature (63)..(64): n is a, c, g, or t
  misc_feature (76)..(76): n is a, c, g, or t
  misc_feature (79)..(79): n is a, c, g, or t
  misc_feature (101)..(102): n is a, c, g, or t
  misc_feature (105)..(105): n is a, c, g, or t
  misc_feature (109)..(109): n is a, c, g, or t
  misc_feature (112)..(112): n is a, c, g, or t
  misc_feature (120)..(120): n is a, c, g, or t
  misc_feature (128)..(128): n is a, c, g, or t
  misc_feature (150)..(150): n is a, c, g, or t
  misc_feature (153)..(153): n is a, c, g, or t
  misc_feature (178)..(179): n is a, c, g, or t
  misc_feature (184)..(184): n is a, c, g, or t
  misc_feature (226)..(226): n is a, c, g, or t
  misc_feature (233)..(233): n is a, c, g, or t
  misc_feature (247)..(247): n is a, c, g, or t
  misc_feature (249)..(249): n is a, c, g, or t
  misc_feature (258)..(258): n is a, c, g, or t
  misc_feature (261)..(261): n is a, c, g, or t
  misc_feature (284)..(284): n is a, c, g, or t
  misc_feature (301)..(301): n is a, c, g, or t
  misc_feature (303)..(303): n is a, c, g, or t
  misc_feature (306)..(306): n is a, c, g, or t
  misc_feature (308)..(308): n is a, c, g, or t
  misc_feature (330)..(330): n is a, c, g, or t
  misc_feature (334)..(334): n is a, c, g, or t
  misc_feature (368)..(368): n is a, c, g, or t
  misc_feature (389)..(389): n is a, c, g, or t
  misc_feature (394)..(394): n is a, c, g, or t
  misc_feature (454)..(454): n is a, c, g, or t
  misc_feature (462)..(462): n is a, c, g, or t
  misc_feature (518)..(518): n is a, c, g, or t
  misc_feature (526)..(526): n is a, c, g, or t
  misc_feature (529)..(529): n is a, c, g, or t
  misc_feature (548)..(548): n is a, c, g, or t
  misc_feature (558)..(558): n is a, c, g, or t
  misc_feature (570)..(570): n is a, c, g, or t
  misc_feature (628)..(628): n is a, c, g, or t
  misc_feature (632)..(632): n is a, c, g, or t
  misc_feature (642)..(642): n is a, c, g, or t
  misc_feature (658)..(658): n is a, c, g, or t
  misc_feature (677)..(677): n is a, c, g, or t
  misc_feature (757)..(757): n is a, c, g, or t
taatattccaggncaagatagggggcaggctgggctggttcttcttcaatgggcttttgcngnnaaggaggagagnggncttggctcactatccagggtannccnagcncgnttttcccntggttagnccagggaggagagaggagaggngangggggcagcggggagggaggggagnnaaggnagtgatgctttggggtaagaagttgaggctgaggctgggggnacagggnggagctgcccaggngnagtgaccantgntcagggacagagcgcgcaaagcntgggaagggctgaaggnancanangggtgatagagtgaggaagganaagngggatggatggagaaaaggagctgggggagggcngggctcagggctagccctctncgctntaaatgatgatctgccgaggtcgtccgtagcctgtaatgccggcctgggaggcccctttnttgttgcncatttgaaggccaatgaaatgctttccctcctgcagctggttctttgtaaattccnttttatgntcntgggctttttttataaacnagttgggatntccacggtagtncgccattattcttggtcactgccaagctgcccaaagccattagggtgctctgaactgntggnatgtttttgncttcaaagaggtcaanagtctggaacatgttaatnttgatgaccccatagtcctcagccgccttcaggaactgagccacctgctccatctgcttgaagaccatggagggtgggtnctcgggg

SEQ ID NO: 726030 - DNA, 328 bp, Homo sapiens
agatgatagatagatagatagatagatagatagatagatagatagatatctaccaccaatgtcaaaaataaggttaaagaacacttgtgaggggctaataacctcctccaaaggcatctacatcgtaattcccagaacctgtgaatatgttacctcacttggcaaaaggtacttttaagatgggattaaattacagagatcagcctgcattatatgttttggcccagcgtaagcaaaaaggatccttataaaagggaggtagagaccagaatcagaagagatgtggcaacaggagcagagattggagcgatgtactttgcagatggag

SEQ ID NO: 726031 - DNA, 422 bp, Homo sapiens
gcgtcgaccaccattgcactccagtcttactcttctactcagactggagtgcaatggtgcgacctcggctcactgcaacctccgcctcccagattcaagcgattctcctgcctcagcctccccagtagctggcaccacaggtggcaaccaccacgcccaactaattgtttttgtatttttagtagagacggggtttcaccatgttgcccaggctagtctcaaactcctgacctcaggtgatctgcccgcctcggcctcccaacgcgctgggattacaggtgtgagccaccgtgcccggcctgaactttttgtaaaggcaagtgaagcagtgggagtggagaaggaacaatgacatcagtaactggttgtgatcagctagttgtaaacaccactgcactcggaccagcctatgtgaactgttt

SEQ ID NO: 726032 - DNA, 1269 bp, Homo sapiens
  misc_feature (449)..(449): n is a, c, g, or t
  misc_feature (799)..(799): n is a, c, g, or t
agcgggaaaaagctagtgaaacaagacgatgacaagtcactggccgtctcttaccatgtttgtgtctctctatttctctacccttcacgtgaggttacttgggtactgtgtcacgaactttgcacattattcctcggatcacacaggtcctccactgatactgcttggtgtatcctacgataataaaacctcctgatcattcacgcataaccatgaacgcgattcaccaacgtactgcgttaatagtacatgtgggtccggcgtgtaggcatgtccgaaggcgtaagtaaaggaagcctgaactcaaggcacaatgcctagacacaccgtgcaaaccagcgtcagcacataaggacacaactccgaatgtgaaactagtctgccacgaggtcacaatccagacacgcacttggagtattactcggacccagaacacacgtatacatttntcgcttgtatccacgaccttttctcgcccaaagacggcagaaaatttctgtctgttgatcaacgtgtgtctatccctggcgtagaaaaatgtcgacccaatagtctctgtgaaagattcactggaggatccattgtgtctccctgcacaacgggcttcttacccattgtggcctcgattgcaagatccgacatatacaataaccactttctccggcgccaccgattcctcttcccctttgtgccaatggggcttttggggccaactcttcgaatttaccatgggggattttggagaccaaccgtttgtgtacccgtcggttctcagatacgcgatttgccgctcataggngataggaaacgcgttacacaagaggttcccgttcgtggatccacatactccctttgtgggaatcaggtcggatatgctcacgttttcattcctcccacaaagccacggggataactccgggcattaggtctatataggtggtgggtcacactgggcataatgcctccggttgcaaattggttggagagagtcgggcgaattggtgtataccacatcctacttagtaatatgaaagtccgcctcgtacgaggaatgggtatatacccatattgtggccatctccatatctcttgccccattgagagttaaaggctttccgcaggcaaaacgagatatggagattgactctactgcgtatatgcccaacttatagagttgagatctggtaatgaaacccaattcattacttaaccgcaattgtaaccttgacttagtgccacccatctggttcccattccttcggattgtgg

SEQ ID NO: 726033 - DNA, 385 bp, Homo sapiens
  misc_feature (83)..(83): n is a, c, g, or t
aaagtggctgtggatctgggtgaatcaagtgcagtggttaagtgaatgtgaaagccctaggacatcactatctactactgtanacttataaacactgtatattggcccaggcgcggtggctcatgcctgtaatcccagcactttgggaggccgaggtgggcggatcacgaggtcaggagatcgagaccatcctggccaacatagtgaaaccccatctctactaaaaatacaaaaattagccgggcatggtggcgcatgcctgtaatcccagctacttgggaggcggagggaggagaatcccttgaaccagggagttggaggttgcagtgagctgagattgcgccacagcactctagtctggtgacacagcgagactccatctcaa

SEQ ID NO: 726034 - DNA, 1296 bp, Homo sapiens
ccgtgctgttgttataatgtgcattagtctatctctatactaccttgctcttctcttcgatatgtgtgttgtcgtctgcgcccttggatttagttgccttataaatgctgctgttgtttgcctatgtactctttctttatacgcctatttttccctcttctgtgtcttattttttttgctcttctcttgggataggggtctttttcattcgccgcacttgtttactacttcggaggttttttctctcacttattacctattcttttaattttggttcttcttgccccttccctgttatctccctaggagacgccgtttctccgaagtcacaatgacttggactcaacattatcgggcaaatcccagttctacagagtctcctcttgagataggcccaaagcttctttcccgtgattcctggctttcggttatcttcgtaatgccctgtattgctgtggcctatgcctgctgtctcgaatgcagattgctctttgaacatgtccttttggctcgttcccatatcaatgaatagatgagtgaaaggagttttctttttctctttagtacttacgtatttgggattcctgtgtctacagctctccctctccagatgaatacatcagaatcctgcaactttttgcacagctggtatctgtctggtagtcagtgagaccccttgtcttggtgatccttcactgggtttccaagcagaggagtcaacatgattacaattgccagtagagttgcttgtttggcggtacaagatgagcaagtaaagtaaacacctacagcctcttctacagttctgacatgctatacagtgcgtttaacgctttctaaacgtgtttaccagactgcctgaaggccaagggcgatggcgcacgacagaagcacttatgctttcacggatatttctaaactctcgttagagagcagcctttgaaaatcgcccaattttggttcatgcttatttagacctctctctaccttcttcagggtaatctttgtggcacaaacgatagcatttccaagctttagagttttctgaattcctgcgccttcctgacgtgagccctgagcgatcgttctatagcagttctgtccatgcgtcctgcttggtctctctgtgttctattgttacttgggtgcaatagcaacttccctaccccgtgcattccatcttctcatgcttgtgtaaagttcttcacttttttctctgagggctgggggttgggggagtcagcatgattatatatttaatgtagaaaatgtgacatcctacatactaggtgaata

SEQ ID NO: 726035 - DNA, 1287 bp, Homo sapiens
ggctaggtggtgcactgggaaacgcgggcgtaggtgaccggctggctttctcagttttgtgtggatgactgggctgcatgttggtgcagctttgctcagcttgcttgctgtgtcctgatgtgcaggacagcaccattagtcgcatgtggactagtcaccataatctgcaagtgcacccctgccacagcctgctgatgctgtgccagctgcaatgtgaccctgtctgctgtgatacctgctgcacctgcgagacgcaagcgctgtgaccctgtcagagagagtagctcctggctggctccaaaccacctgtgtacctagcgagtgtgcgtggcactgctgtgtgtacgcctggtgactcggtgcgcatgccagttgcctctaacgttcttctcctgagttacaacctggtcatctcgttcaacttgtggacgcaaggcgtccagacgactcatgcacggagcacaagttacacggttgctcgcactggacaacatatacctgacacgaatgcactggtctaactgtaggagggcttactgtgcgacctgccttcttaccttcaccagtgacactcggtgcttccaacagatgtgtacatatactaggacaactccacaacatggcacaatacctcgaagcccacacaatactaattttcctggctccatatgaacaggaacttaggacactggcttgtgcgggccccaactcttgcccaagaaatacgaagaatgaccaccattgacagtttaccaagattcccatacacacgggaccacgatcattggcgaaatggaactcactgccattggtcaaatatccccgaatcggtgcctccttatacagtgggtactgttcctgcacgggtaaccttctaccaactctcgaacttggcattccctactttagacaaaaacctcccacatatgtactgtacccccattaccgctggcaccaggtgcacctttgcacggtgtctcactctttctcaggaaactctccgctcaatcgatcaggaaatctctggaccgccaccggcaatggaagtgtgcacgattgccactctctacgtacctgccagtcatcttcgcccaccaaccaataactcatcagaacaaaagacacaatcgacacaccatccgtcctcaatccccagacacacaagctactcaaattgataacactacatccaacacttatatcactctacaacgcctcgcacaacatctcacccacagtatccaccctccttctcttcgcttcttttctttctctcttctctcctgc

SEQ ID NO: 726036 - DNA, 418 bp, Homo sapiens
  misc_feature (206)..(206): n is a, c, g, or t
  misc_feature (225)..(226): n is a, c, g, or t
  misc_feature (248)..(248): n is a, c, g, or t
  misc_feature (252)..(252): n is a, c, g, or t
  misc_feature (262)..(262): n is a, c, g, or t
  misc_feature (283)..(283): n is a, c, g, or t
  misc_feature (295)..(295): n is a, c, g, or t
  misc_feature (308)..(308): n is a, c, g, or t
  misc_feature (327)..(327): n is a, c, g, or t
  misc_feature (333)..(333): n is a, c, g, or t
  misc_feature (342)..(342): n is a, c, g, or t
  misc_feature (361)..(361): n is a, c, g, or t
  misc_feature (373)..(373): n is a, c, g, or t
  misc_feature (376)..(376): n is a, c, g, or t
  misc_feature (383)..(383): n is a, c, g, or t
  misc_feature (406)..(406): n is a, c, g, or t
ggcatcgatcctccctgcccgcgaagtgacagtttacaaaattattttttgcaaaaaagaaaaaaaagttacgttaaaaacccaaaaactacatattttattatagaaaaaggattttttctcccccagacaaatggaaaaaaagaggaaagattaactatttgccccgaaatgtcttgttttgttgcgacataggaaaataaccnagcccaaagttatattccnncccttttactgatttttttttnttcnatctgttccntctgcgggattcatttctccnatttcatgtccnttttggggtgggngtcggggtaggggggactnttgtcnaaaggcccnttggggcatgggggtttgntagctcccttgnccntgaaaanattttatgatattaaagaaaatnttttgaaatgga

SEQ ID NO: 726037 - DNA, 141 bp, Homo sapiens
attagagaccggcagcactgaagctggtgaagaatgagactcatctcaataataataataataataataataataataagtgactgtacagctgagttaactgctataatttatagttgtaatatcaaataaagaaactat

SEQ ID NO: 726038 - DNA, 832 bp, Homo sapiens
  misc_feature (32)..(32): n is a, c, g, or t
  misc_feature (52)..(52): n is a, c, g, or t
  misc_feature (56)..(56): n is a, c, g, or t
  misc_feature (76)..(76): n is a, c, g, or t
  misc_feature (135)..(135): n is a, c, g, or t
  misc_feature (215)..(215): n is a, c, g, or t
  misc_feature (219)..(219): n is a, c, g, or t
  misc_feature (228)..(228): n is a, c, g, or t
  misc_feature (375)..(375): n is a, c, g, or t
  misc_feature (400)..(400): n is a, c, g, or t
  misc_feature (409)..(409): n is a, c, g, or t
  misc_feature (419)..(420): n is a, c, g, or t
  misc_feature (422)..(422): n is a, c, g, or t
  misc_feature (427)..(427): n is a, c, g, or t
  misc_feature (432)..(432): n is a, c, g, or t
  misc_feature (490)..(491): n is a, c, g, or t
  misc_feature (493)..(493): n is a, c, g, or t
  misc_feature (498)..(498): n is a, c, g, or t
  misc_feature (507)..(507): n is a, c, g, or t
  misc_feature (525)..(525): n is a, c, g, or t
  misc_feature (533)..(533): n is a, c, g, or t
  misc_feature (538)..(538): n is a, c, g, or t
  misc_feature (551)..(551): n is a, c, g, or t
  misc_feature (580)..(580): n is a, c, g, or t
  misc_feature (590)..(590): n is a, c, g, or t
  misc_feature (592)..(592): n is a, c, g, or t
  misc_feature (594)..(595): n is a, c, g, or t
  misc_feature (599)..(600): n is a, c, g, or t
  misc_feature (612)..(612): n is a, c, g, or t
  misc_feature (617)..(617): n is a, c, g, or t
  misc_feature (626)..(627): n is a, c, g, or t
  misc_feature (734)..(734): n is a, c, g, or t
  misc_feature (757)..(757): n is a, c, g, or t
  misc_feature (808)..(808): n is a, c, g, or t
ccgcgctcgcagggccgtgccacctgcccgcncgcccgctcgctcgctcgcncgcngcgccgcgctgccgaccgcnagcatgctgccgagagtgggctgccccgcgctgccgctgccgccgccgccgctgctgcngctgctgccgctgatgctgctgctactgggcgcgagtggcggcggcggcggggcgcgcgcggaggtgctgttccgctgcncgcnctgcacacncgagcgcctggccgcctgcgggcccccgccggttgcgccgcccgccgcggtggccgacaatggccggagggacccgcatgccatgcgcggagctcgtccgggagccgggctgcggctgctgctcgagtgtgcgcccggatggagganagaaggaagatgcggcgtctacacnccgcgatgnggacaggggnngngctgntattnccacccgggctacacgagctgcccctagcaggcgctagatcatggagcgagggcactnntnaaaangcgccgggnacgccagagtatgcgcgncagcccgngagcnggtttgcagacanatgggcgatagaccactccagaaaggagngcctgggtgngngnncccnngtgggacagcanccatngaacatgtnnggggcggggggagagcagttctgggccggaaagcccctcaaagtcgaggtatgaaaggagctggccagtgttccggggagaaggtcactgacgcagcaccggcaganggggcaagggtggcaagcatcancttggcctggaggagcccaagaagctgcgaccaccccctgccaggactccntgccaacaggaactggaccaggtc

SEQ ID NO: 726039 - DNA, 335 bp, Homo sapiens
tggagcctcactctgtcacccaggctggagtgcaatgacacgatctcggctcactgcaacctccacctcctgggttcaagcgattctcctgtctcagcctcctgagtagctgggattacaggtgcctgccaccatggctggctaatttttgtgtttttagtagagacggggtttcaccatgttggccaggctggtctcaaactcctgacctcaagtgatctgctcaccttggtctcccaaagtgctgggattacaggcgtgagccaccgctcctggctgagataggtctttcttaaaggggagagggaatggctggagagagcaggagagaaact

SEQ ID NO: 726040 - DNA, 128 bp, Homo sapiens
ggcaagaacgaggaggatgtgaaataaacacctgggtatagtcccaataatccggtccagtaacagttcagaatgaagctcagtgtttgggaactgtccaaagaaagcattcaggcttgtgttttgac

SEQ ID NO: 726041 - DNA, 168 bp, Homo sapiens
cactgcttcggatggagaagaagttgctggagttggactgtgggatactgtccaggccagctggaccggtgggggaaggggacggagacattggctacgggtggcactctgcagggagtacgggctcagtgcgcctcacacaagcgaggtagggtttggagacgccaa

SEQ ID NO: 726042 - DNA, 1980 bp, Homo sapiens
  misc_feature (168)..(168): n is a, c, g, or t
  misc_feature (603)..(603): n is a, c, g, or t
tggcgtgctgttcatcgtgtttgttgtttcttctcgttggtattccgcctcttctgcgtgtcttcgcgtgtgtttggttgttctgctttcccttgtgctaagtctgttgttgctcctggggtatagtactagcttgttgttacgtcactttgcttttgcattcgcttntgtttattgtggtctagctatttttttctcctacggttggtcgtgttctgtgatattctaccagctttctgtctctaatgatggtcacaatcgtttggttggtgtacgctccagtatgcttctgtgtgtggctgcttcttctgttctgattagttatgtcttgcccacaggggagagattattctatttttgctcgggatgcttccttgtgggggtgtttgatctgccgtcctccgcgtgtgtattttggagagggtccgtctatcatcgccttatttgagggggttgtacaactagttctctggtctagtggcgctctgtgtgttgttgttgtatacgcgaccgcctcctctcattatgagttttttgtatgagatgcgtggtcggactctcttttgtcttgtgcatccgatcgactctgatggcttctacatngaccactgattgtttctcctagtggggggggggatggttgatcatcattatctttttcgtcgcggggagtatatatggggtttggggttgggtgtcggggggtcgttgctccctccattgatgagagtgtgtgtctcctggggagcgcaccccatttgtgttggactgtcgcatttggtcgtcgcgtgttacgatgacaaatagtgtggttgaatataattgttgtgcttcagtggcgcctccctctttagtattactgtttcctaagcctacgccgggcgacaagcacccacgatgtggttcgtgtggagaatacctagctgtgtgtgataagaatttcgcgttttgttgtccggtagagaagtatattgtgctacgggagatccccactcgctccgtggtccatcgtgtttagagtcgttcggtgtattaattacgtcggcggtgttatcatcagaatgaagatagttttttggtttaagacctctcgtttaggggtgtctctcccccctgcgaagattgtccggtcactattctgttgttgatacttatatagaggtgttgttacgacaaccaacagggaaagttgtttccccacccccttcgcagataagagaacttcttggtggtgtgtgtgatataaaagtgttgtctatatccactgaccgcgcgccactcctcgtgtggatacgtctggtggaaacgctgtctcgttgtgttgtgtttccacgacgccttgatttatcctcgggggagatctccctgttgttttttttggagacagtctctctcatgagagagtctcactctctcagggcacacaaacacaggtgtgtgtggtaaaacatctggtcgtctgtcggctgtgttgcgcgtgtttcgtgtcacaacagatacacactcccctgtgatttatataggagtgcacaccagtgtgtccaatatagagaatattatagaggtgcccaaccagaggtgtgtgtataacacccagaaagggggcgccacactctctgtgtggcctctcctgtggtagagtagtgtagtagacggtaatacctgggaagaaagaccaatagaaataccacgccataattaagatatccagagatatgtttacagttgtttgtgtcttgtggggtacaaatctgtaaaagtaccaacccgctgtaatgtgcccaaggtgggccaccgtacgtacgtcttcccagagtatggtcttgtagttacagtcttcccagagtatggtcacagccatcttttaacactgtgttccacggtcctatagtttgctttctcccctttttaagagtatggtaagatttactgggattgatttactgaatgaaatttaaagccagatattcccgtttcttg

SEQ ID NO: 726043 - DNA, 150 bp, Homo sapiens
aggacggtggattattccttcaggatgcaggatagggacgtgcggatgacctccttccggatgcagatgaaggacgtgcggatgacttccttccagatgcagatgagggacgtgcggatgacttccttccagatgcagatgagggacggg

SEQ ID NO: 726044 - DNA, 374 bp, Homo sapiens
  misc_feature (23)..(23): n is a, c, g, or t
  misc_feature (62)..(62): n is a, c, g, or t
ttccctgatccctgggacaaganaccggggttttcctacaacaatattgttgagaaacatanaggcttgagaaagggcttcccaaaatcaaacttcagtttcaaaattgcctttcctgacgccaggcttttccgatgcttcagaagggcctctggagtatccagaaaagaggtctgataactttgaagattatgacactggaataaagggaaatgtacagaattcatgaagagctaaaatgttcatgaatatcaaggaaaagaagagctaactgaatgaattcagaaaactgaagcaatctttttgacttttgcttggaatattgctgatccttgttttgtttttcagagtaaaggaaacattttggactaaaa

SEQ ID NO: 726045 - DNA, 333 bp, Homo sapiens
  misc_feature (129)..(129): n is a, c, g, or t
  misc_feature (174)..(174): n is a, c, g, or t
  misc_feature (199)..(199): n is a, c, g, or t
  misc_feature (209)..(209): n is a, c, g, or t
  misc_feature (221)..(221): n is a, c, g, or t
  misc_feature (242)..(242): n is a, c, g, or t
  misc_feature (247)..(247): n is a, c, g, or t
  misc_feature (270)..(270): n is a, c, g, or t
  misc_feature (292)..(292): n is a, c, g, or t
  misc_feature (307)..(307): n is a, c, g, or t
tgagaaagaataagtgaagactttaggtttaggatgctttaggatggggcagatgtcctcaaagaacaatggggacagagtagggagcgtacatgcagcctggggacctgatccccttccacggtcatnttgcctctgctccttctgtctgatttattccgcattgggacattngtctatcattctccaattgcttcgngtttatgagntctgtatacccngcccgtcagtatgttttttanggganaggatgctgccttttactttgtntatgtacccgcatttgccctanacaaccttgtatgcnacaagaactcagtctatctctgacct

SEQ ID NO: 726046 - DNA, 1371 bp, Homo sapiens
gctgtattccagaaattaacttgatgtaatgattaaacttgtagagtccattgcatattgatgcttggaaatacgcgaggctctcatctataatcattctaggtaatatggtggaaggagtgttgcggctgtgaagaggaaacgcagcatctagatctggtacgttcgcttgatcgttccatatttccgtatgacatgtcgttgcggcaccagcgtgatatcacattgggcacgaccgtagcctctgatattactagtctggtacatcgaaacagagttatacaggtagacctaggggtgaagcaactctggtagaagtgtgccatcagtggtactcggaaaattgcactaaccttttaatgtagcttgtgacataaagccttagcccagtagatcagggaattagccagtaggactctacaataatgagagttgtattaccaaaaacagtacacaatcttaaatattttacttcaaacaaggattttttcccaagtaggagtcctcggaagaggattcgctagaaaacattccaaaacagggtggcaactacgtgttgcttgtagatgtcgcgtttgcgaatcttccatgcgtataatggggggtatatactaatgcttgtaagaaacgcaatcgtacatcttcattacggcgcctattggccatttaatttgcatccttgaacccgcccccagttttggctgtggatacgttccctatccgaatagattctgcgttctcttacatggcccggccagagttggtcaaacgcacgctaacgttaacaggatttgccgttccattcccttggaatgcgtctgtcaataaattcggattcagacacacccctatttagttgtgcagcaacggccatcaccccgaaggcaatgttgttaacgttcgggacacccgcgcaggcttaggttcaaagctagggcgcacattacaacttcttgtagacccacgttagggttatagggttccgaataccccacggcttggtgctatcataataacaaaggaccaccctctccagagttcggatactgcctcaagcaggttatcgcagagacactccaactgcgacggattcatcgtattccaaagctgggttaacccggttcgggccttgtaaacgacagggctatacacggtggattccatagtacacagcaccacgttcattaggaggaattttctcatgcggcgaacaggggaacgctacattaccgagtttccaaaggtgcccttactggaacaccaccggttttcaaccccgtacacaaaagaccagattacacgcatttctggtgcacaacggccttctaacaggacctcttaagcggctcccagcacagagcactgagaaaa

SEQ ID NO: 726047 - DNA, 344 bp, Homo sapiens
gaatggcgcgtcccccgaaggaatataaatcattctattataaagatatgtgtatgtagcactattcacagtagcaaagcactattcacaatggcaaaggcatggaatcaacctaaatgcccatcaatggtagactggataaggaaaatgtggtacatatacaccatggaataatatgcagcaattaaaaggaatgagatcatgtcctttgcagggacatgaatggggctgtaagccattatcctcagcaaactaatgcaggaacagaaaaccaaataacgcatgttctcacgtataagtgggggcagaatgatgagaacacaaggacgcgccatcgtgcgctt

SEQ ID NO: 726048 - DNA, 219 bp, Homo sapiens
tgtgcggccagttccagcttcagtgactcagtaggtcctcaaatacttcccatgggaaatacaactccacggtatcagaaaatacagttagccaatgtttcctgatgagttttgtgcacatttttcttgattgtatcttcagtccctttccaccccagaacagtgaacaattattttcccctctctgtgcttacacccttctgcgtcttctcgagccga

SEQ ID NO: 726049 - DNA, 711 bp, Homo sapiens
gggaggactcaagaagcagcagcgaggagtcagacagtgacatgagaggcactgtgcagccatgaatgcagctcaggtgaagcccttggggaaaagcccccagtgtgtaaaccctgccgtctacgcatgtgtgctatggtgtgccctctggggaaatgtgcgcctggcccatgtgccaccctgggaaggtggtggcctgcaaccccctcagcccaggtggggaagtgggaggaggactcagagagcagtagtgaggagtcatcagacagcagtgatggacgatgctgcccacagctgtggacccggctcaggaaaagtccttggggaacatctccagtgccaaatccatctccagtcctgccaaggggaccccttcagaagtgcatggggcctgtagcccgtccaggtcaaggctgaaaagcccatggacaactcggagagcagcgacggagtcatcggaccagtgcggacagtgaggaggcaccagcagccatgactgcagctcaggcaaaagcagctctgaaaattcctcagagcaaggcttgccaagagagcaaccaataccactgcatctgccaaggtcggcccctgtgcgacgtgggcacgccagagcccccggaaaagccaggaaactgcgacttctccagcaggcctcatccacagctgctggcctggcgggcacccagcagaacaggcagaggcatacttcaa

SEQ ID NO: 726050 - DNA, 496 bp, Homo sapiens
  misc_feature (280)..(280): n is a, c, g, or t
gctccgggcggctctgacgctgctcggggaggtcccccggccgccggactcccggggtgtcccgggctcgcgcaggacgcagaaggtgcagtggagccaggtgggacgaaggagaagcacgaagacggggtgaaggtggagacatgctggagcacaaggtgcccgtacttcgcacccgcataccgagccccttcccgacggagtgcgttcttctatgaaggaaggcctgtgagattgagcgtggcagcggaggaggtcgccagtataaatgggaggatgntagatcatgaatacacaacaaaggaggtttaccggaagaacttcttcaatgactggcgaaaggaaatggcggtggaagaagagggaagtcatcaagagcctggacaagtgtgattcacggagatccacagatactttgtggacaaggccggagccggaaagtcctgagcagggaggagaagcagaagctaaaagaagaggcagaaaaaattcagca

SEQ ID NO: 726051 - DNA, 1059 bp, Homo sapiens
  misc_feature (570)..(570): n is a, c, g, or t
gatcgcaactattcttccattcgtatattgttcctgctcgttgtattatccatcaagatctccacggctgactcatgcgcatcgatcgcattgaacggtctagaactcctcggatgtacaatatcctcaccgatgtagatccggaccgccaatgctgcttattcatccaattcatgtcatcgcactattgttcttacatctctattgaacgctggtccgctcgacaactaaatcgacgtgtggaagagccagaccaaacacaattgcctcgagcaacggtactataatccatggactgcaaatcatatgcggctcgctttagcatcgtagccgggtggggtatatcttcatcgcgttcagaggtgatccccttgatactctcgtgcggagagcatggaaactattacgagttatcactgtcccccattccgctctcgtagaatattttatattccctgcctttacttactttgtgtatagcaaacatattggcgccccttgtaagtcaatagctcgcttaagtgaagacaacccactctcatacttatcccccacgcatcatatgtaagncacgacatttatacattagcaaaattaccatttccaaacattctttgaagagcccctaaccccaaaaagcttcccttgggacttttttgttaataattgcactaggagctttgaaacctagaaattttccccaatcgcgaactcatttgtacgttggcacaagacattgcctgggccacaattactgcccagccaagccagcaaagggggggttgggccgtaattgttattgcaacaggctaaactgggactttgacttttactttccaaaaattattttaagccgcctttttccctttagaaaactgtgggaactcacccaaaacctaatgacaaattccctccttagcagaggggccaactttttaaggaaggtgcctgcctgggtttctttttttggccattgaatttgtccccaaggaagtttcctgtttgttgatttacccagttaaatgggggttcctgggtgaattgttgaattacccacac

SEQ ID NO: 726052 - DNA, 1130 bp, Homo sapiens
agcggagctgtgaatgaagcaggcttggggttgctgccgcctggggaggagcaggaaggactgtgagtcggacgatgtgagctcgtgtatcgctggcttgtactagggttctgtatctgccggtaggccgctgggcaactgacctctcgggggactcgcatggcctagcatggggtctgtaagcgtgtatcgggaatagcgaggcagaggatcatccttgcggaagatgggtcatggtccctaagctcctttccgctggatgcgagagttgtactaaccagtgccgcgtcatgccttgatggtgtaatgagctgagaatcggagctgcggcaacctgggaagcctcgatactcaggtgctcgatcccatctatgctggctatcaatcggtagactgtcaaggattttgatcgccatgtcaagaaaaggggtcacaacagtttggtgggggcctgtgggtgagctcatggtctcctaccatgcaactcaccgcttttgaggtcgctagagtgacgaggtatctcgcaccttcagacgtgggatcaccgtttagcaattcattgtatctcgtcccactagacttgggactcactatgttccctgccccatgggatcaactcgaggcatccaatggtcagagaacggtgatcgccgggtagaacgagcacatttgtaaacctcgctcaagacgacttccaatacgcccacatggggaccacttgaagcgtttgggtccgcttcttggtgtacacgaagttgggccttggtacagtcaggaacaggacttgtggctttcccgtgggaaacccagaaccttaattgtacacgtccccgaggccgaatccttggtttggaacgaatttccataggggacagacgaatgtcaagtgctaggggatccgatgggggggccataacacaaaggaatctgggattgggaaaccttgtgggggcacacccgcgccttgggcgggggttaccacaaacctgataccaactcctgtgtgcttaagaaccttaaaccaaacccaaggccacaaaccaacgggcaactggaacccacaaacgaataggataccttctccaaagacattttcccttaggccttgggcgcaagccaggtttggcagg

SEQ ID NO: 726053 - DNA, 189 bp, Homo sapiens
atctctacacggatcccctgttagtaccgctacttgtggaggctgagttgagaggattgcctgagccctagaggtggaggagtttgcagtgagccgagattgtgccactgcattccagcctgagccacagagtgagaacctgtctcaaaaaaaaaacacagaatgagagaaagaaggggtcccgccctc

SEQ ID NO: 726054 - DNA, 436 bp, Homo sapiens
cagtgaactaagaggtgatgtactttatgctcttcaaccctgtggcaccaaacttcgcaagcagaaaagaactaagactcacctgtcagctctggtcaccaaaggggcttagaaatgaactgctacaaggcttttaggaacattcacctctatcctctccagtagcaagtacaatgacaacagccagatgcaataaagaatctctgagagtaatactgcacacttcaaagacagaaagctaaataaagtcatttactcagaggtacacttggagagcacaagagagagccagggaaaacacattcactaactttcatggtaaaaatagaaatctgactcaactctaccttaacagcaatatttaaaaccttaactttagtcataaaaaatatatatatcaagcatgcttaaataaagaggaatatatagcaccaaa

SEQ ID NO: 726055 - DNA, 103 bp, Homo sapiens
tttattcatttgcacaacaacaacaacaacaaattcacggaatcatttaagtgcatgaacattatttttcaacacatttcacaaggaggacaagttgaatgga

SEQ ID NO: 726056 - DNA, 146 bp, Homo sapiens
catacctctgcaagtattcatgtcgtcttactttatccatttcatggatgaaaaccaagtattatgaggttcaggggtttccccgaaggctacacagcagcctaattctggtgtctatcactacactgcatcaattcttttttttt

SEQ ID NO: 726057 - DNA, 1010 bp, Homo sapiens
  misc_feature (231)..(231): n is a, c, g, or t
gcatgtgctgactggcgtcacgcaacgcgtatgccaggaatggtgcttagcagacgtacctgcagagacactattttcctgatgatactatctagatagtctgtgtcgggctctcgtgtcgtcgccgtgcttcgctggcatggccatgtacacgcgcagtctgctgcatcttccatggggggttcccccgatcgctagcgcggatgcgtgataatagcgcggggcaatatngtgtttcatggagcgcccagagaaatgcatgagcgctaattttgtagcgatttggggtacgcgctggatgaatggaccgaagaatgggcaccagggattcaaagagggtgtccttgtgaggagagaagccatgcctcacgaatgttgggtaatgagcacctttcagatggtgtacaaggaactctcatgttcctaggattgtaaaagagtaagaaatcgttataccagtgtagaagttcattgaattccatgaagtactaacatggcgtgaggtcgatgtagtccgtgttcttaatttttaagaggtcatagacggttcgttgtatagcagtaaatggtctataaaacattttgtagtccctatgggactttgatatcaaggattattcatgtaaccgtttagagagttgtgggcaagattatccccggtgaaaaggattcttgacttgtgaagctgtgagtacatttttacattgacttctatgttggaaacgccaggtcagtaggtggggcggttactgttccttcgattgcaatgggatagtcatttgtctgatgattgttcaattctgactaaaagtttggttaggacaatataagatagggaggggaaaggaaaggaggacttttgggcgcaaaacaaaattgtgtgggggaccgaagagttagtgttaacccacgggctcgcatatggtgtttccaaactgggggagggcatccgattgtgtgtagcatgtaacaggggtatttaataaaacagaaataacgaggtcgaaaat

SEQ ID NO: 726058 - DNA, 360 bp, Homo sapiens
actaataatcatctcccttcctactattactactactaattattactatcatgactaccacacactcactcggctacatacaaaaatccaccccttaccgactgctgctgctatccctatttctcactccgcccggcgctcctttttccttcatatcttcttttagctattacctacttcttattagatctatcaaattagcccgtccttttatcccactacctatgcatccactactaacaaactaactcatgcctgctactagataatgtctatcccttcttcttattcatcatccatagtcactacttctgtctctatgtattgattactacaaggatgatactgactgcgcctaat

SEQ ID NO: 726059 - DNA, 1462 bp, Homo sapiens
  misc_feature (21)..(21): n is a, c, g, or t
  misc_feature (91)..(91): n is a, c, g, or t
  misc_feature (253)..(255): n is a, c, g, or t
  misc_feature (264)..(264): n is a, c, g, or t
  misc_feature (273)..(273): n is a, c, g, or t
  misc_feature (276)..(276): n is a, c, g, or t
  misc_feature (290)..(290): n is a, c, g, or t
  misc_feature (295)..(296): n is a, c, g, or t
  misc_feature (312)..(312): n is a, c, g, or t
  misc_feature (324)..(324): n is a, c, g, or t
  misc_feature (330)..(330): n is a, c, g, or t
  misc_feature (336)..(336): n is a, c, g, or t
  misc_feature (342)..(342): n is a, c, g, or t
  misc_feature (366)..(366): n is a, c, g, or t
  misc_feature (370)..(370): n is a, c, g, or t
  misc_feature (375)..(375): n is a, c, g, or t
  misc_feature (378)..(378): n is a, c, g, or t
tctcattataactttttaaanggggtctcaaaattctgtgacaaattttgggtcaagtggtttccattaaaaagtacgtgattttaaaaanctaaataactttaaaacgtgccacagcgcaaaaaagaaaaccaagaggtggctccacaaaacattcctccttttcctttcgtagaggttttacgagtgcttgtgttatcattaaccgagctcttttatacttacttaaactttaagagtggccaatgtgaannnaaacgagtntcgtgaaancgngttctttccaccancgtgnnttaagaaggtgggggnggcgaggttatngagggnataatnatctcnatttgacgcctttctgtggagctntccngtggngcnagacacgtgtgggtgaaccttgtgccagagcctccaagcagagccttctctgtggtcccaaagtgctttggaagtgaacaaccccgcgcgagacaacgtggctcgtggctctctcatatactcagcgaacacgaggcagagaggcgaacccccaaagaggggtcgcatatacgtctcgtggagaagagcgctctctcaaaacaacaaacatgtgggccttgtgcccgaggagaaccccaatactccacagcaaaatggcggaaggaaactcaacccagagatctctcaaagagaacattagagcgcgcgcccaatacgtgtccccaacgtctgttgtatcaccacaagaaccggggcgagatcacaaactcttttcacccttttacaacggtcttcagggcaaacaccttttggcagttgcgcacactgtgttggaaccccccgtggggtggcgcacaaaaatccaccaaataaacacgcgggggcacattaagaccgcggaggagcacttatatttgatggacgcacctggggaaagtgcgggctcccccagggccattaattcccaccctgtgaagaccaggtatgaaaaagacccccaacgcgtgtctatctcccccacagtggcggccggggcgccccatcttcttcggggtctcgtgtccacccccaccccaaccggttttgcgccatcggaaaccaaatacttttcctctttctgagcccagacaagccacacctttcttctttggcacatctctgcgaagcgcgccccaatatgttcgccccccgaagagaaaaaacgttttcctctccaaaaagagtccagcagagggccgcttttcaacaagcaccatttatcaatgcccagcagtgacagacgtgcacggttgggaggccaatcgtgccaacggctcaacccgggctgttgtggaagaccaccacatcctcactctcgcgcacagcgacgacccacaccaacccccatcatgtagaaccctccgagagcgcacagcgcaggttctcacacgaacagtctgcgagcagcagacgacccaaaacgactgagcgaagctcaatcaag

SEQ ID NO: 726060 - DNA, 104 bp, Homo sapiens
tgactcacaggagctaccttactgaggataaatacgtcaatatcaacggcgcgagcgtatcgcgcatgacctttcccatcttggttccttgctgtcagatggtc

SEQ ID NO: 726061 - DNA, 242 bp, Homo sapiens
tgccgggcccccccagggggtcccccacaacccggcctggcctcctggtgtttgcggtcccagtggcccctgggcaggggccccccggcttacccttaggtgctggtgctgggtctgttttggctttggggtgtgctgggaggggcccccggtcccttttccttcctgtgccctttgaaaggtaagggtttgtgtggctgtggagctcaagggtttgtgaataaaggcggcggccctgggga

SEQ ID NO: 726062 - DNA, 329 bp, Homo sapiens
  misc_feature (284)..(284): n is a, c, g, or t
  misc_feature (301)..(301): n is a, c, g, or t
tcgaatcgacggtttctctgggctgcagctttctcaggtctgacactttcccgttcaggcccttcatcttgaagagatgttctcctcatggtgattgttcttcttaatgaggtcttagatggaaatgaggaagttattgggaacaggaataaaaggtacatctatgtcatgctttcagcaaatagcttgggtgcattgtgtccaggccctaggaatctgtggaagtttgaacttaagagtgatgacttagggtatcagggtatctgggcagaagaaatttctanagcagcaaagcattcanagatgtggcccctggctgatcgctagca

SEQ ID NO: 726063 - DNA, 747 bp, Homo sapiens
attcataggacgagcacgttctaatggtgaccgtagatatgccgcaattccggcctatgtccactcagtctagagcaaaaagtcggaagtaacgtgtagcacattctgatgggtgtaatggctgaatagatgccttatgttacatagctgcataagcggattagactattactagaatccacgccattaatatggacctttgaaattcagaagatttggcctgtgaatgctgcgttgctcatgccaattcgtgttaatatgttagtaagtaatatttacttagtaccaataatacttgattgacatggttgagagcaggtgtatatcgacgcattactcgatttaatgctcatctgcagactacggttcatatttctatttcagcctattagcgcaatttatgcctcagctctgggctagtggcagggtggcgtcagtgacaggaatcagatctgcgtatttcatcatgcccagctcatcttgcctcaattcttaatcacgagaggtagctggcggaaagcagagactgttaggatacactgagccctttcagtaaggaagcttaaggtagattacgacaagttagggaacctgaccagcatacaatcttccagatggagtattacctgacatctgagatcatcttgctagtcatgctatcatagctgtcgactgaattaaggaaaggtgaactagttcacaaggcatatacgcagccgattgattcatggcacacctagctcagac

SEQ ID NO: 726064 - DNA, 263 bp, Homo sapiens
actgctgcccctgtccccgaggagtgtcccgcggagccacacctggcaagagcagtgtgggatgcagggaaccgtatgcacgtggaaatgccctggaccgtgagtgtggccctccctttctgggcctccccaggtgagccctgtccctgccccgccatgaccagcctcatatgagcccacggttcccacggagctgacttacccggggtgcctgtgccaaacaataaacccggcgtgtgtttccccaaaaaagacaaaaaaaa

SEQ ID NO: 726065 - DNA, 855 bp, Homo sapiens
  misc_feature (25)..(25): n is a, c, g, or t
  misc_feature (42)..(42): n is a, c, g, or t
  misc_feature (45)..(45): n is a, c, g, or t
  misc_feature (560)..(560): n is a, c, g, or t
  misc_feature (606)..(606): n is a, c, g, or t
  misc_feature (625)..(625): n is a, c, g, or t
  misc_feature (636)..(636): n is a, c, g, or t
  misc_feature (638)..(638): n is a, c, g, or t
ggccaggatggcccccgactctggncctccatgatcacctgntcngcctcccaaagtgctgggattacaggtgtgagccactgcgtccggccaaaaaaatttttgtaaagaccaggtctcaccatgttgcccaggctgttctccaactcttgagctcaagcaatactcccacctcagactcccaaagtggaggctggtattacaggctgagccactgcacccggcagagaatccatgtttgtttggaaaatatcacttctttgttcttgattttggtttttgatattcagtttagaacttaccctagctttcagtatatttgtgtgtgtgtgtgtacacatgtgctttatagaaagacacacacagagggagacagagattatgcagactaatgactgacttcacatattagttttaacttagaatgctgaatcatactttaaactataagaaatgctacaaacccacacaaattgtgtttgtaaaacgttaatatacaaaacataagaaatgacactatacacacgctagctgacttacacaaaataatcttagaaacnattaaagtagattaatatagctataatagccatatattatatatantgtaaatagtgaccctatnttattcttaanangatcaggtttctagtcaccatgtatgaaagtccttccaaattacctcaaaatataacaaatctttctctaaccctaagacacaagcagaattctatgcttctttggcaacaacaataactattagaaaatcttaacctcacccagaagttaaaacaagaaaagaaagaaaagaaaggaaaaaacagcttacttaaataattgtgctaaatagcttat

SEQ ID NO: 726066 - DNA, 886 bp, Homo sapiens
  misc_feature (56)..(56): n is a, c, g, or t
  misc_feature (591)..(591): n is a, c, g, or t
  misc_feature (637)..(637): n is a, c, g, or t
  misc_feature (656)..(656): n is a, c, g, or t
  misc_feature (667)..(667): n is a, c, g, or t
  misc_feature (669)..(669): n is a, c, g, or t
cgctctagagtatccccggctcatttgagttcactgcaacctccacctcccaggtncaagtgattttcctgcctcaccctcctgagtagctggaattacaggtgtgagccactgcgtccggccaaaaaaatttttgtaaagaccaggtctcaccatgttgcccaggctgttctccaactcttgagctcaagcaatactcccacctcagactcccaaagtggaggctggtattacaggctgagccactgcacccggcagagaatccatgtttgtttggaaaatatcacttctttgttcttgattttggtttttgatattcagtttagaacttaccctagctttcagtatatttgtgtgtgtgtgtgtacacatgtgctttatagaaagacacacacagagggagacagagattatgcagactaatgactgacttcacatattagttttaacttagaatgctgaatcatactttaaactataagaaatgctacaaacccacacaaattgtgtttgtaaaacgttaatatacaaaacataagaaatgacactatacacacgctagctgacttacacaaaataatcttagaaacnattaaagtagattaatatagctataatagccatatattatatatantgtaaatagtgaccctatnttattcttaanangatcaggtttctagtcaccatgtatgaaagtccttccaaattacctcaaaatataacaaatctttctctaaccctaagacacaagcagaattctatgcttctttggcaacaacaataactattagaaaatcttaacctcacccagaagttaaaacaagaaaagaaagaaaagaaaggaaaaaacagcttacttaaataattgtgctaaatagcttat

SEQ ID NO: 726067 - DNA, 178 bp, Homo sapiens
taataaccgtacagcagacagtcaaaggacatcagttaataaggtgacacataagaataggccagaaccacatatctgatgagaatggcagtaccacaccgaagtcaagacagataaacagaacatctttgcactttcttgcgtagacagacttgttacttagggctggaggcacatg

SEQ ID NO: 726068 - DNA, 134 bp, Homo sapiens
ccaaacctcttcagttgctggtcagatccgtgagaggaagcaagaaggaggaggaggagctgaggccacccttctgcagttaggcctgaggcacttctagtcaggaaagcagctttagtcagacctgatacagc

SEQ ID NO: 726069 - DNA, 678 bp, Homo sapiens
  misc_feature (383)..(383): n is a, c, g, or t
  misc_feature (429)..(429): n is a, c, g, or t
  misc_feature (448)..(448): n is a, c, g, or t
  misc_feature (459)..(459): n is a, c, g, or t
  misc_feature (461)..(461): n is a, c, g, or t
aattcgcggccgcgtcgacacacggtgactcatgcctgtaatcccagcagagaatccatgtttgtttggaaaatatcacttctttgttcttgattttggtttttgatattcagtttagaacttaccctagctttcagtatatttgtgtgtgtgtgtgtacacatgtgctttatagaaagacacacacagagggagacagagattatgcagactaatgactgacttcacatattagttttaacttagaatgctgaatcatactttaaactataagaaatgctacaaacccacacaaattgtgtttgtaaaacgttaatatacaaaacataagaaatgacactatacacacgctagctgacttacacaaaataatcttagaaacnattaaagtagattaatatagctataatagccatatattatatatantgtaaatagtgaccctatnttattcttaanangatcaggtttctagtcaccatgtatgaaagtccttccaaattacctcaaaatataacaaatctttctctaaccctaagacacaagcagaattctatgcttctttggcaacaacaataactattagaaaatcttaacctcacccagaagttaaaacaagaaaagaaagaaaagaaaggaaaaaacagcttacttaaataattgtgctaaatagcttat

SEQ ID NO: 726070 - DNA, 127 bp, Homo sapiens
cctgattgaacttgatttagtgtactttgaagatcgatcacctctctcattcagatgaaattctttggatagaatttatttccaaagtaaggattttcatcaaaataaaaatctgttcagcaatttg

SEQ ID NO: 726071 - DNA, 453 bp, Homo sapiens
gcattgtgctgagtgtgccccagtaatggctagccaggtgcttggccttagagcaccgatgtacagggtcctccaggtcttcaatggagaaaccaatgtccacaggtatagctcggaccacgactcctcttgtgacgtgtcctccaatgactggatcactttcatgcctctgtttaaatcctgcatctgctcaatgtcttcggcgctcaggctgctgaatttctcataggacactttcagtgagctcaaagatgtccacctctgcagggtgtgtgtcatcgctgctgctcagcaatgcacggaggtgcgggatagtgaggagagacactctgcctgttgaccacattatccaggtatctgcccagcatggtcatggcctcgccctcgtcgctgcagcccagcagctgctccatgttggcgcccatgacggacagggccacctgcaggatcacc

SEQ ID NO: 726072 - DNA, 132 bp, Homo sapiens
acatcgatgatagccacctacaggatgctgctggagcgcgaggagagcaggatgtctctgcctctcccaaactttagctccctgaacctgagggaaagtaatcgggattcactccctctggtagatacccac

SEQ ID NO: 726073 - DNA, 795 bp, Homo sapiens
gcctggtgtgattccgtccgttgcgcggttgttctctggagcagggttcttttatctccgtgccgccttctctcctacctatgtgcgtgcccgtatcccgatgaaagattcgatggacgatggacatgagccccctgatggccccagaactatcttgtacggtctgtgaactaaaggccgagcaagagattatcacttgtaaggtggtgtaaatgactgaaaatgtagcaccagttgatcttgtaagacatcggtcagttccaggggctgtgtgcaaagtgctgagtttgcctccattgttgaaagcagatgggccatgctacttacggaaggtcagtgccaaattaatcgtaagcactgggggagtattgaacagattgtctgtacggcccaacggtatactcgcttggggggcttccgaatatgatcgagccaccagtggttcttgaaggtagactgtggtcggtttcgagggccggtgcattatgagttggacagcactttagtaggctgtgagatggagagatgcggatgtccaggacaggattggaccgacggccggagtggattgttgaaagctcctttaagtactatctgcgaccaggcgggtctagtccccttggaagggttggtaagcaatggttccccccaggacaaatatgtaaccaacttttgctctgctttgatggaacgagtagattgcggacttgattgcattgaaagacggattggattgttgggcacgattgggtgactgatgcaagaactttggacggagattagggaagcttacag

SEQ ID NO: 726074 - DNA, 442 bp, Homo sapiens
  misc_feature (167)..(167): n is a, c, g, or t
acatccattcactcacattcatgcacatacactacggacaatttagttcatcagttcacctatagttcatgtctttggaatgtgggggaacctggagcacccggaggaatcccatgccaacacgtagagaacatgcaaactccacacagaaatgccaactgaccctngccgaggctggaaccaacaacttttcttgctgtgaggtgtcagtgcttaacgactgagccaacgtgctgccctaaaatgtttcagacatgcagtttaaagagtcaaataatgcaaatcatagatcattatgaggcagttttgatgtggatcattcgttctttatttccctcacaaatgtctttaaatcactggacaatgctttgagatctgttaaattaataatgctcttttgtatgttgtgaaataaagtcctgaggagaaatgaaaaaaaaaa

SEQ ID NO: 726075 - DNA, 802 bp, Homo sapiens
  misc_feature (40)..(40): n is a, c, g, or t
  misc_feature (105)..(105): n is a, c, g, or t
  misc_feature (131)..(131): n is a, c, g, or t
  misc_feature (133)..(133): n is a, c, g, or t
  misc_feature (165)..(165): n is a, c, g, or t
  misc_feature (208)..(208): n is a, c, g, or t
  misc_feature (219)..(219): n is a, c, g, or t
  misc_feature (248)..(248): n is a, c, g, or t
  misc_feature (252)..(252): n is a, c, g, or t
  misc_feature (258)..(258): n is a, c, g, or t
  misc_feature (261)..(261): n is a, c, g, or t
  misc_feature (295)..(295): n is a, c, g, or t
  misc_feature (306)..(306): n is a, c, g, or t
  misc_feature (310)..(310): n is a, c, g, or t
  misc_feature (320)..(320): n is a, c, g, or t
  misc_feature (346)..(346): n is a, c, g, or t
  misc_feature (348)..(348): n is a, c, g, or t
  misc_feature (353)..(353): n is a, c, g, or t
  misc_feature (358)..(358): n is a, c, g, or t
  misc_feature (362)..(362): n is a, c, g, or t
  misc_feature (364)..(365): n is a, c, g, or t
  misc_feature (367)..(367): n is a, c, g, or t
  misc_feature (370)..(370): n is a, c, g, or t
  misc_feature (374)..(375): n is a, c, g, or t
  misc_feature (390)..(390): n is a, c, g, or t
  misc_feature (395)..(395): n is a, c, g, or t
  misc_feature (399)..(399): n is a, c, g, or t
  misc_feature (403)..(403): n is a, c, g, or t
  misc_feature (408)..(408): n is a, c, g, or t
  misc_feature (415)..(415): n is a, c, g, or t
  misc_feature (420)..(420): n is a, c, g, or t
  misc_feature (425)..(425): n is a, c, g, or t
  misc_feature (429)..(429): n is a, c, g, or t
  misc_feature (435)..(435): n is a, c, g, or t
  misc_feature (443)..(443): n is a, c, g, or t
  misc_feature (455)..(455): n is a, c, g, or t
  misc_feature (469)..(470): n is a, c, g, or t
  misc_feature (473)..(473): n is a, c, g, or t
  misc_feature (476)..(476): n is a, c, g, or t
  misc_feature (479)..(479): n is a, c, g, or t
  misc_feature (482)..(482): n is a, c, g, or t
  misc_feature (486)..(487): n is a, c, g, or t
  misc_feature (491)..(491): n is a, c, g, or t
  misc_feature (506)..(507): n is a, c, g, or t
  misc_feature (511)..(511): n is a, c, g, or t
  misc_feature (514)..(514): n is a, c, g, or t
  misc_feature (565)..(565): n is a, c, g, or t
  misc_feature (572)..(572): n is a, c, g, or t
  misc_feature (578)..(578): n is a, c, g, or t
  misc_feature (584)..(584): n is a, c, g, or t
  misc_feature (601)..(601): n is a, c, g, or t
  misc_feature (605)..(605): n is a, c, g, or t
  misc_feature (790)..(790): n is a, c, g, or t
cccacaaccccagccctagttcaaagctggacacattggngctcaaacagctgcctctcaccacgaccggaaatgctgacaaatgtgtatatattatcaatcccngggggcttgggtttaaaataaaattncnttattgcgggtctccaagtccttaggatttgnccttaaaggtactagaagatgagtaagaccacacacaccaagnctatgtttagnctttagagtaaactagcaaatggccagtntgtnctaggntgnattgcatcagacatcacagtacatgaagaaaatntgctttttgtnaaangccaccaggnattttagatcccgtttaccatgaggngnggggngcggngggngnncnggngggnnggtgagtggaaaggnggagngggngggngggcnctttggnggggntgggnacgntgcaangggggggngggactgggaantggagggggagggnnatntanaanggngtgnntagnaaagtgacttgaaannggtngtnaaccacttcccagggatccctcccctctcccaccaaaacaaacaaacaaanaacaacnacaacnaaaacnctgggaattatcttganagtnaagttaaaactatgtggtggagaagagagtgcttgttccaggtaaaggacttcaagataatttacaggcagatttatttttattagtaaaagtcacaaataggaaaagacttattggctgactttgagctgtgtgcttttaaaaatgtctctattattacgttaacaagaaaaaaaaatcaagcnagtttttgcttc

SEQ ID NO: 726076 - DNA, 1127 bp, Homo sapiens
  misc_feature (343)..(343): n is a, c, g, or t
ggcccttgctccggacgaatgccccttgcatcctcttcatcgatgaaatcgatgcggtgggaaggaagagaggaagaggcaacatttggagggcagagtgagcaggagaactacactcaaccagctgctggtggagatggatggttataatacaaacaacaaatgtcgtcattttggccggcaccaatcgaccagatatcctggaccccgcgactgattaggcctggggacgtttcagacaggcagatcttatattggaccaccagacataaaaggaagagcttctattttcaaagattcatctccgaccgctaaaactggacagtaccctggagacaggcanaacattggccaagcaacaactggcatctttaactccagggttttcaggatgctgatgtttgctacatgtctgtcaatgaagctgcgtagattgctgcacaggcatctgtcagattccatacatcagaaacactttgaacaggccattgagcgagatgattggtaggcttagcagcaagcaaaacgcaggttctgcagcctgaggagcacagcaagactgtggcataccacgaaagcaaggccatgcggttgccggctgatatctggagcacggcagacccgatattaaagggttatccatcatcccacgtgcaaaggactacgtatgctcagtattacctacagaccataacttctaataccaaagatcacatcctggatacgacacgtatatgaacttacagttcacaaaaactctgaaaaaactcctacattgacacacttcaccacatgcattctcacacatcacctaacaacagtaacaaacaattatattccataatgcacaaacagcatcataacacctagcaaacccaattaacaccaaatagagacagataatacaaaaaacaaacacatcaaaaaaaaaacagaaagagatataaggaagagaagaaagtaaaaacaaaagggcacagacaggcagcaacaaggatacaaagcgtactacacagcgagagacaagaagagagtaaatacagacgagagaaacacaccaaaagatagcgctagaagagaaacaaaatgacaaaacagatgtagggagatataaaataaagaacaag

SEQ ID NO: 726077 - DNA, 160 bp, Homo sapiens
agaatcgagcgtcggtaccagatgagcagctgaacgttgacggaggtcgctctggatcgacgaagctgatatcacacgtcttgggcaggttcagctcgtttatgtccttctggatccgcagctgcgccgcggacgcttcttgctgctcgccttggtgccg

SEQ ID NO: 726078 - DNA, 258 bp, Homo sapiens
  misc_feature (107)..(107): n is a, c, g, or t
  misc_feature (133)..(133): n is a, c, g, or t
tcaagaacaacataggcatatactatatcatgggcaccaattagcaatgatttttttaaaccagtttagtagggacaaaaagacatgtaaatagacaagtgcgaaantacgtccatatgtggaacaaggtggntcgtgaaggaataagtaatcagtttgaactagaggcagaggaagtggccagaacatagggtgtaaataaggacccatggagaagtaacgctcaaaagctatctggccccataaaagacattataa

SEQ ID NO: 726079 - DNA, 955 bp, Homo sapiens
ttagtcataaacgtaccagcaagctctgcatctactggacaagagtattatgactttaaaaaccccatttattgaaaagtacctgagaaggcagctcacgaaatccaggcctgtgatcctggacccggcggagcctacaggaagaacttgggtggtggagacccaaagggttggaggcagctggcacacagaggctgaggccttggctgaattacccactgctttaagcaatagggatggagttccccagatgaggctcgcatggattctgctggtctgaaagcaaatcagatgctacgtacggagtgatcacactgacgtatcccaaggatgggtatcaggaaactaggtgggttacattggaaaacacatgaggtaccctcatttctctcatagacccaggcgcattccaggcagcatccaaacccacaaggcaaaaaaagagggactgtgtccttgcagcaatcgcgtctagaattgccaagtgaaattcttgcgcggggacaaagggccgccaggtgttactctcgcaccatggttccttcattttgcatggttggggaacgcttatgaatccaggagacggaacaagagcgtcctctaggtgagctgggttgtacttaaattccaagggacaggaatccccaggagtctcctgaacttccgtggcaactttcttattgccctcatatcctaagtcattagataaacattcttccaaaagacctcaacttcattgccaacctattctctggaaatattcccttgctgagagaaccagaggagagtttacgattaagaagacatgagaatgccaagcctttgactttcttctgtgcaaccttgatgggggagggtaattgtctaactgtaatttattcaatagccaactaaaaataaagcaaataaccaaaaatacaaagggagagacaaaaaaatatcagggacgagaaag

SEQ ID NO: 726080 - DNA, 204 bp, Homo sapiens
tgcggccttgatctcccgggtacaagtaatcctcccacctccaaagtagctgggatcacaggtgcatgccaccatgcccagctaactttttactttgttgtcgcaatgggtctagctatgttgccaggctggtctagaactcctggactcaagcaatcctcctgcttcaacctctcaaagcattaggattacaggcatgagtca

SEQ ID NO: 726081 - DNA, 127 bp, Homo sapiens
agaaatctctgtaaatcgtatcagataagggactacagtctagaacatataagaaaactcttacaagaaagaaagttgttaatggcacaggatgggaaagaaggtatacaagtggcatcgataaaca

SEQ ID NO: 726082 - DNA, 779 bp, Homo sapiens
tggcttccccggggtcggaactatagtgtggtggacccggatgactctatgatgtgtactgttatgctgaagacctaagatggagaactgttcctgggcttgaccctccagagaagctgacattggaggaatgcacgggacgtactgcaggagcggggtgcaagagattgccagcatgggcccaactgtatgcagcctgggatggtggcctggaccactgcatcccagggtggcgtagctgatggcagtgtgcgctaccccgattcgtcacactcacagcgcagcgacttgtggtgggggcttgcctggtgtcaagacgtctcttctctcttcccccaaccagactggtcattcccccaataagcacaggcgattcaacagtcatactgcattccgagactcgagtccagccttctgcgcatccctgtaggcctccagaacgcggaggctccaagccatggctctgatggacttagaggctatcgtcacagtgacagagacccttggatggaactgcaggctgcctcaggaaagccacgtgagagtgaatccccgtgagggccattgaagttccatcccccagtcatgggagtgacgcggaggaaggtggaaaagctccagttccaaaacggaacccattgagaggcccccttaggcacgctccctagactttggaaaccaccaattccctggtaccggccacggggtctcagaaggacggacgttaggcttgggggacgcagaacatatgagatgggcaaggcagaggcggaaaaaag

SEQ ID NO: 726083 - DNA, 332 bp, Homo sapiens
caaatcgccatgatgacaaaaatgagacggatggccttgtatttttcactggagcactattcacaataacaaagacattgaatcaaatgagatgcccatcaatggttgactagataaagaaagtgtcatacatatgtgccatggactactgtatagccataaaaagaatgaaatcatgtcctttgcaacaacatggatgaagctggaagccattatcctaagtgaattagtacaggaacagaagcccaaataccacaggttctcacttataactgggggctaaacatcgagtacacatggacataatatgggaacaatagatactgaagacc

SEQ ID NO: 726084 - DNA, 442 bp, Homo sapiens
ttgggggggagggaaggaagaactcagggtatgttaatatacctttacaattgctttcctgtgagttgtctcggcgggatctggaatcttactactgcatcttctatatagaagctgtgtgacttttaggtatagcagcattatgcttttatctatgggataactcattattataatatgaaatataaatgtgacttaattgatctttacattgaaatacgtgctaactgtcactgtccatagctgcctgctgagatgactatctacaggggggcactctttactgaagaaagtattgtgagtcgcactacctcagcactccttagactgtgtatcccggaactggtagctcatgaaccgtatgcttcccaattgacagggtactctcctgtctgagagacatacatgtctgtgagaccattcttctccagcatgagactct

SEQ ID NO: 726085 - DNA, 150 bp, Homo sapiens
tttggacgggctcgtgacctggagcccacgccagttacagaatgtctgagagagcagagctgggatacaaagacactggtacttaatagtcgggtaccacgtagtatactagtccacattgtcttagtagggttcacgttcaggtatcca

SEQ ID NO: 726086 - DNA, 1174 bp, Homo sapiens
  misc_feature (1)..(1): n is a, c, g, or t
  misc_feature (1143)..(1143): n is a, c, g, or t
nctacgtaagacatagagtgagaccgccattgatggtcagtgctgatctactagggcttctctgcccacgtgtctcggatctcttcgcttcgttctgaatgtgtcttcctgtagctcattcgctcgtcgagattgcgcgcgctgtgatcgcggtgcaggtgcgcttgctttgttgtggttctcgatcactaacggctagtaggtatctctggtccgacttctggaccggactgcactctgttttccggagcgtgcgtgcccagttgtcaggaagcggatgttcagtcccagctctgaagagaatgagccacagtgctgactatcaatcgtcgttgcgtcaatgtcaccgacgctccaggaagcattaggccgatcccattgccagccatctcttctcgtcgtctattcagcactcccagcctctgacttccttacctgtgacccacgtctctctctgaaatttctctgcagggcgtactggagaccaattcacacactatggatctctttcttacctgtgatgactgtcgtggactgcaaggttgtctactgcccatggtggacccactagctccaggcatcttagtatttgtcccccgtcctcatgcatcgccacaaagcggctttctctaggtgtggggagtactcctgaaaaggactgagatcgggtgcgtcctaccaagacagtggactgcaccaccctggtttttactaagaagcccacgctctgcgtgtccgagagcgactgcattcaattttagggtccacttggagtatcaagcggcaggctctcgagtcgatcttgtcgtgtgcacttttgaatcttctgctagcttctattctgccgatagcatgtgcatctcagcccgcatcaatatacttttagccacgatggatggatgttcatttatacacaggagtttctcaactccattcttcccttgctggactctgacacagactgctctcaaacagccagaagacaagggttgctactgagaaaggggagagacgatatatttcaaagagtgggcactgtaatgattttgctagctcctgccagcttgccttcctaaaatggcttttcccgccagctgatgccggatagctggtgataagatcagcttcttctatatcatgacnaaaaccgttcccggaagggagcgtcaccaga

SEQ ID NO: 726087 - DNA, 316 bp, Homo sapiens
cttaacgcgtagctggagcattcattcactgctaattcacgatggcacgcactgactcacagacgggcgtgttaagtcgctgctatgatcctgctgcctgattggggaggtgactgtcctactagaaccgctgtgaagaaccttgaacagtaacactccatgcaggcccagctgttgagggttttcttgatgaatgaatggggcaccatacatggctaagataaagccttgcgctccggactttatctgaggtgtctggagaagttctcctgcccctccacttttttgcatctactctcactaaatgagtataatg

SEQ ID NO: 726088 - DNA, 214 bp, Homo sapiens
ctcctcgtacgggcatcaagcaggaggggtagatggaggttggagttgctggtcctcttggcgcccctgtgtaccaaggaagaaaacaagaagccgtgaatagcataacccaactcccaagtgaggatgggaaatcctgcgttggaaaaactgacagaaagcacaacaatgcgaagatgaggagctggagcactataggtcgcatgagtccaca

SEQ ID NO: 726089 - DNA, 205 bp, Homo sapiens
tgtctactagtaggatccccggctgtgactatttgttgcattatacaacgtatctgtagaagatgaagggcagctttagttctataatacacagaggacttactacatgcgaggaacgtatttcaaacatgttacatatctcttttagatcttcacaaaaactttacgagggtagttattaattatctatccctagcttaacggg

SEQ ID NO: 726090 - DNA, 648 bp, Homo sapiens
gcgaattcactagtgattcggcccgcggcggggacgtagggctaagggagggggcgctggagcttccaacccgaggcaataaaagaaatgttgcgtaactcaaaaaaaacaaaacaaaaaaaaaacaaaaaaaaacacaaaaaaacaacaacacaaaaaaacaacaaaaaaaacaaaacaaaaacaaaaaaacaaaaaaaacaaaaaaaaaaaaaaacaaaaaacaacaaaacgaaaaaaaagaacaaaagaaagaaagaggaggggggcgggcgcggggcgggcggcgacacgagaagagagcaagaagggggaaggggggagggcgggggcgcgcgcggaacggggggggggaggggggcgcacacgtgcaggaagaaggagaacggggagagacgaagcagaaacaaggggtgggggcccccacaacacaagaaaacacacagcagacgagcaggggggagagcggcaaacaggggcggggacgagagagacaaaaaaacgacgacgcacggcgagggacgggcgacggcgcggcgaggggacaacgcggggaggacaaacaagacagcaggaccaggcgagcgccccgcgcaccgagacgccaccaaggacaggacggcccccgccgggcgggggggggggggt

SEQ ID NO: 726091 - DNA, 117 bp, Homo sapiens
gttagatagcagcagagtttcactcatatcgcccatgctgaagtgcatggaacgatatcggcccacagcaacatccgcctcccaggctccaacgaccctcccttctgtcgtcttctc

SEQ ID NO: 726092 - DNA, 936 bp, Homo sapiens
agatcaccatttacagctggttctcagtgctcttttttttctttgagacggatctagctccaccgcactctagcctggtgacagagtgagactccatctcaaaaaaaaaagaaaaaaaagaaaaatactgatgcctgggctccagcaccctgcatgcctagtctggatttaagtaggagtgaggcgtgggcgcctagatggatcgaggaagcctcccaggtgattctaatgtgtagaaatgttgagatacagtccttcagctacatagtgttcaaagcgtggtgcgtagatcagacatggacaatctcaaagcaccccagccttgctgaatcagcccctgcctcttaagatgcctctgatgattcctttcacaaagcttgggaagcagctttctgtcggcccagtgcctagccttggagaccacctctccatagagggctaccaggatctccttcagcactgcggaagagtgggccccagggcatgattaggagaccccagtcctttcagaatgggtcaacaatagcaagggagtgaagctcgaaggacaagttcaggcttgggggaactcatggttcagaatggctcccttccctgggttgctgcctctaggctgttctggaactgcagtgattcattgtgcttttgagttttggggctttcatctcactattgctggatagtctgtcagagttagaagtggaatgagtcgaggcaggccaggggcctctcccttgctgctgggaagggccagcacattcctcgttcctatgatgaagatgcacgtgtatacaataaccaccacatttcttggtactccacttaaaacatgtaaataacccgaaactgttactccaagtataatgtgaatacagcttggcaaggaatttaatatttgcaaaactataaaatgttttgtaatataaaaaaaaaaaa

SEQ ID NO: 726093 - DNA, 1732 bp, Homo sapiens
gtctaatgtttgtgctatttgttccgcagtgcagtagtgtgttagtgagtttattttctaagttctatttgttttttgcgtctgcttttttcgtgaattgtctgcatttgatctttgattattgtttctcccgaagataaacttatcctcttgtgtgtgttgggataccatctctttgtggtggtggtcccatacgtactattagtgttgtggtgtatgagctcaccatttttgtggtattactgcagaaaagcagctaccgtgctgtatgttattatgcgtctcctcgcgcggcggcggtgtgttcgttcgcctctgctggtgttttgtgtgtcgcttccctgtgctgtgtggttgtgtttctttgtggtgctccggccttcggtggtgggtgctgtgtattgtaggtgtatcctctcgatgtgtgggggtgtttcgagcgcgtcgcgttgtggtgtgtggtgtgggtggtgtggttgcggcgtttgctctcttctcttttcgtgtcggtgggtgttgatgtggttgtttcgtcgctctggctctgtccgttgcctcgcgcgcgcagccgtgtttgttgttgtttgtgtgtgtgtattgttgttctcgttgccattggtggtgtgtagttctgtgcagagtggggctgctggcgcgtgagttgcgtcttcttcacgtgtgtggtggtagggtgtgcggcactactacatctgctccgcatgtgttgtgtgttgcgggttcggtgccggccctcctcccctcccctcctctctgcgtcgctgagtttgtttgtgttgtgttgggcgttctgcactctcctccgccgggtgtgtagtggtgcggtgtctgctcccggccgtcgtgctggctgaggtggtgtttgtttatcctcttcgcttgcacgttcagctctgtcgtgagtgtgctgtggggtggtgttggtggtgcttgctgttgtgtcgcgtcgccgctcatcgtctctgctccgtcgctgcttgcggtgtgtgtagtgggtcgctgctccccctcctcccccctccctgcgtgggttggggtcgtgggggggcgcggctgtcggctggtggtgttgtgtggtggtgggcgtaccgcacggcactgacaacatacgcagctctgtactgctgtgtgttgtgcgcgacgcgcgcccgcgcggcgcgcgtcgctcctccctgctcgctgctggtcggctgttgtgtgtgtgctgctctcacacgcgcgtcgggcgtccacacccagcgctccctcctccgcgcgtggaggtgcgcgcgcgcgcgctcgcgtgctcacagtgctgcgcgtctctcctcgtcgcgtcgtgcgtgtgtgtgtgcgtgtggcgtggtggctggcgggcgcctcctcgcgcgcgtcgcgcgtcgtgtgtggggtgtgcgtgagcgcacccacccgcgcgcgcgctctcgcttctctttctcctccctcccgctcctcccctccccgcgcgcgcggaaggtgtgatgttctccacgaataatatatctcctcgcgcgggtgcgccccccgccaatagttatgttgtgtgtgggtggccgccccccccaccccccccacccgccccccccccccccaccacccgaggcgccgccccccccggtcgggtgggggggccccccccccccccccccccccccccccccaccaaaactcccccccccctaaaaatatccggtggtgggggggggccccccca

SEQ ID NO: 726094 - DNA, 449 bp, Homo sapiens
cgctgcatgccgagcatcccccctaaagatacaaaccctcccccacgcatggtgttcataacccggcgtgttcccctgttagccacttcctctctcttcacaccctgcactcttgctggactgatctacttgcagtttcttgaatctgcaatactcccctctttgttgctttgtgtatggtgctatttccgccgcaaacacctcctgttggttaacaccttttcagacctcaagactcagtcaagatgtaacttccagaaagccttgactcagcctacgactagttcagatcagtaacacttctctggttttctcttttctcacagctctctgtgagtacttgaacataatacttatcacataggattgtagctatctgtttccttgttgggtcctaccactagatagggagatccttgagggtagggactgtgttttagtctcccttg

SEQ ID NO: 726095 - DNA, 408 bp, Homo sapiens
ctaatccctgaatatctgaacttcattagaggggtggtagactcggaggatctccctctaaacatatcccgtgagatgttgcaacaaagcaaaattttgaaagttatcacggaagaattaggtcaaaaaaatgcttaggaactctttactggaactggcggaaggataaagagaaactacaaagacaattctatgcagcagttctctaaaacccataacagcttggacatacagcgaacgactctcaaaaatccggaagaagtctttcagcagctagttacaggtactacacatctagcctctggttgatgagtcatggtttctctacaaggcactacttgcacccagaatgacaggagaaccagaacacatatctattatatcacaggtgagaccaagggaccaggg

SEQ ID NO: 726096 - DNA, 339 bp, Homo sapiens
  misc_feature (1)..(2): n is a, c, g, or t
  misc_feature (84)..(84): n is a, c, g, or t
  misc_feature (116)..(116): n is a, c, g, or t
  misc_feature (127)..(128): n is a, c, g, or t
  misc_feature (246)..(246): n is a, c, g, or t
  misc_feature (267)..(267): n is a, c, g, or t
  misc_feature (325)..(325): n is a, c, g, or t
nnggcacgagcattggctggcggcggtttgccagaaatcccaggtttgcctggcggtgacaccggtggcgagacaccagcaccntaatccagaagccggtccgattgaaagcgcancccagcagttnngttggacgttgctccaatcgagatgatccaaccattggtcagccaattgaagatggcatcatcactggtgctgctgcactggacggcctgctggctggcggaatcccgggcggtgacnaaggtcttgccctatcccganggaatccggtctgcactgacagattctggttggggttggcaacaggcctcttcaattnggggcctcaacttg

SEQ ID NO: 726097 - DNA, 524 bp, Homo sapiens
  misc_feature (66)..(66): n is a, c, g, or t
  misc_feature (201)..(201): n is a, c, g, or t
  misc_feature (520)..(520): n is a, c, g, or t
aattaggatggaaaaaacggatttaaaaattaggaaaaggattcaaatccccctaccctggcccanagcacccaaatgccccaaagagcccactcatcctgtaagagcttgcctgtgcctgcctgggcgggaatcctgcaaaccctggtaccctgtaaaaggaataggtccttaaaggtcccctactatggttgagagcangagaaacgaaggtttcccctgggtcattaatatccatggatcacttcacctaaaataaattgcaagtagggccgagtgtggtggttgacgcctgtaacttagctagcactctgggattacaggtatgcgccaccatgaccggctaattttttatttttagcagagatagggtttctccgtgctggtcaggctggtctcgaactcctgaacttaggtgatccacccgccacagcctcccaaactgctgggattacagttgtaactaccgcaccctggcagaaaccccatctcttaaaaacaaccaaccaaccaaccaacncaaa

SEQ ID NO: 726098 - DNA, 1905 bp, Homo sapiens
gtttaaaaacagaaacgaagaaacgtgacaaagtggagccaggagcaaggctactgaaggcgcagagttctcgtgcatacattgcctgaaaacaaaaacgtatcacaaaagtctgcaataaattgcaaccttgcacactaggtcatcggagccttacacgaaaaaatacttctgcgaggacttcgtgccagaacaagctgggctgttcaacctcaatactggcgtcacccttgttactggatcttggtaggcgaaggatactttcatctcgaaaacaagattatataagtacctcagttgtatcctttagaaaaccttcgtcttctttaacctttacatagttcactatggcatgcttattcccattgcacgtgatacatacccagatgagatattgagtttattttagaggtgcctcgtctattctgactatttaggtcaactagtgttagatttagctggtataacaggaaactgttcttatgcttaggagatacatgctgaaagatatttggggaataaaagtgtcagtgagatgcttggtaaccttttcgaaaggcgtccaacaatcgaacgacacggatcgatatgcgcaacgtattcatgttccgaggcaggttttaccctttttaccaattttacatgacagatttccaagaggttccggacaggctcccggctctgcagtttgaaaatttcgctaataaacagcggtcgacccgctcttggttcaaccggattccgctagttgccggcacaggccctcgatggaggttccgaccaggtcccaactataaacgcggggggggggcaccccgatggcgagaggtagtcggttgtcgtctacacctcaaatagacatgatatctttgcttccttcttctctttctctgacagacagagaaaacagaacacagtgagaggatagcgacagagagagtagagcgtgcacgcaatacgatggacagcaccaagtatgcacgacggcagggagaacgcaggagcaaggcgggggctcgaacgccagggagaccgcgaggacagatagcacgagagcaggaaagggagacaaacgaagagaagacaaaagagactagcgagcgcaccgagccaacagcgcacaggcagcgcagcagagccagcaagcaccacagcaagaggcaagaaaacagcagaactaaggaagacccgacggcaagagaagagaagaggcagagacgaacacgacacagaagcgaccgcaggcagcacacaggcagaacgacgcgaccaccagcgacagcgcacgcagagcgagcgagaggcagacgcgacagagagagcgcgagaaagaggcgaaacgcaagcaagcagacacagcgacgcacgagaccaagacgaggagaagaagcagaaccagacgacacgaagaacggacgagcggagaaaaacagaaagaaacaaagcaaaacagaccctaagggacggagaggcgcgagaagacagacggacgaagaagaaagcacgagcagacaaacaaacagaccaacgaaacccacgacgacgaagccacacacccacacacagacagcacaacaaaggaacagaccagcagcgagaggacgaggcgagcagcacgagagagcagaacgcgaacagcacagcgggcgagaccgagaccaccaagaggagacgaccacagagaacgcgcacaaccaagaagcgagagccagacacagagccgagagcacaccaggaacacccgaaccaaaaagaaaccaaagaagagcaacgacgaacggccaagaaggagagcgcaacacaggaagcagaggaagcaagcgagagacaaccgaggcagaccggcgaagcaagggaggacagccagagcagagaggaacagagagcagcagaacaagacagaag

SEQ ID NO: 726099 - DNA, 252 bp, Homo sapiens
gcaaacccccatgacacaagtttacctatgtaacaaacctgaacatgtatgtacccctgaacttaaaagtgaaaaaaataaaaaatatatatacacaggtcattataatataaatgatagtgcttgcataatagacggtacaccgtgtctatgcaatgcaaaaggaggttgccttcatggggaagatggtaatctcaggggaggctttagcacgaaaatctgtcataattattggggacccagatttgtagt

SEQ ID NO: 726100 - DNA, 310 bp, Homo sapiens
  misc_feature (106)..(106): n is a, c, g, or t
  misc_feature (158)..(158): n is a, c, g, or t
  misc_feature (230)..(230): n is a, c, g, or t
  misc_feature (264)..(264): n is a, c, g, or t
  misc_feature (291)..(291): n is a, c, g, or t
tggtcttgaacttctgggtcttgaacttctgacctcaggtgatccacctgccttggcctcccaaagtgctgagatgacaggtgtgtgccactgcatccagcctgtnagaggcatttaaaccagagcaactctatcttgagtaggggctaggtaaaatnaagctgggacctgagctgcattctcaggagattaggcattcttagtcacaggatgagataggtcagcaacgntacaggtcacaaaggccctgctcatcacaaaaantgcaagaaagtagctgttcaaacccgncaaatccaaggtggcaatt

SEQ ID NO: 726101 - DNA, 477 bp, Homo sapiens
tcactcagtgctgtaggagaacaagagcaggtccaaatcatatgatctcagaggaatcaggaaatgtttgagagacaactgattcaaaggtcggcctgggaatggaaataccacatgagaattgatgtgcgagatcaggcgccaggcatggatggtcatcttgcctgcttgactataagttaaatcctggcgacagaagtaccgatctctcaataggcaatctcaggtcatctgctggcctctgtcaagtactaaacaatggatgctccgagtaggaaggctgctacccaattatctaatcaggagtttacaaatggttctaggcccttagccaggatagcagagccagtcttatagttgtcatgtctgcagtgagccccagcgccctgcttctccaccctctgccctagaaccaatgtatcacagaataactgttggttcagcaacaggcttcatctgcacaggaggatatacaac

SEQ ID NO: 726102 - DNA, 275 bp, Homo sapiens
atcgagctcggtccagcggacacgcactgaagagactcccagtctgggttcactgttgactggactggggtgaactgggacgatagtattcctttccgctgtagatttttttttttttggatcagcggtagacttttatgaaagtggctgggtgcccaccaaatagaaggctacatcgggttggtaatgtgtctaaggtgcagaccagcccatggcacaaagctgtcccctcgggtttggctctggctcggtgtccagggtggctggtcccgcgg

SEQ ID NO: 726103 - DNA, 674 bp, Homo sapiens
cgatggtaggcggcggcggggtcggcggtgtgcctcctgtaagaatgccaaccccctcatctaccagcgctctggtgtgagcggcctgtgactggctgtgctgaggagtgacgagcatgtgttcccgacagcatcgacgcacgcgagatcttcgatctagatatctgctccatcaatgacccggagcatccactatgactgctatgagtgagtattgaactgtagtagagcaggtgcgggttcaggttagctgacccctgacgagtacagtggctgtgtgctttcacaccaaccattccgcactgccagcatggccacgccttatatggtctagtaccatacaatggtacaagcttactgctgctcccttcctacagcgtattcaaagatggactgtgcaacatatatctaccggggacccatgcctcagagcatgcagtgaacaagcaacttgcatgataaaggagcgggtaggcagctgccctggagaaacacccacctacttgcgagcgttgtgaatacagttgccttgtcatgccgctgataccttgagcctaggcttttggacccctacatgcctgcatacatggtattcctggacccagcttcctgccagtgcttgtaacctgttgatttcttgaatcactcacactgagaaactaacatttaggcaa

SEQ ID NO: 726104 - DNA, 501 bp, Homo sapiens
gcgggtataagatctttcttgccacgatcggtggtgaatgcgtgcggtcagtgttacttgcagcagtagtcaactcgtctgccggcacggcgtgattcagcctgagcgcagcctgtcggctgtacgctgctctacgagggggcatggagcccatgcagatcgacgtggacccccaggaagaaccgcagaatgcacctgacgtcaactacgtggtggagaaccccagcctggatctggaacagtacgcggccagctacagcggcctgatgcgcatcgaacggctgcagtccattgctgatcactgccccacgctgcgggtgcaggccctgaagatggccctctccttcgtgcagagaccctttaccgtgtacatgtacgaggagatccacccgcaagctctcagaggccaccagggagctgcagaacgcacccgacgccatccctgagagcggcgtgcagcccccagccctggacacggcctgggtcgcgcgcacgcggaaa

SEQ ID NO: 726105 - DNA, 1055 bp, Homo sapiens
  misc_feature (70)..(70): n is a, c, g, or t
gggactaattgggcctagggccactacacagagggagccgagctggtcgagctcggtccgggatgtggtngaaggaaggagtcagaagagcttgggactggtgctccggagaggcttgcgcagggctggcgccacgtgctctgggcgggtgcggaacggggtccggcgatgggcaccctgctcatcagctaggatgccgggaagatgtacgcctgaccggggcatgaacagcttcagtggtcatggcgcctcacctcgagatggtgtcatgacgagtgggtggtgtgagccctagcaatcgccagcctctcggtccaccagctggtggaaaacacagatgaaacgcgtactccattgataactgaggccctgtatgacatctgcattccgcaccctgaagctgaccagccccagctacggggacctcaaccagctggtgtcggacaccatgagcggggtcaccagctgcctgcgcttcccgggccagctgaacgcagacctgcgcaagctggcggtgaacatggtgcccttccctcgcctgcacttcttcatgcccggcttcgcgcccctggaccagccggggcagccagcagtaccgggcgctcacggtgcccgagctcacccaggagatgttcgagtccaagaacatgatgggcgctgcgaccggccacgggcgtacctgacggtggctgcatcttccggggccgcatgtcctgaaggaggtggacgagcagatgctcaacgtgcagaacaagaaccgcagctacttcgtggagtggatcccaaaaagtggagacgggccggtgcgaaatccggcccgggggcggacgatgtcggcactcatcgggaacagcacggcatccggagcgggaaggccatcccgaacagtcgggcacggtcgggcaaggccccggcggccggggcaggctgcgcaagggtcacccgacaacacagaagacggggcaccacagcacagaacgggcacacggcgcagcagcggagcgcacacacaccacgcaccacagcgcacggacaagcacgagagcgaaacagag

SEQ ID NO: 726106 - DNA, 121 bp, Homo sapiens
cctcatttctattctcctcactcctcccgcattccttctactcaccttaacctccagcaccacgccccttctactatctcgcacctgtatcacaagctaacatgacctgcttgggctgttt

SEQ ID NO: 726107 - DNA, 1604 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 726108 - DNA, 668 bp, Homo sapiens
acggaccatgcagagttattcttggtttctttaaagccatattcaaacattcaaccttgggccctaaatcgggtcctttttaagttcacaagccatgaatcttccagttttattacctcacattccaatcctttaagcaagacttctcctatgccatcagcatgtatatcatttcctaggaatttgatcttcctgtcattctttttgggtacaacggccctttctgggttctcaaagctctagtttcttctaattctggatcatcgcaagtctggccctctttgaactttaaaacataatgtctaattccaccccaattttcagcatttcttcaactaaatcgataaagctgtctccattatgagaaaggccagaataatactccgagtaagcataagaaagctggtcattttacaacttctcccgactctaggaagtaatatgatgccatttgttgagcatctacagtgtgccaagcacatggttcatctctgcaaactgctgctacattctgtaaagcaagtattatccgcattttagggattaggaacagcttcctgatctcttgccaaaagtcacagctagtgagtggtttaggcaagatacaaaccctagttagttaatccttactcagaagtgtataggactatgatacattgtctcagctt

SEQ ID NO: 726109 - DNA, 614 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 726110 - DNA, 1751 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 726111 - DNA, 697 bp, Homo sapiens
catctaaagagccgcggggcctggccaccatggcacaaccccgtctctaccggaaatgctgaaattagcctagtgtggtggtgatgcatgcctgtggttccagctactatgggaggctgaggcaggagaatcacttgaacccgggtggtggaggtcgtggttgagctattgtgccatgcactccagtctatgcaacagagtgagcacgctgtctcaaacataaatcacctcaaaataaatacacatcaacaatcaaaatacataacagagacctcaagcagggggccaagaaagatgtcccctcagcagatctccaggatttacacttttcttttcccgccgcaattctcccacttgcagagagcatagagggtggagcttccatctgcccatctgagctcctatttgtgtttacacccataatacatgcctacccagtctgtaattaatgaattgtcagtttacacttcatatctccacatgacccaggtatcctataccctcactccaacatggaggaataccacggtcaggacatgactcctggttattatcaataaatctaaaaaaggggggcccgacaaagaattaaccattcaaaggggcacagtaactaacatcagtacacacctatctttgtacacattgatcataaactgaggccgattaatacgtcgacatggcgacatatcaaagt

SEQ ID NO: 726112 - DNA, 264 bp, Homo sapiens
aaaaaaaaaaaaaaaaaatttttaaataatttgggggggttttttgcccaaaaaagttttaggttttccccccttcccccccccccggggggggggccccaaagggcccttaaccccaacccctttttccccccccccccctttccccccgggggggcccgggggtgtcccttttttttttttttttttggggggtggggccccgggggggggggaattcccccttggggaaaattttttgggaaaaaaaccttttttttttta

SEQ ID NO: 726113 - DNA, 1501 bp, Homo sapiens
tgagcattaagcagtatctcccagcattgttagctactgagtggcacatcttcagtacgcatgattcgtgggggactcaggcagaggtaaaagtgtgaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 726114 - DNA, 1680 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 726115 - DNA, 188 bp, Homo sapiens
cgcagcatctagtgtcgtactactgagcacgctactctgcactcgcacctgactcagcactttgtacactggctcagcagctatatgtttacacatcatttaaatgttcctgctttgtaattcatgtaatagagatgggtggccactgtacagatatttattacgcttgagatccacattaaaggaga

SEQ ID NO: 726116 - DNA, 266 bp, Homo sapiens
gtcggcccaacttttgtctcagctcaccaaggaggagcgtgatgtgacacccccatccagcttcagtgagctgctggctgctggagacagccctgggtggccagtgtgtggacctgccaggaggtggctgagatcacaaatgcagctgccccctggtggtgcctgtcagcaagcccgtgtgcccttctgtcgctccctgtccctgctccattgtcccatggacagcacatgagcaggctcgagatgggacttgtgcacttgtggct

SEQ ID NO: 726117 - DNA, 1090 bp, Homo sapiens
tgtggagattttttttttgggggggggggaagcccccccgcgcccgcgcgacccccccgcgcccccccggcgcgctctctctcaaaaaaaaacccgcgcccccagatttcacaaaacaacaaaaaacaaaaagctcaaaacccacacgaccgcaaaaatattatatacacaaaaaagaaaaaatctctctctcttattttacatccacacacatactatatatattcctctctctctctctctctctctccaccccctctctcccacacacaaaagagagcgcgcgtgatatatactctctcacacaatagatatatatatttctctcacacaacacacacaagagcgtcgggtcgctacatactactactctctctctctgtgagagatatattctatatttttctctctctacactactactctcacagagagagagcagcacacaaagaacatgtgtgaggcacacacactaagagagagagagagtggctctctctctctctcacgcgcgcggtggtgtcgcacacacacacagtgtgcgtctactcacacccgcagcagagtagtagtatacacaaagatatagtgtgagagagagagagacacgacactctctctctcctcatcacactctctctcctgtagtatatcgtgtcacacacccacagagagatatatatattcagcagagtgacgtcgaaacaccacaaaacacagagagaggtgtgccgacgactatagtgtgagagacgagacgaagggacagaaactgcgtagacgccaccaccaccctcctccgcagcagagaaggagcaacacaccgcgaagaagagagacaccactctctctccacacaaacagagagtagtccatcgctcagctgtagatgtacaacaacgagagtgttgtggggcgacctacaaccacaacagctgtgatatcaaccagatgagagagagtcgaggaacaaaaattctctacacacaccacaagatgtgtggcgccgctgtcgccgggaggagaatgtttcgtcgaggcaacccccccccccccctgtgtgaaacacacttccccacaaaagatacat

SEQ ID NO: 726118 - DNA, 1348 bp, Homo sapiens
ggtttcttacaaaatctgaagcaggctggttgatcaccttctgggttgcagatatgccacaccaaggttgcccaggcaagataagagagagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 726119 - DNA, 219 bp, Homo sapiens
tggccgcatcgacatttattattggttaagctgagtaaaggatgacaaaaaccaattgtcgaaagaaccaaaaacatctaatgcaaaggataaaaatgttcggccattctactgtcatctggctgtcacgctttgaccaaagccaaagtgctccttcaagcagttttttctctgaagagagtttagaagcagcagaaggagcttgatataaaaagtcac

SEQ ID NO: 726120 - DNA, 1447 bp, Homo sapiens
tgagcattaagcagtatctcccagcattgttagctactgagtggcacatcttcagtacgcatgattcgtgggggactcaggcagaggtaaaagtgtgaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccgctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 726121 - DNA, 1642 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 726122 - DNA, 1844 bp, Homo sapiens
  misc_feature (17)..(17): n is a, c, g, or t
  misc_feature (30)..(30): n is a, c, g, or t
  misc_feature (37)..(37): n is a, c, g, or t
  misc_feature (1766)..(1766): n is a, c, g, or t
  misc_feature (1768)..(1769): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcagaaaaaaacaaaatggncnnattggcccccgcgatgcaactctgcgcacggtgcctttccggaggatgatccatgattcgcacgcgtgctcggtg

SEQ ID NO: 726123 - DNA, 1161 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaaagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 726124 - DNA, 220 bp, Homo sapiens
atcccctatactgttcgcgccaagtgtttgctattgaacagtatgtgggactctgtcgtgaatctcggagattgcagaggtcccatcagtctgaccttaccagttctaaaggatcctggggatcctgcagggtccaaatagcagacacccagcaggctggagaatgcaccacggagccgaggcatcctccgctgctgaatgccgggccgtggtaccaaca

SEQ ID NO: 726125 - DNA, 111 bp, Homo sapiens
tatcaagtatcaaggaagaaaggagagcttcaaatccatgaaggaacgggaagaattgcagatcaggtaatctacaaaccggactgtcgtggggactgggtcatgttctgt

SEQ ID NO: 726126 - DNA, 193 bp, Homo sapiens
aattccatcagagccaattttaaaagcatatgtggaaaataattattcttgctgtactttatgcaaataatcaggccaagtataagactaaagtttattttgcaaacaatcctattatgatttgtttttaacaaaaatgaagactggagagtttcaaaacttatcacacttgtcattaaattctagttttatt

SEQ ID NO: 726127 - DNA, 136 bp, Homo sapiens
aaaaagtcaacagtttgatgattgtagaaataaaacagttctataaattgttataatttttcaagtctaaagaagtaccagtacagaaaatggtcgaaaagtttctaagtaagtcatcatctttgtcggtttacga

SEQ ID NO: 726128 - DNA, 719 bp, Homo sapiens
  misc_feature (592)..(594): n is a, c, g, or t
  misc_feature (628)..(630): n is a, c, g, or t
  misc_feature (633)..(633): n is a, c, g, or t
atgcctacccgtctgactctgagcggacttcgccagtacctccccccggtacccctgtccgacgcccgcctaccaccaccagatgccacccccacactcggacactgtggaattctaccagcgcctgtcgacacgagacactcttctgtcatctttcgtactatctggagaggcactaaggcacagtatctggcagccaaggccgctaaagagagcagtcatggcgattccacaccaagtacatgcatgtggttccagaggcacgaggagcccaagaccatcactgacgagtttgagcagggcacatacatcgtacgtttgacctatcgagaagtaggggccagcggaagaaggaacggctctgcaccttgtgagtaccgctacctggaggaccgggacctccagtgacaccggcccctccctctactccactacaccgttgcaccccgtcatgactgatccccgctagcccaggtgagggccactgaccctggaagactggagggaggccaccaagccacggggcatcacaccctctcccaggaagcagggagggggccgggaggttttcctctcagccccacctgggggnnncgggggcgagggctgccccctcctcccctccacnnntgngggacattttttggataaacactattattcattaatggaaaatactttaatgaactacaccctacgctctcttactatgacacaca

SEQ ID NO: 726129 - DNA, 204 bp, Homo sapiens
gggaatacagacgtgagccaccgcgcccgggtgggatatatcacagtttaatcatccacctgtggaaggacctcggggttaacttccaatttggggctatgaaaaataaaacggcggtgaacatgccattttatatttccgctagccacggtacgcatgatccagtttctctctatcctggccatcactgggtgttagcacggg

SEQ ID NO: 726130 - DNA, 145 bp, Homo sapiens
cctgaaataatggattactagcacaagttggtcatgttatcaaccatgcacgaagaccaacagtaccggaatttttccttctgtctgtcctttgaccacatggtttatggtcttaccttgcatcttcagaggcatgctgaaaatc

SEQ ID NO: 726131 - DNA, 191 bp, Homo sapiens
gcctggcctgggtccaacctgtgggggcttgcccctgggcttggggctcccgtcccccctcaggggtggtttgcagcgctgtcagttcagtgtggaaagcatttttttttaagttatgggaacggttcctggggttgctttgaaaaaacccttccttacctggggggttttttataaattttcataggtta

SEQ ID NO: 726132 - DNA, 164 bp, Homo sapiens
tgcggtctcataaaaggtttggtctcgtaaaagcaattttttttccaaggacacagccctcaggagatccggagaagataggctcaaaacaagctctggtgatatgttgcccagggcaggttaacagttttcaggtacagtcctgtatcagggtgtggctaatc

SEQ ID NO: 726133 - DNA, 906 bp, Homo sapiens
gggaccctgcagcctcggagatgttgatgcctaagaagaaccggaattggcattgattaatctccttataaaaggataggagtcgatgtgtggccacagaaatgggatgtccgacatgcctaagtcgtcccggagactagtggagactaataatgtgcccaacacttcatgtcactgaatggcatgtagtctctcgacgtctcgtgactaggatgaaggagacgagttgcgcctggagatcatttctacctggtatcgcttaccagactgaggagtatccaggtatctccgtgattaccttcatctgcccccgtagattgtgcctgtcatcctacgccgtactccgtccagagactgtgcatgcctcggccgtaaatggctctggagggtgacgcgacctgacggattcactcacaactaggggaaggctagtacagtagatacctagccgtacggagtgctgtgtcgacctggttgctcgtacagaagatcttgatgtctggggctgtctcagcaaaccgaattccagtttagaggcggatttggtcgtggacgtggtcagccacctcagtaaaattggagaggattcttttgcattgaataaacttacagctaataaaaagggcgctgatagatagacggtgcccccataaagagacgccgcatggccacattcttgagggcgggcgaaccaacgcgtaaatgcgcgggcaaggtcgaaacaggttctccaagccggttttgttataatgggcaacgtccgggcgcccatagtgggacgcattattttcacaccgggtgatcctgttatattcactaacagcaaattcagatgcatgtgatctaatacctggcatcaatgctacaagtgcttcaaaatcgtgaacacgtaaatgcatgacgatt

SEQ ID NO: 726134 - DNA, 873 bp, Homo sapiens
tgcaagatggccggagagtgcagcagcacccctgagctgtcagtgctgttccgccgctggccgctgatgtgccctgcctggcctggctggtggagctactgccctggacggccagcagttgccctgctggtgagtgtgtgtgcttgcctgctggctgatgtgctgagtgctgggcctgctgctgctgtctggctgtcacatgccctgctgtgcatgatgtgctgcccatgtggctggcctgtgtgcccacgactgcctgaaatgcgcctgcttagctgtgtttgcctggcctctggatgtgcttccccctgtgtgcccctggctgtgctttggaacccgtgctgctgtgtgctgtggagtgctcgggcgggcggtccgtgccctgggactcgggtttgggcgaccaggaggtgccggtggcctgcgctcggacccggtgacttaaggagattaaaattaattttggttgctgttggttcttgaacaaataagttgagttcttttagtttgagggtattgccagtttttgaagggactgaggacggttgggaggttttatccgtaggaggataagggggaagatctttggggaaagggtcaggtagtttttagtagtagggaagagggggtgattgaaggccgtgcaggggagggtttggagggtcagcgttcgttcgcaggcttggcacgcggattaacgaggagtgcgacatggtaagggcaagttggggtatgggggcaagagcggttgaggccaaagcccagtgttcgtcgtttggagtcgacggttttcgcagtgtttcgaaccccgtaagcccacgtggagggaagagtcagggggaggtgggattgttgtgacctattgtcgggaga

SEQ ID NO: 726135 - DNA, 892 bp, Homo sapiens
  misc_feature (375)..(375): n is a, c, g, or t
gtgctggcccccaggattcccccagacaaactgtctttgtcaccacgtggggctcactttgttcatcaccttcccgcaacttccctagatccccgtactagagttggacagaccccttcggctacaggaaggcaggaggggtgagtcccctactccctcttcactgtggccacagaccccttgccctaccgtcctgggatctgagtacatagtagtggatgattggaagaatgcagtcacattagttgtccatgtgaggcccaagtagcccgggttggctcgccacctgaggattggcatgggtgcgtgcatccccactaatccctacttgttgctttccgacacttcagctcaatttccccctgtcctcagaantgggagctacactaataatcaagggaggctcacacctgccccgactcacaaaacccacccacatcctgatccatccctagccacccccaaagggttcctgggtaccaatatattatccatcatgatcgcacaaaaaggtaaccctcctgaaacagcttgctgtacgtgagcgccgcgtatcaattgttccacttctctcgatcatctcggtcacttagcttgcgtgcataccagggtagccaaagatgttcaatcctccattggcctcccctgttctgcccacggatcccccttccaccccaagaatacctcttgctggccggaacgacgggggcgtgccggcatggcagggcggggtggaaccgactaccccagatccacacgcgcaacggtgggggccctgcccctaagggatgcttgccgcccacagtgaggcacaggggggcccgaaaccaccaataaaaggtgtacgggcacaacatcctcgcccggtaaggaggagacgggacccaggacg

SEQ ID NO: 726136 - DNA, 347 bp, Homo sapiens
atatatatatgtatttataactggttacacgtgggattcataattaggcataaccagttgtagttggcacagttttggtatttaagctcagggtcaagttctgtttcattttgtcggtccaaagtacaaagagaaaataaaaatgaagggcatttgatctccatggtgtttacttaaatacaggaatgtcataggaaacagtatgtacagatgagcagagcctcctgacccctattctggctcttggagataggggctggggtccgatggaaacgggtcaatgcggcctgctgctggactccgaggcctgcctcttgcgtgaaggggtgtagccgttgagacagcca

SEQ ID NO: 726137 - DNA, 109 bp, Homo sapiens
gtccttacttccacgatcaccaaggtgtcaatgtccagcactgtgcaggcagcaacatctttgagagaacggaggtctggcagctctgattgtgggtggcatcgtgggg

SEQ ID NO: 726138 - DNA, 410 bp, Homo sapiens
cagttccgagtgctctaggtggacgtaggatggtaggttatggggtggagaggttgagtgtggtgtagggccgtcggttacgatataagagtagcgagataaggatgaaaaagaacttgtggtaggttattatccgtattacttatgtatgaaagtgttggttgtttggtagatagagggttagcttgaccttgattttaagacgctccctctgcacgaagagcctaaatctataggcgaagggggactttagctttgtaataagttgtggcctgtgttagtgttttaagattttgagtagcaagaagatcgggttgatgcttagtatgaatggttggagctttaccttcagtcttaggttctaggtgaagtccccgattatagcgcatcgttactgcctgactggctaa

SEQ ID NO: 726139 - DNA, 454 bp, Homo sapiens
atccgaaagtttcttttgttgcacagacaggctctgtactttttttgttactatttggagtcaggactatggagccgagtagttaatcttataaatatagccggtgttacttgtatgaacttacagttaacataggaaaaatacaagtaaggatgtgagaattggcatttaaaggggaaattttcaacccttaatctgaaacacagaagacagtcttaatcataactgtactgtgacgaatgctattgatgtcaataggtactgattactttccaaatattgatgtatatggccagtgggcttttcttaaatgaaaacactgttccatataaagtacatttatgtttaatccagtaagagaatagaatgttcattggtgactctttaaatcctttactaattatctaattggaaagcgaaaagaagggcctatattaaatgctgaaagtgacaa

SEQ ID NO: 726140 - DNA, 217 bp, Homo sapiens
acatcagctaactatgacatatgatctgttttcttcttaactctgtcatctgtggtgtactacactgacatagattcttatcctcttgaactggccattgtgtccatagcataacccccacttgatcataggtgtataacttatttctaatataatgctgtatgtagttctactccactaattttttttctttcttttttttttgggaaggcggaaa

SEQ ID NO: 726141 - DNA, 1146 bp, Homo sapiens
  misc_feature (753)..(753): n is a, c, g, or t
cgtgtgtggagcgtgctcgccggacgcgttgtgtggcttgtgtatgttcttcgtcgcgtgcgggtcttcttgggtgcgcttttcccaggtggtttgcttgttggtctgtgtctccctctattactcgtggggtctaattccggccttacgttttcccccctgtgccattctgtgtgactcgttgctacccgggggcccccacccgtttaaattggggctctcccgcgccggcctttgtctgtgggcattatgtccctgaactgttcccccttttgggtgacccctccccgtctggtggtaccttcgctttggcccaatttcgatcccggcgtcgaatgtccttcatcgctcccaagaccactgggacgacccccagggggacttctccccaacggccctgtgcggggttccgggtgttcctgctccggtctttgtgcgctctcccctgggcaatcattgttgctgcccccctggttggggccccctgggttttccccgaaatccgctcatgtgtcgtgaacccagccggttttttacttgagttggcgcccttcccgcaggggccctgtcccctggggccccaggaggccccaatgtggacctttttcgtgttgtaccccgggattacttaaaggtgcccacctagagtgccccttagtttcgtgtaacgcgttgtccaaagtaaaagagttaaagtaatttgtcaaacacttttgcttcttgtccccgccacgggacccaggtggcacgaanccgaggcttatgggtctggcacccccccaccacgctggagaccgcgaaggctttccctggggactggtgttctcccggagcccggggttctcgtgtctaccacgatcgggctcttggcccctcgcgacggcaccctgttgaaccacctcggagggttcccccggagccacccctcggggtgggctcctgagggaccctggggaactgattttgttttgttggtgtgtggccacctgtggcgaccggatataggccctgaactggggaaccccggcccttccctgttcccccctgagcctgcttctcctgagaccagatgctcctagtgaggctgccggcccggtgtggtggggccgagtgtgaccctttgctaaataaagtgaaataccccca

SEQ ID NO: 726142 - DNA, 438 bp, Homo sapiens
  misc_feature (163)..(163): n is a, c, g, or t
cgttaagaacaggtgaggcctggtgctatcttctggagcaaggctgacagcttgacttgtggggcaggattctctgcagcccattcccaagggagactgaccatcatgcctctctcgggagcctagcctgctccaactccatactccactcccagtgccccancattccccaatccctcttcaggcctgtcaagagggaggaagggggccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccaaacccaccccctctggagaaggcctggaagagctgagaccttg

SEQ ID NO: 726143 - DNA, 483 bp, Homo sapiens
  misc_feature (191)..(191): n is a, c, g, or t
tcttctccaatagaaggctgttttgttggctttgaaaatctgtaatttagtgtagccaccttcatcaatgatcttagctagatcttctggataactttctgcagattctatatcagcacttgctgcttcaccttgcatttttatgttatggaggtggcttctttccttgagcattatgaaccaacctctcntagcctcctcaccactctcagtctttatagtattgaagagaataggctgggctcagtggctcacgcctataatcccagcactttgggaggccaagatggaaggatcacttgaggccaagggttggagaccagtgtgggcaacatagtgagtgttggcatgcacatgtagtcccagctacttaggaggcagagcaggaggattgcttgagctcaggagtttgagactgcagtaagacatgatcaagcccctgcactccagggtgggcaaccacgccagaccctgttttttaaa

SEQ ID NO: 726144 - DNA, 997 bp, Homo sapiens
cttgtcgtggaacatgacttcatcatggccaccgtatctagcggatcgcgtcatcgttttgatggtgtaccatctaagaacacgggttgctagacagatcctcaaatcccttatggcttgggcactgaatataaaattgtttgtctcagtttgaaattacatgcagcaaggagatccaacatcaactataggccacgaatgaaacgaaatcttgaattcaatgaaggatgtagaacaaaagaagagtggaaactacttttctcttggatgattagacatgactctgagaatatgataagccatttattaaaaggagtatttactatgaatttttggtcatataaaatcttgagattcaggattttatgccaccacatactctggaatttgaagtatagtatacttaatataacataaaaagccagttgggctgctaccagttcgtagttcgaaacacatgaaaatgccacttattctgttcctgtaacgaggcttcttgtgtgcataatattactaaacatgaacgacattctcaagctatacataattacttccacagttgttcatgagtgtatgggaagatttcagtaggtgtattaatattcacggtaccacacttgctgtaccagtgttgctcccttctggaaatctgtgaaaaaagcggttcactgtagcttacctggtttgccaagtatgccagtgtaatgaaactgccttatggtaaaagccaggcaaagattcactgcttgacagttggattaattgaacatccggattatgttcactgggggtgtcacgtcgtggccgtataattaacacggatatggtttcccgagggaaaattttcccggcgaaacccactgtttgtaaaatcgctttacactggtgcaacctataggggccttacaagtttatcaaaaaagaatacgtccttccgaaaacccatatttggaaatggttgatacgagggggatccccccagagtgtgccaaacttt

SEQ ID NO: 726145 - DNA, 358 bp, Homo sapiens
acctgaaagttttccagttgtgaaaaaaacaaagctgactattttttatttataagtatgtaaatgttcgaacggatcagaacatgaaatgccgtcgtaaatgtcaggtgttggcacacagtagctccaacaccttgagcatttttaagggagtggcttcatttcagtagcgacaaatctttaagaatagttgtaaaattggggttgtgatttccatttctgatgtgtccagattggcacccctttgtagttcaatacagtcacgagatttgccaggggcagccaaggcaaacaatcccaatctttatatataaaatgtattcaagcaaaacatacaaataaatttctgggatattta

SEQ ID NO: 726146 - DNA, 239 bp, Homo sapiens
  misc_feature (208)..(208): n is a, c, g, or t
ccccagtggtccaccccaccctcatgaaagttgccctgcagggcgaagacctgcgagagctgcgcagacatgtgcacgccgacagcacggacttcctggctgtgaagaggccgtctcagtgcgtgttcccagcctgcacctgcacctgctttttttttccctcggagcaggaaggggccgcgggtggggagaggcctgtgcccaagtncccccctcaagaggctgagcagcttagccac

SEQ ID NO: 726147 - DNA, 931 bp, Homo sapiens
gagagagtggggaacgtccggcttcggcagcgggcagtgttcgtatgtgccagcgcactcaacacaagcagacattcaacatcatagggtgcatgttgcagcaacaggcacagcacagcatttttcattcatgacagtgttccccagttgccacacacgttgacaaagggcaggcaacgcacagagactgtggccaaagtctccatgggtctcttatgggcggcaagacaggtcagggcccctgggatactcgttacaacaggccgggcaataagaaacaaaaggcactcaatgctaggggggaagagggaattacaagtggaatgtgcagtcattttgggaaggaattccgcaaggaaggttacaattcccgttgggacaaaaaaaaagtgggatcttatggtacagggacttttagaagtagatgcgaacggagagagagacaaaggggggacagaactgtttaactttaaggatctagaatgtgtgcacaagaaagatcagggtttgagttgtaatttggggattgtacatctaacattggggggggcccagttggggacacctgaaaaaagtggagcagtgtgataagcgacgatgaagcagcggaggaaaaaaatgtgggtctgatataacaaggtggaaagtagtgtgtgatgtgaaaaaggggggtgttggagttcacaacaagagttcacggggattagtgaaggaatgaagagaagttcctggttcagtagttagagatggagcctgaaggagaaacgttgtaccgcagcaaatgtacgaaagttggacatcggtaggagtgtgtgggaacagtaggagaataccatgcagttcgttagtggggttaagggaggagacaacggggtcgccgggtagagaagtatattaaggaagcgtgttggaaaaaggaaaacgtgaggac

SEQ ID NO: 726148 - DNA, 407 bp, Homo sapiens
cagattaacccattgcgtgaagaatcatcgcgggcaaggcgtacaaggattcggagataaaataagaggggaagtattgtaataagggatatatcccatccatattgcgttgttaataataactggtggcgcgaaacatggacaaaaggatcggataggtgccgggtggacaaggtccggcgggtacaacgacgtatgtggcgggatgcataccgcccgtaatagcgtgttggggcctgaaataggtattggggcggagggcggataaaagtaaagtcgtgccaagcccagcgtccgcggacaccgtttcgtcgcggtatggatatttaagtcagcggcgccggcggtcgcgcaagcttataaatacgatagggaccggaatcggcacataaaagaaatcgcgggga

SEQ ID NO: 726149 - DNA, 238 bp, Homo sapiens
tccaaagcgtgaccaagactgagccaaagaattgatcaagttaaatgaaaactgacatctgatatgagcatatttattagtctattcaagcacagtttcgaatttagcaatacatctaaatcctcacatctctacaaggtaggtcaagagctatgattcttctcacttgtacaagataaatggctgtattacatgtctagtcttagttctgacaactgttggatactacgctttggca

SEQ ID NO: 726150 - DNA, 1024 bp, Homo sapiens
  misc_feature (1024)..(1024): n is a, c, g, or t
tcttcatggtggcttgtgggaagtcagcctacgctgtgtccctgctgcgggagtgtgtgaagttgcggccctcgtgaccccaccgtgcccctgcatggccgcgaaggtctgtatcgggtcccttcgcgtggctagaggaagcagagcacttggccgtgatggtgatcagctctcggagaggaagccggggagttcctccccatgggctacctggactctggggtctcacctatagcctgcaggccgaccgatcgccaccctgaagtccaagcaagatgaattgcaccggaaggcactgggtgacagctggagagggcgtcagctggctggccgcccagtgacccccgaggtcatcctctatgtctcgctggcgagctggccctcgtccgacagatctccagtgccatggagcagctgcaggaggccctgagaggttggcaaggatgatgcgccacgccctccacactgctggcactggctcttcgtctgcccgagaaggcaactagcagtcatgccctggtatgtgtcgaacatggcatcaccgagcaagccctgaggaacttcaagctgatgttgagcaaggtgaaagctggagcaggtgctgaaagggccaggaggaaagccctcgtgagctgcatgacaagtgctgatgctgtgggggaccctgtaccaggttctcccagttgggaggctaaagaggattggagttcgggggaggcgccaccgtgaaaaaggagaggtggctggcgcctgagttggctgaggccatgaatgggaggcctggtcccggggggtccacaaagcgctcccgtgagaggacagtagagaggggaaaacccttggggtaaagaagccgcgagtgggggcccgggccttcgttgtggcggtctcgtcttcaggcgcacagaagagtcgacaaaggagggagaccagcacgcaataggggaggagaagaagaaacaggaggaaagaccattatagcagcaaacgagagaaaagagggcccccgggcgcgcgccggccn

SEQ ID NO: 726151 - DNA, 814 bp, Homo sapiens
gcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagcttcggtcacctccaaaaaggccaggaaccggggcccacgggttacgttggccgtggtgtcctcctacatgtggccaggaatatccagaggggctcctggagtgtgtgcgcaaacctatatcttcaacaagcatgcagagaaaatcgaggaagtgacaaaaggaagtcgcgttttttaacaacttcctcactgatgctaagcgcccagctctgcctgagatcaagccagcccagccacctggccccgcccagatactcccccacaggtttgaccccaggactcccctacgccacaccagactcccaggtgctgatgacctatggtcagcccggaccccgatcttgggctatggagctggtgctgtccagcctgcagttcccacaggagggcctccataaccccgatgcccgtatggagcaggcgaaggaactatgacgccttcccgcggccagggaggctaccctgggcaaactcggcacacgatgctacgagaagacccaaggccatagcggacacaacgggacggatgcccaaacca

SEQ ID NO: 726152 - DNA, 450 bp, Homo sapiens
  misc_feature (17)..(17): n is a, c, g, or t
  misc_feature (70)..(70): n is a, c, g, or t
  misc_feature (117)..(117): n is a, c, g, or t
  misc_feature (160)..(160): n is a, c, g, or t
  misc_feature (188)..(188): n is a, c, g, or t
  misc_feature (190)..(190): n is a, c, g, or t
  misc_feature (194)..(194): n is a, c, g, or t
  misc_feature (202)..(202): n is a, c, g, or t
  misc_feature (213)..(213): n is a, c, g, or t
  misc_feature (219)..(219): n is a, c, g, or t
  misc_feature (228)..(228): n is a, c, g, or t
  misc_feature (241)..(241): n is a, c, g, or t
  misc_feature (252)..(252): n is a, c, g, or t
  misc_feature (257)..(257): n is a, c, g, or t
  misc_feature (260)..(260): n is a, c, g, or t
  misc_feature (299)..(300): n is a, c, g, or t
  misc_feature (345)..(345): n is a, c, g, or t
  misc_feature (352)..(352): n is a, c, g, or t
  misc_feature (385)..(386): n is a, c, g, or t
  misc_feature (430)..(430): n is a, c, g, or t
cacaccaggggccaggntccagttccctcatctctggcaggaaagatccacagcttttcctccatgtctnttactcactttcaccagtccgggtaaaatctgtggatcagggttaanaaagcaccgtggagaatggccctcttcaggaaagaaaaataancaaatgaatggtccacctaggggttcantnaagnaacaaatntgttaactgancctgantcccttctnggaagtaataatnaccattgacanctaanaantagacaccatgctaacacacttacatacaatctccttgnntcttctcaatagcccattgcacctctagaaactgttactttcccnttttacncacagtgacacatgaggctcagatataaaggannggtactggacttgaagtcacaaccacgacaggagtaaggatttngcttaaggatttggtcctgt

SEQ ID NO: 726153 - DNA, 86 bp, Homo sapiens
ggatttgctggtgcagtacaactgggcttaatagggacatgccattgcacttcagcccaggcgacagtgagagactctgtctaaaa

SEQ ID NO: 726154 - DNA, 468 bp, Homo sapiens
agctctttatgacctgtatcttgtgccgatatcctgtcttattctgtgacctagaatgctttaaccatctgggaatgcagcccagcaggtctcatcctcatttttacccagcctttattcaagatggagttgctctggttcaaatacctctgacaattcctccccccaactgttgttcaggcaagactgccctattttctgtcattatatattaaattttagtttctagaattttaaataaatggaattatgtaatatttattcttttatctggcttctttccctcagcataatgtttttgagattcatccatgttgttgcatgtatcaggagtacctttttattgctgagtaatattcttttgtatggatatatcacaatttgtttattcactcacctgttgatagacattggggtcgtttccagttttggctattatgaataaagttgttatgaacatttaaaaaa

SEQ ID NO: 726155 - DNA, 256 bp, Homo sapiens
aaaaaagccaaaatggcccccggaaacccttttttttccgggccttcccggaacttttttggggagggacttaacgggcccaaaagggggggggttggttaaaaggggtaaaaaggcccaaaaaaaaagggttttttttttttccctttttggttaagaaggggggggtttttttttttggcccggtttagggagggggggaaccaagttggccccccaaaaaccgggatttttttttgggggggggtttttccca

SEQ ID NO: 726156 - DNA, 436 bp, Homo sapiens
  misc_feature (19)..(19): n is a, c, g, or t
  misc_feature (31)..(31): n is a, c, g, or t
  misc_feature (36)..(36): n is a, c, g, or t
  misc_feature (40)..(41): n is a, c, g, or t
  misc_feature (55)..(57): n is a, c, g, or t
  misc_feature (70)..(70): n is a, c, g, or t
  misc_feature (79)..(79): n is a, c, g, or t
  misc_feature (131)..(131): n is a, c, g, or t
  misc_feature (184)..(185): n is a, c, g, or t
  misc_feature (288)..(288): n is a, c, g, or t
  misc_feature (369)..(369): n is a, c, g, or t
  misc_feature (383)..(383): n is a, c, g, or t
  misc_feature (385)..(385): n is a, c, g, or t
  misc_feature (409)..(409): n is a, c, g, or t
tggacgggcagaacaccanacacacagaganaaacnaganngcgtgcataacagnnncaaacaatgcagngctaacgcngtcagcggtgacagagaaccactgaaccaagatcaggcgaggccgaaatccngggaggtgagagccagccgggccacgtctgtcctagggttcggatcactgatnnggcatccctgtgaggctgaagagagagttcccaagaggctcttgtagctctcctgagtgggaggacaggacattccagcacagcaaggcaaggccctggcccntcctgggcagcccctccctgagggtgcgggaagaccagcagcgccgggcccttggggactctctgagcacttatcagtgtntctggccccttggntngatgagattctctcagaaacaacnttctgtccctcaggcaggggtacggag

SEQ ID NO: 726157 - DNA, 280 bp, Homo sapiens
gggggggaaggttttttgggggggagggaaaaggggccccccaggtttttttcccattcggggttttttggttttttaaaagaggggtttggcctaaacccccagcaaatggggaaatgggggggggggacccccaaaaaaaacggccgggcaaggtttttcttaaaccaaaattaccctttttcccaggttttttggggaaataaaggggggttctttgggggttggcattttagcccccggttttgttcccgggggcccttccccccctttagggcca

SEQ ID NO: 726158 - DNA, 508 bp, Homo sapiens
tggtacatcgtttgtggtgggaggacggcgctcggtttaggggattagagaactactcttgtccctggctgtcacaggagccacgagcttgtaatatttcctctgtatgtgaacacccacaatctggtgcacaaagggcacacatattggagggcctggttgtgtgctgggctaattgctgctgcagtttgggtcaggggaggtcccttatgcagaactgtctcccttgtactgcctttaaggcactcctgtttctaggcgtgcccatcacccacagcaggtccactccagatgtgcagctgtgtctggtgtgcctggatgctccttaggggtgaagctgcatcagagctccctggcagggcagtctggatgagttctttgagttggcctctgggtccgccttctcgggatccgtgcacgttaacgattactaggactatgcagaaaccttgttttctttttttttttttttttttctttttttctcttttttttttttttttttttt

SEQ ID NO: 726159 - DNA, 1029 bp, Homo sapiens
ccccccccgagccgcccgccattgccccgcggcaccccccgtgaagaaaggccctctttatccccgggagcaccataaagagattaaaatagaagggaagggcgagagtcgctggtgaccaccatgacacataactcacccttgtattttatatcattaatcgatggaggacaacacaaaacgacaacaagaaacagcccaccagtcacctgaaatattcatagagagggggaattgatgcgatgcactatagctttattttttttttcttcttggattttgaaagtatgcaggttctcttagatcataataagtgagatagaagaatgagaagatgtgaaaaggcgcgtcccgcacaagaaaacacaaacgacctacacacccaacaaatataacaactctattaccaacctcactcttcgttaactaaaggacgagttaacaaaattagtaacacaatagaagaaaacatataaggcagaaaaagagagatggcaaccccaccatccaagtattaggacgctaacgacgcggtgcatcataaaggagaggatcgagaaggcgcaatacagaatcggtaaatgtgtagacaccgcaacgaatcagctcgtcactaccacctcaagcagaagagtagaggtaggaggactgaagggactgaggaggaacagacgggaggtgatacggtggatagaaagtggggacctagcacagactcaacagcagaacatacatgtaccgattataggtaacgagtcacactctttaataagagcatcatcgctattaacgactgctactcgtatttcactgtctacggccacatatgtataacatgagagatagcgttgatgtctatttgccactcttacctggtcgagtccatacacgatagtatataaataacttgtgtagactgttcatatacacatgaaacgtgcctatccacatcataattatataaataaatataatatttgtacgatactgcagagcataggttagagtgagatgctgcgcacgactccg

SEQ ID NO: 726160 - DNA, 279 bp, Homo sapiens
gttctagaggatcccacgcgtcaagtacttaaccaagggtcacatggtagcaagtggaagactaggatttaaacactgaaatatgcttgtatctttttttcaggtaaagcaaaaaaaaaaaaaaaaaaaaattttcaaggattatataccgggtttccagggtaacattaaattcagaaatacggcttaaaggacaatttcccccaaaatatgagggggtttctaagcaattcgggtatgggccgctgcactcggtccatgtcagccatgtaattgtcc

SEQ ID NO: 726161 - DNA, 354 bp, Homo sapiens
cactggtcctgacagaaggcacggccggcggggcgctgtgcaggcaccgctgcttatacacaagtgtggcagcgtgctctgtgctgaggctggctgtggcggctggagggagcatcgcaacagcacggtgacacgtggtcaccaccggccatggcgtaccctgcgggcgtgacgcttatacctcctgcagcagtccctgagttccaaacgccacacttcgacgctctcagcccgacgcaggtggagccgggcactggcggctccacggaggaagctggtgtgcgccggataaagatggcaaccgccgataagattgtgaaactcatgctcgaccacatgacaaacaccaccaac

SEQ ID NO: 726162 - DNA, 399 bp, Homo sapiens
aggaatgtgcatgcccaaatgctaaaggtccgtgtctccagttggtttttgatcaatcaataaagatgcaaactgccaatagttgggcaggggatgcgacacttagagttgtacaagctaggatgagagaggaatgggagagaatcacaatgacttggggcagaaggatgggacacaggagcagcaggagataaagacaaccagccatgttagaccttcccgattgagcctgggatagcatgggaaagtttaaggaatgccaaacctttgaggtagccaaggcatttttaaaaatgagctaatctatatcaatatctatctatctatctatctatctatctatctatctatctttcatttgcagatccaaagatagctccagtacaagcacccatgcat

SEQ ID NO: 726163 - DNA, 535 bp, Homo sapiens
gtatttcctccttgtggatgtcagtgtccttgctctatcttctggggtcagactaaattggtatgagctcggtatatattaaagaatattaacctggaaaaaaaaaaaaaaaaaaaaacaaaaaaaaaaaaaaaaaaaaaaacgcgggggcggcgcgcgccccgggcccgcaggaaaggctctcacacaacacccggggggggcgcgcgcggcggccccaggggagaggaaacggggcacacaaggggaccccgggaaaccacggggccagaaaccaggggggggggttccccccacgtgaaaaaaccccgggggagcaacacagaggggtgttagaaaacacaccacagaagaggctactatgagagggactaatagggggcctcctaacaagaagagaggccaagaagacgagcgagaaaataaaaaatacaccacgcaggggggaaaacaagcgataacactgagaacacacacaacaacaagaagaacactcgacaaacctaaagatacgaaaataagaccaaactacaga

SEQ ID NO: 726164 - DNA, 151 bp, Homo sapiens
tccctctctccgaaaggcaacatctctgtggtgctctccagcgtctccagtggctatggcggtgccagtggtgtcggcagatggctctaggcctgggctggatggaatgcagctactcgctatggcagtgtgtcttggctgttggaaggtg

SEQ ID NO: 726165 - DNA, 531 bp, Homo sapiens
taggatgccatttcttttatagattccttggtatttctggtggggtaaggggcaggccagggctgttcacgcccatgagggaagaggaaagtgccactgggcaaggtgtcccaccctcccctcctgaccctcctactaggcttatcctggcaatggggtagtcactgccacccttccacacacacactctcactctcacacactaaaaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccatgtggctatttgccctgcagatctgggagttttacccgctaccctgaacctgtattttccctacctttgggcatcttatggcctgttggggaaaactttggcccattgttggagacctaaagcgggttataagaaccagtttgccctggctccttttttggggccctattcacaat

SEQ ID NO: 726166 - DNA, 413 bp, Homo sapiens
ctttctttttaagcccctccttctcccttcatttttatgacattgtgtgtctgtcttagtctgttttgtgctgctataagaatacctgaaactggggcctggtgcagtggctcatgcctgtaattccagcactttgggaggttaacatgggcagatcacttgagcttgagcccaggagtttgagaccagcttggggaacatggcaaaatctgtctttacacacacaaaaattacaaaaatcaaccaggtggggtggcacatgcctgtagtcccagctacttgggtgactaaggcagggttgcttgagcctgggaggtcaaggctgcagtgtcgtggtcacagcttgctgcggactcgacctcccaggcttaagcaatcctcctgctcgagtgacagagtgagaccctgtctca

SEQ ID NO: 726167 - DNA, 292 bp, Homo sapiens
agaggatcccccacaactgacgcgatagtttactgagaatgatgatttccaatttcatccatgtccctacaaaggacatgaactcatcatttttcatggctgcatagtaccctaaaacttaaagtataataataataatttaaaaaatcgataatctgaaaaaaaaaaagaagattgaattcataatttaaaaacttccaaagaggcaatctccaggcccagattatttcactggacatttctaccaaatgtttaaagaagaattaacacagactgatttcgctgcagtttg

SEQ ID NO: 726168 - DNA, 418 bp, Homo sapiens
cctgcttgttcagggcggtcgattttacatctctctgtacattggaaaaccccttccggatccagaataggtcatcatggatgtgtaagccgaaggagctaggggtgcctacggaagcgtacattccagtgcaagaagtccatgatgatggagatctccgaccctcgaaaacactttgagcacggtgcatccagtgagattggaaccgaggacgctgaggacgttggagttgaacagttgttacgaaatatcccatacacgacagtgggcactctggcccaccggcatccaccaatgcatgtccatggtttgaacgtgagctgagatgccaagcgtctgcatatcacgcagctcacctggcataccagtcgccatgtgcgagctgtccatcttcccccatatcctctcccagctcctg

SEQ ID NO: 726169 - DNA, 348 bp, Homo sapiens
gaagaaacactcttattcccaaactacagaataatgtgttaaacatgctaaatagttctatcaggaaaacaaatcactgtatttatctccgcaggctatttgttcagagaggccttttgtttaaatataaatgtttaaatctaaatgtttgcctggattggccataacatgtctttcagcattaggcttttaagaaacacagggttctgtattctttactaaagatctcagcgcccttaatgttgcttcgctgcggctgaccgtcaaatacacgccagcctgggaccttagacaccactgcagaaccatcagttcccaacaacaaaacaaaaaaaacacaacacaaaa

SEQ ID NO: 726170 - DNA, 118 bp, Homo sapiens
ctgcttgaagaacttcatctcgtaaaaatgagattgcagccgggcgcagagatcccacctatatcccagcactttgggaggccgaggcaggcggatcatctgaggtcaggagttggag

SEQ ID NO: 726171 - DNA, 260 bp, Homo sapiens
tctgaggatccctccagatagaattgcgatgttgcagtgtctcaaactgcaggctcaagcatcctcctgcttggctcccaagtagctgggattacagacacctgccaccacacctggctaatttctgtgttttcagttgggacaggctggtcttgaactcctggcctcaagtgatccgcccgcctgtgcctcccaaagtgctgggattacagtcatgagccactgtgcctggacttttcttttcttttttgagacagttt

SEQ ID NO: 726172 - DNA, 259 bp, Homo sapiens
gcaggatctcatcggcgagatgacgctgagcctgagcgtctcgagtacagcaacaggagggttcgccggccagtccaggtctacttttatgtctcccgtgggcggaggaaacgcagtcctatgccagagttacaggtttctgccggtgatctgcggataggagcccctaccggactcatctctgcggggtttcccttgagcatcggcaaccccctttggcactgacatggacttctcaccaccccgtcatctcgccgat

SEQ ID NO: 726173 - DNA, 988 bp, Homo sapiens
  misc_feature (320)..(320): n is a, c, g, or t
ggctgggagataggcttgtgatatgtgtacgttagcgtctgccgagtacagatgaaactgtgtgtgagttacctgcagtgccggagtattgtcagtcacatgaattaacgtgtccttatggagcgcatgatgagcatatagtttctgaggctactacatcgttcattatatgcgttgatatatatgtatatagttcacatgtggatctgccaccaagtcatctggcataaccgattccgttttcttatcatctggagactctcaatgatgatggaggataaaatattcttgagattgaatattggaaggatgtgatcgtngaaggtggtgagagatgaggatcagtgtattgcgtcgtgtaaaccaatatcgtcgatgaatcaagattatgttctcagaatagttgatgctagagtgatttgtgcattagcatggattcacacttgtgctctcaactatgcaggctgtgatgcctacggctcccgtagaaatctttgatcgactgtggggttcaggtcctagataatacacaacagcataacagaatcaaggggcttggtagtgcccgagagcaatgttcgtagtcactactcataactcgtgagaacgacttcgaattttgggagtatcgagactatccactcattcccataatgatatggggaaaaggaagtgctagatgacttaagtagttgggattggtttggtgggaagatagttggtctttattggacctcttggaaaaatcagagatctttcttcagtcctgggggaccaaccgtgtatcagtaacgaagtaaggggaaccatgggattctttctttgaagaaatggtacttgtgatttatccccccatgcagtagggcacgattggtggaggtggactcaagtctcaagtggagcattcagggtaaaatccctttccctaatggagccgcgacttgattcttggcacatttaccgtgtcactgctgtggaaggactaaag

SEQ ID NO: 726174 - DNA, 265 bp, Homo sapiens
cttgaattgtagttcccataatccccatgtattgtggtagggacttgacggaagataatttaatcatggaagctgttatcttcatgctgttcttatgatagtgagttagttctcataatctgatagttttataagtggcttttccctcttttgcttggcacttctccttgctgccgccatgtgaagaaggacatgtttgcttcccctccaccatcaccaccgcacctctcacttcaaagttcttttcaactttcccttacggtac

SEQ ID NO: 726175 - DNA, 777 bp, Homo sapiens
gaataatggcccggttggccgggacgagctggaatgattaatgatgtatgcagcaggttatctacgtctgaaattatttatgtctactgagaacccagaattcgctaagagatggaggaacctcaaaaaagctatgtgaacacaatggaccttgcagagagatgaacctctcaaaagcaccggaccctcagatttctgttagtgaattctgcttgccactgcgtgctacgatcatcctggttaacccctaccactccttgcaactgtgggcacagcattctgcacgtcactgccttgctttatggtgggcatcttcaaagaaaacagaatgtccagaatgcagagaaaaatgggaaggtttccccaaagtcagatattctcctcagggatgccattgagaagagttatgttcctgatgccattgtagacgtgacgcattgtgcaagcacagtgtcagccagaagtaactgacagtaggtccacaacaagtcttgcagccgtttcagaaactatgggacatgatccagattcctttagctcctaatacaggccgagcgaatcagcgagaggggagggggattcttttgccggtgctgctcacaggtttaactggatgtggcagatggtcctgcctcgtcgtatcactggtagtcacgtgaggggaatcgtgaagcagcgacctcctggtccacaatgctgtggccaaatggacggcggaagaaagtcgtcctctggctggagcagcgtgggcccttgggaatcatctttaccggaaag

SEQ ID NO: 726176 - DNA, 962 bp, Homo sapiens
gttgggagcaggctaaggaaacaaatggggaggaattagccacaaatcctcgaagatagacagctactcaaaggcatcttcacggacaatttccaagcattggatgcagtggtgcattcttgcattgggcagtgattgtgtgcacacatctctttaagggagagtggaaatggggtgaggaggaaaatgggagtaggatagagtgtagcgtgacatttattttctggaaaggaagacccgagcatatctgagagctcagtgaagaaagtagtactggcgaatcggattaatatggtatgatcagactttagcaagattctatcacttttcccagtgatgatgtgagacggtgtccgcgtgtgtaagtgcacacaggtgtgtgtgtgtgtgaatcttcatgagtagtgtgcaaggagaagctgtgagaagtgatctgaaaaaagtcagattcgagttagacactagagtacagtcaaaaaagcttcggaagagtgccatcatctgtaaagtacataagagagagtcatgacctccagactcagaaatgacaagaataggcagcgtatgtgaaatagtaagctcagacaagtggagggacacgtagaaacttcctatgccaagtaccttgacgggagtaagtgaccttgaatccaagagaccatggaaactttggagcatcggcccgagagcgtgggatcacggcctggtaatcgcaagaaaaatatggagagggacagaagaattgggggcagagaataacagaagggtccacgacaagactggaaagacccatcctagggaggaacaccgggtgaaaaaaccccgagcctcctacggacaaaagtaaggaaccagagaataagagcgaagccaagagaagacagcggcaccatggaaaggtacccaagcatacacttttgcgacagagctggacggcacaggaagcaaatggggggtggaac

SEQ ID NO: 726177 - DNA, 661 bp, Homo sapiens
  misc_feature (81)..(81): n is a, c, g, or t
  misc_feature (477)..(477): n is a, c, g, or t
  misc_feature (480)..(480): n is a, c, g, or t
tgaggcaatgcagtcaatcccaaagggggtttttgaggcagtttcctttccaaagaggatatcctttttttcagatcagtnacctaccctcctcccccttttggtgattaggattattgatgcagggtggaaccactggggcttggacagccttctttttaaaccctgggagcctaaagattcaagcccttatgccaaagctcacaaaacttgtggtttgtgccctgggtttgtctgtgggcctcatgggcattgtggggggcactgttttcatcatccaaggcctgcgttcagttggtgcttccaaacaccaagggccattgtgaatcccatcctggaagggaaggtgcttccccttttccaggagcaaaaaaatggccttgttaaatgccctagcactatttttgggcccgatttatcaaatcccttttttcctccaaaaatttttcctctcccctttttctttgggacttaagntgntatatcccctcaaagctcacaaatgcctttacattttttccctgacctcctgatttttttttttttttttcaaatgttacctacacaaacatgcctggggtaagccacccggctacctaattcctcagtaacctccttttaaaatttccaaggaagcaataaattccttttttgagtttta

SEQ ID NO: 726178 - DNA, 233 bp, Homo sapiens
aacggaatgaaaaattaggggaacattataagctttcttcccacgttatccagcagagacttttggtattttttagtcctgccatccatgttgctggggctatggtcctagcttgtttcctgttcttaaagtaatgggggttcccttcttctggaagcctctactcatggaatggaagctctaccctggaggctgtgcactgaaaatcttcggtctctgatcacccttgccct

SEQ ID NO: 726179 - DNA, 506 bp, Homo sapiens
ctgctcacaaaatcagctaccacacccagcacaaaggtcgcctcaagctacagagtgctccagtctgcatcctttcaggaaggtcctgcaagataagtacaaggtgtggctgttgcggcgagaagatagcgctagatgaaactccgcaagcgtgttcaagctcctgcggaataactacacgtgcagcatgccaggcctcagggtgcttaacccaggacaaccagaactggcagacggcgcctttctggacacctaatgaatgcggtgaacacactggacagggatgtcctcaaccagctacactgtacagctcatgtagctgaggagctgcaagggttacaagcagtgtaacccccggactcgaaacatggacctgggacttacagatggaggaagctatgagcaatacaggggacaactgtgggaaggctgggaaggttaagaaacaacagaggtggacctcccaaaacatagagggatcatctgattgcacggctatgaaaacc

SEQ ID NO: 726180 - DNA, 348 bp, Homo sapiens
ctgctccgcccctctctggcctctgtggtttctgcagggtgggaagtgggagctgagctctcccatctcactgtatgtgtcaggccgttgcaagttttgtcgttactgtggtctcacctacccagacctgagcaaggcagaaaacacagaaactaatgctttagaaaataagcagttggcaaaacgttatgttttatacctagttctttgaaataagtgaattaaatacttaagctgctgcctcatcaagagaaaagagagaaacaagccaagtggtaaacaggaggtgaatagatgtgaggacagcgaggggtggcgcggggaccgcagagaggggcggagcagggg

SEQ ID NO: 726181 - DNA, 398 bp, Homo sapiens
ccgaaggatgacaagaagacagaattgcaggagctaaatgagctgtacaaacctgtagttgctgcgcaggaaaataagtaaaggtgcagatcccaagtctgtaatatgtgcattcttcaagcaaggacagtgtactaaaggagataagtgtaagttctcccatgacttgcctctggagagaaaactgtgaacaacgcgaagtgtttacattgactggggagagactgacagaaccttgaaaaagactacctactggactacttgggatgagcaaaaagctggcacagaagtagtgaacaagaagcacggtgaggcggaaaagaaaaaaccaaaaactcaaatagtgtgcaagcatttcctggacactattgaaaacaacaagtacaacctgccggtgg

SEQ ID NO: 726182 - DNA, 342 bp, Homo sapiens
  misc_feature (262)..(262): n is a, c, g, or t
  misc_feature (314)..(314): n is a, c, g, or t
agacttcaacaccccactttcaacactagacagatagagacagaaaatcaacaagaaacattgaacttaatctgcactgtagaccaaatggttctaatagatatttacaaaacattttatccaatggctgcagaatatacattctccttgtcagcacatgaaacattcgcaagaagagaccatatgttgggccacaaaacaagtctaaaacattcacaaacattgaaataatatcaagcatcttctctgaccacaatgggantaaaactagaaatcaataagagggattttggaaactatacaaacacctgggnaactaatcagtatgctcctgggttacca

SEQ ID NO: 726183 - DNA, 88 bp, Homo sapiens
acggccgtgtattactgtgcgagagggtatagcagtggctggtacgactactggggccagggaaccctggtcaccgtctcctcaggga

SEQ ID NO: 726184 - DNA, 249 bp, Homo sapiens
  misc_feature (67)..(67): n is a, c, g, or t
  misc_feature (95)..(98): n is a, c, g, or t
  misc_feature (100)..(100): n is a, c, g, or t
  misc_feature (102)..(102): n is a, c, g, or t
  misc_feature (104)..(104): n is a, c, g, or t
  misc_feature (107)..(107): n is a, c, g, or t
  misc_feature (180)..(182): n is a, c, g, or t
  misc_feature (184)..(184): n is a, c, g, or t
  misc_feature (225)..(226): n is a, c, g, or t
  misc_feature (232)..(232): n is a, c, g, or t
  misc_feature (238)..(238): n is a, c, g, or t
cagtggtcacctatgtgtatcagctaattggagatgatgtgaaagtagaacggatcgaatacaaaanaccttaaagccaggcctgtcttgatgannnntncngnttnaattcattgttcctgttgaaatcaagtaattaaacatttaagagccacaaaattgtatcacttttataatatnnncncagtaaaatataataccatcttctctgttaatacataattnntccagnttcctntaaactataag

SEQ ID NO: 726185 - DNA, 112 bp, Homo sapiens
atggccataatctctcgttaatattatgttctgtctgtgccttcctcccatttcacttcctgctaccttagttaatctgttataataaaccctgtaaacataattatgtctt

SEQ ID NO: 726186 - DNA, 165 bp, Homo sapiens
cgtgtgtgtcaagtttttccatcgtttgtgggtacagagtgttgctctgtcacccaggctggcgtgcatgtggtgtgatcttggctcactggaagctctacctcccaggttcaagtgattctcatgcctcatcagctatagcgtgggtaccgagtctcaattcgt

SEQ ID NO: 726187 - DNA, 169 bp, Homo sapiens
tgtagcattaaaatataataataaaaaccaattactggttcttaaccacggactagttagggaagcaagtggtcaggagtgtggggcttaagagacgtgggggaatgggggtgcccggatcagactttgtttggttgagtccttctaccgacctccctgtagtcgacgc

SEQ ID NO: 726188 - DNA, 701 bp, Homo sapiens
cgggggctctttcctgggtggggtttgtgaagtcgtggcccgttagcaggaagcctaacagtcgccccgacgctagtgagggacccaatctgagtcccaggccagctgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgctattggcttgaggcaagtttggctctttggtctgcagtaccaggacactaaagggttctccacctgcgtgaaactcactaagaaggtgactgcccaggatgtgcggaaggaaagccccctgctctttaagttccgtgccaagtttaccctgaggatgtgtccaggaaatgatcaggcatcactaagcgctgttcttctgcaggtgaagagggcattctcatggatgatattactgcccgcttgaaccgttgtcctgctgccccgcatgctggccagtctaagaaggcgacttcaataaggagtgcctaagctcggttactgggccggaaccaagttgttcccgagaggggcctggaccggctcctccaggaccattgggaggagcgtacccaggttgccttagggc

SEQ ID NO: 726189 - DNA, 177 bp, Homo sapiens
taaaaataaaaaaaaaaaattcttttgggtgtgggggggcatgcttccaatccaagctcctttgggggttgaggcaaaaaaattgcttgaccccaggagccagaggttccagtgccccaaaattgcacccttgccctgccagccctcaagcttggggacagagcaagcctttcccta

SEQ ID NO: 726190 - DNA, 560 bp, Homo sapiens
tcttttatgtgttgtcggtgcaggtagaggcttcctaaaagtgtgaaaccgtaggcttggattaaggcgacagcgattcctaggatagtcagtaaaattacaattggtggaaacatgataatgttgtaaaggagaaggttaatgggttgattattgctaggtggtggccgctcccaattaggtgctatgagtaggtaggcctcgcagtaatggtaacgcggttaggctgtacggccagggctaatcgggtttgagatatgaatatacagagctggaatgggtatccgcgataatataaactaagttatagagggtataagggtgtggtaaggttgttcgcctatgtgggtaaaacaagtgggcgctaaagggctattttaacatcttaaaacgcaaaaaaccccttatatatcccacgtggcgccccgctccattaaagggagatatggtccctgtggtcctagagattatataaaaataaaggttggggaggtggatggggtggttcaaaaatgaagtttgaaggcccaggaagatcccgaaaggcgagattcaatttg

SEQ ID NO: 726191 - DNA, 693 bp, Homo sapiens
atgggcttaatcccacctaccatctttacttttccttatcccagcggatcacactgatcctaccacacaactctttcacatcactatcaattatttctttatccactcagaaataacctccatctcaaaatcctttatcaccatctctcaacttttttactttttttcaccatccaccccactctccctaaaaaccctcacaaacttttttctccttttaccattcccactattaatctcacgacatcttctcatccacccatataatctaaacctccaattcacaatcaaccatccgttacccaaccaaaatactctttcttatcataaaaccccatcaccccctccctcctccaccttgtcttccccaccaccatattttccaccaccactccctcctttttactattggcccttaccaccaaacccttaccacccaacaatactattcaccccctcacatctacaatcccattatcctctcttaacacaccacttcccatttttatctccaatttaaaactacactcacaacaaactaattcactaacaccccacaatcccacaccctcctcaccccttctcttctttaacctattcccattcactaaccaaccaacccgctccacttcccccaaccttgtctctccccacaccaaacatttatacactcatatgcaattacctaaacat

SEQ ID NO: 726192 - DNA, 387 bp, Homo sapiens
  misc_feature (51)..(51): n is a, c, g, or t
  misc_feature (226)..(226): n is a, c, g, or t
  misc_feature (353)..(353): n is a, c, g, or t
caagtccataagaccctttagaaccctcaaatcctagtggtttttgcaccnccctcaaagtacctgtggggacctttatgaaaactgtaatatttcccctatatttaagttttgttataatagaaaacaggtttaaggctgagtgcaatggctcatagctgtaatccccagcactttgggaagccaaggtgggaggattgcttgaggcccaggtgtttgataccancctgggcaacatagcagcaagaccctgtctctacagacaaaattaaaaaaataaattagctgggtatggtggcacatgcctctagtcccagctactctggaggccaaggtggaaggattgtttgagnccaggagttcaatcaaggttgcagtgagccataa

SEQ ID NO: 726193 - DNA, 427 bp, Homo sapiens
  misc_feature (201)..(201): n is a, c, g, or t
atgttccaggcattgtatttctgttttacaattgtgtgcaccaataattatccaaaccattctgtgagttaagaattgttactttcatttcacaggttaaaaattgaggttctaataggttaaaagtcttactcagtatgagtagcaggaccaggattctaatccagatcaattgaactccaaggaccagatcttcatccngaaagctgaaagaggtgctggcagcttactgagatagaaatagggctaccttacaagacattcattgttctgtgagtttaacggcagtccgacataaaaacaattattgtaagctactcgggaggctgaggcaggagaatcacttgaaccctggaggtggaggttgcaatgagctgagatttgcctttgtactccagcctgggcaacaagagcgaaacttcgtctc

SEQ ID NO: 726194 - DNA, 81 bp, Homo sapiens
gtcgaagacacggccgtatactactgcgcgaaggaacggggaagagttggggttccaatttttgacgactggggccaggga

SEQ ID NO: 726195 - DNA, 963 bp, Homo sapiens
gggacttccagggtacgcgtgtgctatgaatgtggcagtgtacctgtcgatattcctgattgcctggcatgtttgcatgttgggtgaaacctgaggcagctcctgcatccccactagattcttcctgctccttgtgagtgaaacaaacaaatgttatatttcatattggtggagaagattctatcatcatgtggcacattatatattacggagtttatgcgcatgcacacatgggctcatttacagcacagcattgcaatagggaaaggttgtgacatttagcccagcctggcacatcatctttggcatcacactcaattgtcagtgttgccgcgacacatggccaccaaccacgaggacataagcacaaacattcccattggcacaatcacttccccacagcacattcacagggtctattcaaccaggcacacggcgtggaaaccacgcattaggtcacgctctcccaaggcatgattagcaacatggttgggcacgcaacacatcaatatgttcacgccaattcggcaattcattattacacatagcaacaaggtcgccaacaccaagagccaacattcaatttcacaacagcgccgttggccacgccacacgcggcaatatggccccacagggtcagtattgcgcacgacagcagatacattcgccgcttttgcacacggcaattgttttggacatatcacacagtagccacaggacaattaaaaccccgttggtgctgtacactttaccacacacccatgggacacgtatgtctaacatattgcggaggcacattggataaccaacaccagcggtattggtttggaccggggcacacacaaacggtggcccccacatttccgttgacaacttatccgttcgtgcacttaacaacccccttacgcatgcggccacgtgtccaccaaggtacaggagcatacacccttcccaagttcgcac

SEQ ID NO: 726196 - DNA, 188 bp, Homo sapiens
ctaccctagaggatccggtgaggagttggtgtatcatatatggcaggtttttctagacggcaggtcaggtcaccactgacacgttggcagtgcggacacggaaggcatgcagtgagcttcccgttcagctcagggatgaccttgcccacagcctttggagcgccagcacaacctgtgaccagcacaac

SEQ ID NO: 726197 - DNA, 637 bp, Homo sapiens
cattatggccggggttgatgcatggccgcaactttttttggaggatgatgactgagcacatcggcgggcatgccattcagataattcactaactcacaggccataacagtgtgcatggcctggggaacgccatcatcaacagtgggccacggtaggactgcacacgcattgggcgcgccgggactgtgagacgacaggctgtggatgtgtcccacctgcgccgagtgaaccagaccatctgactggtaagcacaggcgctcgttaggatgacttacggaacattaaaaccgttgcagagtgcctgccgtatgagcatataaatgctgacacgggctgctggaactcctatgccattaagaagaaggactagctggaccgtgcggcccagtccaacctatgattttgccagctgctgcccactaaacctgtctgccctatgtggcacactcagccctatagtgcgcctattacatttcattggccggtcgttttaaacgcccttcctgctagagacagaaaggtcccttttttcccattgactccgggaattttttccggagggagagtaaaaatggtccgagcctttcggctttaaaaagttttttttgacgtttcaagaatggaaattcccctctt

SEQ ID NO: 726198 - DNA, 704 bp, Homo sapiens
caggaaaactcctccttaactgggtagatcatactgaagtggtcagagatttaactttggctccagatggaagctgtgatcctggtgtcagcttcaagagacaaaactctcagagtatgggacctgaaagcatgatggcaaacatgatgcaaagtatggagggggcatcagaatggggtgtacagctgtgcattctctcctgactcttctatgctggtgtccagtcggagcccagtaacagcagttttccttgcgcgaatatggataaaatacacccagtgataccggaaactagaaggacatcaccagtgattgtggtagctgtgtgacttttctcctgatggagcattactgggctacgggcatcttatgatactcgagtatatatctggggatccacataattggagacattctgagtggaattgggggcaactgtgtttcccccaacctactccaatattgctggaggagcaaatgaccgggtgggtacgatcggtatctttaaggcatgatggactgcatgtggaaagcctgtgctgatgataaacagtggggagggttctggagacatggctgaggattatccagtacaagtgtgcaactttgaagcaatgggtacttttgtggtggccttctactaacgtgatggcaggttattaagtatgtgggggaacaaatgaacgggaagggtgcattatggg

SEQ ID NO: 726199 - DNA, 597 bp, Homo sapiens
  misc_feature (142)..(143): n is a, c, g, or t
cagaattaaaagtcatggtggtcgttgcaaagagcacactcggacatattgtcagaaaaatctttctaatcggggaagggatcctggtaggtagtgagctctccatgactggaggaggttaagcatgattcagatagttctnnggtcagatttgtagatgactttcttgaattgaaaaggaattttaaagacctccctcttcagtcctgagattctataattcaaagaagtagagagaaagattaaatctgcagacaaactagtgtttagaaatttaaggcattttctttgcattcacttatttcctcttgaacaaaaggcaacacacacatatatacccttgtatattcaaatgcactcaggaaacagtcacatatttacataggtatttatatagaaatatataacaaagtttgcatacaataagatgctcaatacatagttgtagtaaagtattaagcaatttctgaaaaataataaaggactaaagtctatgtatgttaaaaaaaaaaggaaatattttccctctataattctgtgtttattatgaagtcttcagtcatttgtgacattgattattttccaacggggatcacg

SEQ ID NO: 726200 - DNA, 140 bp, Homo sapiens
tcgtgtatatacgctggtgggagggggcaggcccccttgtgcagagcctgtggtctgaggcacctggctgtgttcccagcagagggagggctggggcggtggccgtaattgtgaatatgtacgataccctcatctgtgac

SEQ ID NO: 726201 - DNA, 1192 bp, Homo sapiens
aaacaattgcttaggtttccttttgtaaaaagcatctacttgcattcagttagggaaggtgaccatatccactctgccttctgtcacagagcagggtgctattgtgaggccatctactgagcagtggactcaaaagcattttcaggcatgtccgagacgggaggactcactacgcaattagcaaacaaaagcaccctgacatcctcctatcaggcaacactgcggcgatgccagagtgcccaaatgcactaacggggcgggcgctataccctgagcaccgatctgtcatcgcaacgaaaatcatcggccggcaacctgttcacatcgttcgtgttacctcaagctccatattaccagcggcgcattcgaccacgactcatccgcctaggcattaccatcgctcgctcgcactcggccgctcagcctagcattaaaccccatcgtccactcaggccactatcaccactagcacagcccggtaaccagggcgcagtcacaaaacgcactggccctatctggcgactttcacctccccttgcattccccgcgaccactttaattccattcaacctggccagctggcaccaggacaatccagcgggcaatttcacgacacttcaaacacacccacgatcgcatacacaggcccacgtccagcaagggacttgacaacattgccccttggtcctcaaacaatttgcacaaagtaccgcatgcgcgtttcacacaccataaccaattgcccaccctttggatggccacggacattgctaagaccactcggaaacaaatacaggcaaaaccagcccctaaacacattcctcccaccatcgacagaacaacgacaggaaattggcatcccccgagacaaacggcaccaggtgcgccaacaaccccgggtgccccactcactccacttcgccaccacatcggcgtcaacccgacagctgcgcgagcccacatactaacaatataactccacatcttaactcccctaaagcaagcccagtctcactactcccctccccattcctctcccccgtcacatacccaacactcccaaccatctaacctaccataaatacactcaccagtcgacatttctacagactattactctcacaccccacctctaccccacccctcacatacactctttcccatcccctatcaacactaatctcatgacaca

SEQ ID NO: 726202 - DNA, 985 bp, Homo sapiens
ggacgcgtgggtcgactgtttgctgccgaggcgggcgagaggagccggactggtgctcctttccttggtgctgggcttcgtggagcattttctggctgtcaaccgcgtcatccctaccaacgttcccgagctcaccttccagacccagagcccgcccccgagcccgacctggaggctcacctacttcccgtggccgactgtctatcatcgacgcctctatgcccgaccttcaccgcccagatccgaggcgccgtcgatctgtacccatctatcctcgagaagggggtgtcatccagccgctgagctgggtgaaagaaggtctccgattgtcctatggaacagacttcagcccggtcccttacctcaacggactcgggcccacatccagtccctcttccagttatatcacaggtagcccgcccagtaggcacccaacatggactcgctccggcggtggcgcattggctgcggtagggggcctgccaggcccatgcggctgctccggcaatgcccacactccgccctgatcagagggaatcatgcactggggatccatgttgggccacccacggggacgccacaacacggcataggccaccacgggacgcgaaacagggacacagacggaaccgcagagggacagaaagcacactgacggtgcggactgaaccgacactggcgcaaccggcaacgcatgataccatgcgcagcggacccggcctgacgggccggggaccaacccggctgaagggcgtaacccacccatcaccagcaaacgaccccaagggaccccgaacaggcggacagaggtccgagacgcacacaggacaagacagcaccggacgccgcaacagcgaacaccggaagacccaagcaagaagaagcaaagcaaaaacaacacgaccgaagccaccacaggggcagcgccgaacggccagacgcaccgacgacggaacaagcgcaacgagaccggcacggcccaccc

SEQ ID NO: 726203 - DNA, 730 bp, Homo sapiens
tgttcccatttcctcaaccacgctcttctcacttgactcccaggctctttggggttaccaggctttagtcgtcgtgaagggaaagttccactagaacgccccatttgagtcccctcctgaggttactgagagtgacactcttagtttgcatggaagtagctcctccacgttcactccattaattgaggaaaccaatcggtatccatggcccatcccttgtcgctctcaagacacccctgggtggcccaaggtgccacacaccagagtgttcaaggatggatcaattgtagcacgttagcctctgccgctggagactccctgccggctcttcttggttggtcagtacagtacctcagagtgtgtgaacggatagactatgagagtgaccaacccggcctccccatctgtgagccccaagcactgcctttgtgccctggcactttggactccaggctacaggcttgctgaagtccttggcgacaggggtggtgcgtatccagagaatgctgccttcctctaagcctgtccctctcctgcctcattttcgctgtagctcctcctggttctgtttgctcattggctgctgtgttcatcaaagggggttctcaccagaagtgaggggcctttcccttccaatcccttggggcaccggggcagctgtgcctgcctgcctctgcctgaggcagccgctcctgcctgagcctggacaggaaatgctccccgcgtgcaa

SEQ ID NO: 726204 - DNA, 116 bp, Homo sapiens
tattctatcagcctttgggtatgaatcatacacgtgtagtcaaacagagagggcatcatgtcagaacttaacagctattactctttcgttagaaaagagacagcataacaggaaaa

SEQ ID NO: 726205 - DNA, 148 bp, Homo sapiens
tcttgcaagcacctgctacttcaatttccatttgcatgtgtgcttgcgctgctcagtgggtgcatccatctcagcagtctgcacctgccaggccatgccaagcttggccacttggcctgtctgtatttcaccacacgtctgtagcctt

SEQ ID NO: 726206 - DNA, 685 bp, Homo sapiens
ggtgtatgtcccagtgcggctgccacctctgaacttccccactgactctctgtgagtgagaaatttagccgtagtacagtaattactgtaccctcgacatgtactgttacagctttctgagcagagatgactgcccaattgtccaaatgcctacgattgaaatgaaaactctattgttacctctgagttgtgttccacggaaaatgctatccagcagatcatttaggaaaaataattctatttttagcctttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcacatattctgtcagacgctaacaaagaagcccgacatctcaggttggattcctggttctctc

SEQ ID NO: 726207 - DNA, 498 bp, Homo sapiens
ggtcgcactggtgatgcggtctgttgtcccccggcctcctggactcctggtcccggggtctcccagcgctggtttcgacttcagcttcctgccctagccacctcaagagaaggtcacgatggtggccgtactaccgggctgatgatgccaatgtggttcgtgacggtgacctcgaggtggacacaccctcaagagcctgagccagcagatcgagaacatccggagcccagagggaagcctgcaaggaacccggcccgaacctgctgtgacctcaagatgtgcagtctgactggaagagtggagagtactggattgacccaaaccaagggctgcaacgtggatgccatcaaagtcttctgcaacatggagactggtgagcactgagtgtaccccattcagcccagtgtggcccagaagaactgggtacatcagcaagaaccccaaggaccagaggcatgtctggatcggcgagagcatgaccgatggatacccagacga

SEQ ID NO: 726208 - DNA, 304 bp, Homo sapiens
gaggggcggtctgttatatgtagagactggctccaatatggaaatccatccaaatacattcatcaggccgagtgacagagtagaaaactctccagctacatatatacaaaataacaatcataaccatacaggagaagctatcttcaaggtttctaccaaagactctaccgtcttgtagtaaaagacgacatcaaatccaagcttttgaaggtaggcaacctttacatcagaccctactgatccaacaactttgcagcccttgagcttagcaaatctgccccacgactgagcccacagctccagc

SEQ ID NO: 726209 - DNA, 166 bp, Homo sapiens
acacctaattttgggggtgggtagggagcgaggtctcactgtgttgctcaggctggtctgaaactcctgagctcaagccattctcctgtttagacctcccagagtgctgggattacaggtgtgagctaccacttgtggcaaaagcattaattttaaggaaaccaga

SEQ ID NO: 726210 - DNA, 155 bp, Homo sapiens
gtaacgtaaactcaaaatacgcatggtgtacggcgggtcggaaaagagaaggcgtacacgtggactacgaatctgggaaagtcaccctattagaggggtacagacatcgaggagagagaacagagacacgtcctatcatgtgtagtgttccctac

SEQ ID NO: 726211 - DNA, 185 bp, Homo sapiens
agggcttgatggtctgcgcgaggaagtagcggaacgtccgtcgcgcatcacactgacggtgctggaagatttacacggtgagcaattcctgaaagcgattgatatcgtgctggtggcagtcagtgaacacattgaacgtttcgctgccctggcgcgtgaaatggccgcgaccgaaacccgcgaaa

SEQ ID NO: 726212 - DNA, 100 bp, Homo sapiens
gaacacacgatgggctatccttacccatgacccaaggtgtgccctccgtctggaatgccgtacccttattcccagatctctagaactctgggttctccca

SEQ ID NO: 726213 - DNA, 181 bp, Homo sapiens
cgcgcacggggggggcggcaggacacatcgacttgtcgatggtgtcgttgatcgtggtggtagcgccgttgcctgcaacttccagtttttcgaagttgccgccggaagcgtcagtgatttgacggtctgcgtgctcttatcgataaacacgtcatcggtcggcgcaggcacggttacggta

SEQ ID NO: 726214 - DNA, 265 bp, Homo sapiens
tgttccacttgaccagccatttcccaatctgtccccctccgttttgggccttgctagtccctaagacacaacagttttgaaattagaccaactaataaccctacaatggcctctaagtgttccagtgaaaggaagagtagcacatctcttacattacatcaaaaactagaaataagcttcatgaggaagacatgtcaaaacccaagataggtagaaaactactcctcttgtgccaaacatccgagttgtgaatgcaaagggaaaa

SEQ ID NO: 726215 - DNA, 134 bp, Homo sapiens
atgcggatgacgcccggtgcaccgggggggcccaggggccccctggggccctgggatgggaccgcggtggcttcccgcggaggtttcggcagtgcaatccagggccgggtcgcggcccgtggacggggccgggg

SEQ ID NO: 726216 - DNA, 792 bp, Homo sapiens
  misc_feature (785)..(785): n is a, c, g, or t
cagatctctgtgggggcggagcttgttgctgggatgactacgaagcgttagcttacccacatgcccaagtgtacgtgcactgagccatatacaccagtagatgcatgtgtgggtgtgctcatgcacacacacactctctatctaggtctctggcttctctactctgttgactgtcttctcaggtcactcgcacactgaggcttcctatgagaagctcacttgccacctctcaggggggtcccagattgcatacatcacaatcccaagactggagttggggggaactggagggagcaaaacactgatctgatactgggcagtttgcttgaaactagaccacctatagctagatctctgaaaaccaatctactgaaaacttgacagcttaaaggaaatgactcactgactaatttggcacaagctcaattgctatattgagggagcgtatatgcatgtaggagacctattcttttttgacatgcttcggatatttcaaggatatatatctattcatccaagagtacttctgagctattatgagcgacatagatgtatcacatttgcagcactatgtacatgatgagaatgcttcctacctttatgggtagactgttatatgatagctaccattcaaacactttctcgtgcattactggtagcaattacaagagtgcagacgttatgtgagcatacttttggctttaatacaggatgtcttctcaacgagatgccttggaagaataacggagctccgaggcctgatgctttgggcgtacttctacatnctctggg

SEQ ID NO: 726217 - DNA, 1023 bp, Homo sapiens
ggtctgaactggctcccgtagttaactaggacaagagactacatatggagtatgtcctgaggaggggttgggatggtgtgttatctctcacctcgcacctttatgagggtcctctatgctccatcttcagaggccctcacaggtgggtggcttgtcgagcaggagtgcagagctgtaacgccagccatagaggcaaggactgactgagggggctgtgtcctcttatttggagatttgcgaacatccctcgttcttgtcctctcgttctgcataggcgcaggattccatgcagcgtgggtgtttaccaaggaaacaaaataccctgtcccagtatgggtaacacgccaggaaccgatgttggtgaacgctggcgtggttcaggcacgaagacaggtgctgactggtgagtcccttcaggcagagattccgcgcgtccttagggtctgcccttggggggtccggtaccaaataacctgtgtaaacttggctttctgggcgcccctctggggcccatacggctagtgtttacccacttaaaattgactcccaggacctcacgaagaccttatgtgggcacgccactatccattttcacccgccctaaggatagcgcagcccttgggaaaaactcacctaggtaagggggggcacgcgtgcccccaacttagcttgttggccacaatccgctataagaggaagatattgtgtagatcaacgttcaatgtatgtataatcgtgaccttggggagcggcagggcggcacaacaacctttgcccctttatacgtgagttgcctagctccgtttgtggccacgattgtgaagaaggctgctataccacttgggaccccttccgtgggacaaaggccctgaggcactttcttcttctataggacctataaaccgtgcgaaaggttacaggttccccgcagaaactgcactgcgcgttgagcacttttgcctacggcgcaaagaaaaggcggttcacggggaggtcccaggggggggggaggaaaacaaactt

SEQ ID NO: 726218 - DNA, 381 bp, Homo sapiens
ggaagatgtattgaagcggatgaagtgagggactgaagtgaaggcagactacgctgtattacagagacaccaaaagaactccttacgctctttctataaagtgcatgcgtgtctatataatccatcattatgtccatttgcgatacaatgactagctttccttgatacacgacaaacttgctgtgacaaagctggcacaaactgcatcgaaggattctgcataggaacctacaagccattctggctcgtacccatgacattcacattacctatgctcctttaaatggaggcaccttagcgagattcaggctgaggctcatattatttcaaacccatactataccagaatctagttgatgagcatatatctggtatttggcg

SEQ ID NO: 726219 - DNA, 517 bp, Homo sapiens
acattgtgtatactgccttgcgattatggcaaacaagatcacacatataataatacctagtcataataatctaaactcttatattcaggacaatgagacagtacaaacatatttcacgcagctatcgcatacatcataaatacatccctctacctgagacctccacgtaagactctcatctttccacttcagagttccagaagtgtcccacggcattatactacccccaggcttactcttactaatgtgaaacagcttcctccccctattactccctctctgtatatgccgcatttcactctgtattatatcacccccttcttccctcacacttcatagtacactttgatctggtcaaaactccaattatcggggatctcatcttacgtcagtgtgttggccttctctgatgcgcactggccgtcgtaccccaacggggattagataccccactatgcttagccctaaacctcaacagttaaatcaacaaaactgctcgccagaaccacaaatatcg

SEQ ID NO: 726220 - DNA, 223 bp, Homo sapiens
  misc_feature (66)..(66): n is a, c, g, or t
gtccatgctgtatccaacattggaggtcagcaggcagatcatgaggcaggagttaagatagcctgncaagatgtgaacatcctgtctctactaaagatacaaaaaattagcctggatggtagcacgcacctgtaatccctgctactcgggaggctgaggcagggattcacttgaacccaggaagcagaggttgcagtaagcgaagatcgcaccattgcactcc

SEQ ID NO: 726221 - DNA, 125 bp, Homo sapiens
tggggccttttgggtggggtggggggctgtggtcaaaccctattttgtatttgggacttaaggtggggggagtaaaggggcccctggaaaatgtattccaaacaataaaactttgggcctttgga

SEQ ID NO: 726222 - DNA, 922 bp, Homo sapiens
ccatattagcgtccgtggctgagtagccccattatactatttgtgcccgcaattgggttttccttggggaaccttccacagatttgggcaccttgacggcgtgcccccctagtacgacaaaatttggcgcaatactgtgcgagaattttgccacaacggcgcgcacactgtgacaaccactggcggggccccatcacaagaaccaggggttatccggcctgatgcggtaacttcccaatccacggtagcctgggaagccaacacttatctcccgggggatgcccgcctctccagtacttgccccaaggtgtctgtcgccccccccattcagctgcggctgggtgggccgaacaacagccaccggcggtagtaaggcctctggccgcaagacgtggtaacaacgcggcggcacccgcacatggtcaaggggacaagagacctccacgatcagggcgacgcacaagagacctcatctgcggacgggggccacccatcaggcagtatggcccggaaaccaccccaaccggacggtcccactgccgggggagggcgcactgatgtcttgagccgccggctgatgggcgaaccacctccccccgcgggagatcgacccacgcaaacatcctttcagtctggccctcaactcgaggggaggccaagacattgcccccccggacagatcatcgcgcggccccggtgatgcccagagggaaacacgtcaccaaggagactagttcaccaaggggctggagcgccgtggccccggagcaagcaacgccccgggaggagacaccaccacggggctaacaatacataagtgagcagtggattcaaagcgccccacatacatctgccagcacgctaaaacccccgggccccgcccagtttcatacccaaaaaggccccgcttccccctcataaa

SEQ ID NO: 726223 - DNA, 159 bp, Homo sapiens
gatcactaagtcgatcagggccatccttgcagctgcagcacaacgctctcgccgccgacatgcactgagcagatgcaacctttcgttgcaccctcaagagccacaacggctgggtaacccagattgctactacccgagttacccgacatgatctatccg

SEQ ID NO: 726224 - DNA, 1138 bp, Homo sapiens
gtgcctccaggagcactcacagccctcacagattctctgcaccctcctcctctgctggtgtgtccttggaagagagagggccttccggaaggctcagagacagcctcctctcctatggagggggttccgagattgctaaaacgtttgctcctcacatgggtcaactgttccagtgtgcggtgggccacccgggttcaagacatcgttcacagctgggaagctcctgggctggccctgattatcagtcatggggattgtacagatatgcaaaggagagtacttctggctggagcctagaagaatgcgatttgagaatttccaggaacctgacatcggcctcgtcgcacgtggctttccttctagggctcctttgcctatggaggctggaacgtttctgaatttaccgtgactgaggagcgttgtgatccctactagctgttcttcgctggaagcccgagagggtcatcttcccaagtgtgtaggccagtgatccgacgtgaagcgcttgcagtcccaatcccagccctgctcttcacatgcatctccacccgtgctgatgctggtcaccagtcgacatgtacagcactcatcgaacgtacgtgggcttcatcagagtaccgtcttctatggggtcacggttgctggacaggatagtccttcgcatggaagaagcctgattattcccccgtgcccattccaagcccctgtcctaccagggggtgagtgtgggaccagcagagcgcgacgggaagctgcaagcctttggccctgtgagcgatggtggtcttcatgtggagtgaagaaggacgcgatggaatggccccagtcccctatgtcctggggggccacggtggctaggacaaggttccaacgctcaatggctctgggtcccacagaagttccagcccgggcgggtcccccactcaatcttacactgcggtggcctggggccttccaggcggggcctttcaccctggggggcagaagccgcgggagagttgtgggatgggggctgggccatcatgccgggcacgagcaagcgacggccacataccacgggtggttacaggggcaccaaacgaccgcaagtgggtcgatgacctcttgtgagcgcgcttaacccgtgtgtgcgcaaaat

SEQ ID NO: 726225 - DNA, 162 bp, Homo sapiens
aagagagtaactaagagtatctacatccactttcacaagtgcgtttaggaaattaggtgcaatgcctattccatgtgatctctaaactcaatagatattctattcaagtgctattatacttgtccataaaattgaagtaattatattttcataccctatatt

SEQ ID NO: 726226 - DNA, 2065 bp, Homo sapiens
tagcgggtcggcgcggagcggaaggtgcagctcggtttcccccggcacccctccccctcgggcgcagccccaccctccgccggccgggccgacccacgcagaaacatatccctcatgcggcagcgagcacaggggcgggcatcaaagcgcaccccacaggcagaacccacatcaatgtggcgcagccaagacgactcacaaggcgctcccccagaggaactaccagatagaaccagcacgagagagcaggcccaagagaaggacgacacataccacacgggacgaaaacagggccaccaaaagcggagcaccaggcaagacacgtggggcaccaccggatgcaacaacacagccacaacagtgcggaagacactataaaataccgcacaccaaaaaggagcacaagacaaaggggagagaaatataccaacacacacaaatgtgatagcaaacacgagcgaccacgacacacatagaacggagcacacaaccacgaggaggaaacacacatctaatcagaccagaaaatcgccaacacagaaagcaaaggcacaaagaaaacagaccccacgaaaataaaagcccaccagagaggataagcagagacaagcaggcacccacaagggagacgaagaaaacgggaacacacaacaacaacaaaaaaaggagaacaaaaacgcaccgcgacacaacgacacagcaaccaacacacaaagcgaaccaacctgaacaaaacgagaaaacaacaaacgaaaaaagccgcccgcactaagctagcccaagcacgaatgcaggcaacacagcaggagaacctgtgagaagccacgatatacgccagaggagcaagaccaacacaacattgcaggaggaaaacaggagacacatggcagatgagagacaacaagcaatagcaacaccccacgatgcacaagtgagacccctatcccgaatgcaagaacgcacacaccaagtgaagaggcaacaccaggaagagcaaaccgtacaaccaagaacagagctagagaaaggaaaacgaaaataacagaagtatgtcacccagatagacacaagagcagcaaaacaacaaaggacaacacactaaacgtagtcgcctatacacaagcgaacaaacacggggaccaacaagcgacagcacgcgagaacaagcaaccacacaaacaccagcatatagaacaaaacagcaaccaaacgacagaacaacccccccaccaagaggtactctaaggagcgcgagggacacaaagaaagaggacgcaatgaagaggaacaacagacacgctagcacagaaaaagaggaaaaacggaacatgacaaaagaggacacccacaccgaaggcgaacaataacaggaaccgagacagaaaacacaagcgaacccacctaagtggagggccacccgcagaaaaacaagctggtgcacacaaataaagagaccaaagaccaaaagatagacgactgaagacaaagaaaacggaacagaaacacacgaaaggacaaaagagaggaacacacagtagaggcgcgaagaaaagacaaccagacagcgctggtaacacaaggcaggatgagacaggccaaaaatgatataaaaaagataagttgagtacatagtataagcattagttgattcacaaatatgaatgaacaataatagattagaccaacgaaaaaagagaagcaggagagaaaatattagaataaacaaaccagaaaatagagtatatcagataataagccgatacacaacgacgaggatggatagttaacgcaaagcaagaaattgtggaattaatcaaatataaaggcgacaagtacaaaaatgaggctaattaatgaacttaaccacagaataaagattaatctaagaaagaagccatataactgagacaactaatatgatatggtactacaccataattaaaaaggttgagaaacatacacaaaaataaagaagatgaagttaacataacaagacaaaagaagatagattctacaataggtactcgcaaagagttacataaatgagagacacgaccaaactaaa

SEQ ID NO: 726227 - DNA, 914 bp, Homo sapiens
agcaggggcgaccgatcaggttggtgtccggtttaaacgagcgcccggcagcgacaaaagagcgtcgactggaacaagaacgcgcaagggggtggaagtaacaccctacctcccactctgcggggtaggtccaggggccccggaggcggcagcccccccgtcgtgggagaagtcggtcacagatgccgccgagagcgtgaccggcagacaaaacacgggggggtcggcttacctgcggcgggggagctcacccgcacagagtggggtcagcagtgtagtctctctcggggggaatcaacacgttgcggcaaggagtcggtgagtagcaagctcgcggcgcttccgagccctaccgagacagaggttcgtcttgggatcaagttgagctcccagctcgccggtgatccattggagcgtgtacgcattgtttccaaacgagcgcgggcgcggagatcggacagaaactgtgatctctatctcataggggcagccactggaggtggagcgtagagagctcctcacgactccctctgctagcgtcgagtgagcagcgcgcccgctggcccccttctttgacgaggacattggtcttgtcagccccgccagaatgcgccccacagaataagtgagatagagcttcacatccatgccggagtgcccctccggggtgggtggattctctctggcggtggacaattcgtgagaatagggtggtcacatcgcggctcttcggtcgacgggcgatgccccgggtaagtagcgacgctcaggagctcatctcagcgggtatgatcctgcaaaggggcggggtgactgagtcaactatgccacctctcttctagaactttttcaactaaagactctctgagtcccgtcccttgctgtacaaaaaaaaggtccaccgcccacatgac

SEQ ID NO: 726228 - DNA, 329 bp, Homo sapiens
tccaggagatagctatagcatgcctgctgtcactggacgtcgcgtcataccaggtgtcacatgtgcccttcatagatcttcaccatggattaagtacctgtacaagcttatttcccccttaaaaacaagttgctttgtgtgtcttgagtggtcggagttgttcatcttgacgtgtcctaggatcagaggactgcaccatgtcttctccagtttggctcagttttttagtgcagtagggtggaggcatgcagtgggcaagcaagcaaagggaggcaagtaaagtttaattcatgcctttattgggttgaggtgcactcattaagcttacg

SEQ ID NO: 726229 - DNA, 153 bp, Homo sapiens
taccagattaaagggagcagttttctctaaacttgaaacaactgaagatagctgcatattaaccacaacaacctgacagagtcagtgggcccacttcccatatctctggaggatctgcagcttactcataactagatcacatagctgggctca

SEQ ID NO: 726230 - DNA, 249 bp, Homo sapiens
tattagcaactttgctacacttatgctgaatgttatgagaatcgtgaattaataaattacacagtaattcctaacttaaagtaaatggaatggtccaatttaacatggcgctgaagattataatagtgcctgtgtggaagggaagaaaaagcaagttgggggagattttgcaaagagaattggtgttcctccttcgtagtagcccgtggtgtctaggtcaagagttagggcataagtaaaaaagcgaaa

SEQ ID NO: 726231 - DNA, 373 bp, Homo sapiens
  misc_feature (125)..(125): n is a, c, g, or t
  misc_feature (239)..(239): n is a, c, g, or t
  misc_feature (268)..(268): n is a, c, g, or t
  misc_feature (357)..(357): n is a, c, g, or t
  misc_feature (371)..(371): n is a, c, g, or t
gagcgaggtgaccccggctactaaagaagggtaaggcagagtagccatgggggcgcacctgacccggcgctatctgtgggatgcctcggtggagcctgaccccgagaagatacccagcttcccgnccggaacctcggcttttccggagcgcaaggagcgagtgatggtggccacacaacaagagatgatggatgcccagctgacacttgcagcaaacgtgactacttgttgcccactanctcatcccggctgcttgaaagttgcaaancgagacaagctttccccaactttcctggccttgcaaagcaccgagcagcaccgactggggactacttgcgaagcaacttggggttaagntgaaaacgcgttgnaa

SEQ ID NO: 726232 - DNA, 418 bp, Homo sapiens
  misc_feature (146)..(146): n is a, c, g, or t
tcagtgatctcagtagatactcatcatgattcatgcattagaggaaaatattcctgttaagtggaaaatgtgcggatggctactggaagacttcattctaaggagctttatagtaaaacatttcatttagaaatctgaaccttctntcttcagtttgctgtaatccacatgcactgagtagaacttgtattgatcatcgcgacccagtaggtacagggctctgggttagtcttcctgtcccaacaaacatctggattgaacaatgtcaggaggcgagagaaacagtgctgctccattacctccagttccaataaatacgaaaagggggatcaccttcgcatgcttcttggcctgacccatgatctggcggagaatgtctgcagcagaagcctccaactggaaaggagacaaccagcct

SEQ ID NO: 726233 - DNA, 520 bp, Homo sapiens
cgataccagactggcacagagcacgtactccatctcaaaaagaaagaaaagaagactctgacctgtactctgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatatgataaatatacttttgtgaacaaaaattgagacatttacattttctccctgtatggtgactcggcgtgtgcaacaacttcgtccattcggatctgtatggtcactcggagtgtgcacaccgcgatctgcaacaacttcgtccatactgacttgcaacaacttcgtccattaagacctgcaacaacttcgtccactgcg

SEQ ID NO: 726234 - DNA, 959 bp, Homo sapiens
ggtcattgataaaaacatttctaagagtggggctagagaacatactttacatctgacatccttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttccaaggaaccagttggggcacggtatgtgagacccctatctctacaaaagaatataaaaatatgagctgggtgtgatggcacacacctgttgtcccagctactcaagaagctgagatgggaggatcctgagctcaggaggtcaaggctgcagtgagccgagattgtgccactggcactgcaagctggggttgacagtgcaagaacctggtcttaaaagcaaaacaaaaccacaaaacaaaacacattatagacacacacacagcgaggtccaatatggtagcagggcatccaaggggaacacagtatgtaggtcaaacgtggccggtcacagtgtacagcttggacaaactaaacatattagagtaggcaaacacacctcaaaagtgtaggttgtgcacaaacataaaaagtgggcgctttcatctccggagtggtgagtcattactgtgactgtcaaggaggggggaccgctttggatagcctcaaaaacttcgcgggggcagtggtaaaccggcgacgagacagacacagaaaatgggggcacccgctctaaggtcggcgaccaaagaactgacacgtcgggagcaaacatcttctcaaaaaggcagttgaataaagtggctccag

SEQ ID NO: 726235 - DNA, 105 bp, Homo sapiens
tataacgtaacacctgaaggaatctaaagttccgggtaaggtcgttccgttcaaagttggcgttgttggaccaacccccccgttatacccgaccctgggcctttt

SEQ ID NO: 726236 - DNA, 460 bp, Homo sapiens
gtacatccggatcatcatgcacaagacactatagatgctatttacgttttagaaaaaaaaccacacactttcttttcctatacatctgctgccaattaatttgctgacaattttctgctggctcaactattttgtttatacacaggtatagtatttaacagaacactgtacattctttttcatctactaaataatatttgcattatatagtgttcgttcttcttgttccatgtcaatggacacttttaattatgtgttttaaaaaggaagatcttgcccctactggattctagaaaaagcaatacaaaatcttaagtatgaaacctccatcaccagccagctatgttcatgtgacaattcagcatgatatagacagttgctttaaatcttaaaatacttagttgattaacttaatcatcttctttatggaaaactgtcagtcaaaaccagaacatatcgc

SEQ ID NO: 726237 - DNA, 219 bp, Homo sapiens
atcgagagcttctaggcgcagcgaccgaaggaggaatatcagacccatatccagcatgtggagaacaacaagaatgctgacaacgattggttccgactagagtccaacaaggaaggaactcggtggtttggaaaattctggtatatccatgatctactactactgcccagaaatttcaggtcctgagctggatcgacagacagcaaagatgtacaggga

SEQ ID NO: 726238 - DNA, 396 bp, Homo sapiens
  misc_feature (151)..(151): n is a, c, g, or t
  misc_feature (169)..(169): n is a, c, g, or t
  misc_feature (296)..(296): n is a, c, g, or t
  misc_feature (300)..(300): n is a, c, g, or t
  misc_feature (302)..(302): n is a, c, g, or t
cattaactctgtactaatatagtgctgtttggtaaatgttaaaattagataatttatttttcttcacatttttcttagtatggttcttctgtgtcacacaataggaaggaagtacagaaatgaattgtttttgtaaacctcacttcttacnaactatttgtagtgtgantttcaagagaattgttgtttttctcgattaaaggggagaaatggaagtaagtgtgaggcaacttaatctttaataacagagctggaagttaggaatggatagctacagtaaatgacttctttttttnagtnanatgccacacatgagcatgaatgtttcagaaatgcaacacatgattaaatagaaataacaatggagttatatgccactccagcggggatcctcta

SEQ ID NO: 726239 - DNA, 248 bp, Homo sapiens
tccgcgactgactccgcggctgaccaggaataccccaacctcgtccacgagactgatttggaataccccaacccaaccacgagactgaccaggaataccccaacccaaccacgagacttatcaggaatacccaaacctatccacgagactgaccaggagtacccgaaccgaattacgagactaatgtggaatacccaaatctaaccacgcgattgatcaggaataccctgacttaaccaccagtttta

SEQ ID NO: 726240 - DNA, 833 bp, Homo sapiens
  misc_feature (693)..(693): n is a, c, g, or t
  misc_feature (801)..(801): n is a, c, g, or t
  misc_feature (833)..(833): n is a, c, g, or t
taaaagttcggaaaatttgcagcctgacaatgtgatagaaaagaaaaattcccattttctgaggagaaattcaagctggctgcagaaatttgcatgagtaacaggagccaaatgctaattcccaagacaatggggaaaatgtctccagggcatgtcagaggtctttatggcaacccctcccatcacaggtccagagatatcaggaaaaaatggttttgttggccaggcccggggtcctcatgctgtgtgcagcctagggacttggtgccctgcatcccagccactcccaaccatgactgacaggaggcaaggtagagcttgggctgtagcttcggggagtgcaagctccaagccttgacagcttccatgtggtgttgagactgcgagtgcacagaagtcaagaactggggtttggaaaccttcgcctagattaaagaggatgtgcggaaatgcctggatggccaggcagaagtttgctgcaggggcagggccctcatggagatcctctgccagggcagtgcagaagggaaatgtggggtcagagaccccacacacagtccctactggggcaccacctagtggagctgtgagaagaggtcctccagaccccagaatggtagatccaccgacagcttgcaccgtgtacctggaaaagttgcagacactcaatgccagcccatgaaagcagctganagggagctgtaccctgcaaaggtacaggggcagactgccaagacatgggaacccaccttcattgatgactgatgtagatgtgagcagagaatatttgacttaaattgntgccctgatttgcttatggctgacctttgttn

SEQ ID NO: 726241 - DNA, 880 bp, Homo sapiens
  misc_feature (44)..(44): n is a, c, g, or t
  misc_feature (86)..(86): n is a, c, g, or t
  misc_feature (109)..(109): n is a, c, g, or t
  misc_feature (114)..(114): n is a, c, g, or t
  misc_feature (117)..(118): n is a, c, g, or t
  misc_feature (122)..(122): n is a, c, g, or t
  misc_feature (126)..(126): n is a, c, g, or t
  misc_feature (141)..(141): n is a, c, g, or t
  misc_feature (146)..(146): n is a, c, g, or t
  misc_feature (163)..(164): n is a, c, g, or t
  misc_feature (223)..(223): n is a, c, g, or t
  misc_feature (374)..(374): n is a, c, g, or t
  misc_feature (378)..(378): n is a, c, g, or t
  misc_feature (426)..(426): n is a, c, g, or t
  misc_feature (435)..(435): n is a, c, g, or t
  misc_feature (441)..(441): n is a, c, g, or t
  misc_feature (483)..(483): n is a, c, g, or t
  misc_feature (485)..(485): n is a, c, g, or t
  misc_feature (490)..(490): n is a, c, g, or t
  misc_feature (523)..(523): n is a, c, g, or t
  misc_feature (554)..(554): n is a, c, g, or t
  misc_feature (625)..(625): n is a, c, g, or t
  misc_feature (632)..(632): n is a, c, g, or t
  misc_feature (650)..(650): n is a, c, g, or t
  misc_feature (714)..(714): n is a, c, g, or t
  misc_feature (726)..(726): n is a, c, g, or t
  misc_feature (741)..(741): n is a, c, g, or t
  misc_feature (764)..(764): n is a, c, g, or t
  misc_feature (797)..(797): n is a, c, g, or t
  misc_feature (865)..(865): n is a, c, g, or t
ccttttaaaaacgaaaatgcaaaggcagtcagtgaatcaataanataaacctatctatagcagtcatcaaaagagaggtaacagtnaccagtgtgaaaatatcacaganttcanagnncacncggntctccaatgagtcgngtgtntatccgacacagcgggnnccggtagactgaagacgaatcccccccatgcatgccccacccccagtcaagcccttccncatcaccgtccaccagcccacacagtggggtagccggctgccgaggcaattccacaatggtttctccggtctttggccatctttacgtagccacccatgccccattcttcaccccagctgtccttcaccagccaatatttattgttatctnattntgttctttcaaatccgtagccaaccaccagcacaccatgacccatgtnttcactgcnacagtntggctcaaaataaatgccttctttatagaacaggaaggactnangaccngcatcaatagcaacagaaatgggccccacagtngcaactgccttcatcagggccttctcctgcntagggatgtccacaaagccggtgtcattagcaacagaatacttgggattgtacttacaggattcttctgtngcctcanatggataggattcctcanagttcaggcctccattatcctgaacatactggaaagcataatccattaggccaccattgcagcnttcattgccttnaggcccagagcagtntaccagattctgctcactcagtnagataagcctcccagttttccggaacatctgtncttcaagagcaccagttgcactaaaagcccaataagaaccacactgaccctgattcttcataggagtnacgtagcctttctct

SEQ ID NO: 726242 - DNA, 549 bp, Homo sapiens
ctcggagatctccggaaaactgcacatgtgaggcggggacgcatggggaagggccgaagccccggacagctccagacataaagcagacggatcgcactgacgacaccgaagcgcgagtcatggctggggccttagatggcaacaagtgctgagatcagcgggctcagtagcaggaacacaagcaccacccttgacaggatgatcatggaaggaagacggcgcaggacagatctcccgaatccaccgtgtcgggcctgaagaggccgcatgaacgctcgcgattcacatgagcgcatcatggtaggcatcgcaaggccatcaacctaccaggtgaagctcgaggcgctgtggccgcatattagaagaccagagacgagcaagcatcaagatagcaaatccgcgcgaatgcgcacgcctgagtagcatgatccaacatccaccattggaccaccattcgtgacaacaaggaaaagatctgggacgagttcccaggaggccacactgcaaggcggacaccaagattgacagcgatggccagcagccatggat

SEQ ID NO: 726243 - DNA, 584 bp, Homo sapiens
ctccctctaatctagaaaaatagaagtacggcgagtacgatgctgtgtgttaatgaggctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagaccagaaggatgtaaaggatggaaaataccagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatac

SEQ ID NO: 726244 - DNA, 126 bp, Homo sapiens
gcgtcgacggacacacccacggtgcggccacggcggccagtggtcttggtgtgctggcctcggacacgaaggctccaagaagaaataagtctgtaggccttgtctgttaataaatagtttatatac

SEQ ID NO: 726245 - DNA, 288 bp, Homo sapiens
gggtgagactgtctcaaaaaataaaataaaacaaaaataaaataaaacttgcctcaggctctcactctgccttatgcccctcaactgaattctttattctgaggagataagaattgaggttgctgcaaacccttatggattctccactgctaacagtttcagatagctaggaggaggatattaaatgttctcaccacaaaaaaggataaatgtttgagatgatggatatgcaaattcctatgatctgatcaccatgcagtatatgtattaaaacatcactgtgtactc

SEQ ID NO: 726246 - DNA, 769 bp, Homo sapiens
ctccctctaatctagaaaaatagaagtacggcgagtacgatgctgtgtgttaatgaggctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagaccagaaggatgtaaaggatggaaaataccagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacaaagataaaaatagttttttattttatattcagagattaataaaaaaaaaaacttcaggcggcccccgtccccaatttccctatataattcttttacattcattccgctcgttaaaactggtacttgaaaaacctgctttcccaattaatccctttaaaaaatcccttttcaacttgctattaca

SEQ ID NO: 726247 - DNA, 921 bp, Homo sapiens
ctccctctaatctagaaaaatagaagtacggcgagtacgatgctgtgtgttaatgaggctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagaccagaaggatgtaaaggatggaaaataccagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaacgacatgcaaaataagtctagtatggacctctgtctggtctaataacaataagttctaatatagccactaacacatagagtagtaagagaagaggggcgctcggatgaagaatgattccccttagagaggcacgcaaatgtaaacgcgtgtgcacacaggagtcttggtcgaccgaacggtgggccgcccttatcgggcgaattcgttattagtgaatccttggcgcacgggacacaaaggattggcccaaaccagtgtgtgatcgggggaaaacggggtacattgagcggacctttagtgaagtgaaccctaatgtcctgggggggcggccttgatgggccagatctcctcacaagagttacgggctcgcaagggaaggttcag

SEQ ID NO: 726248 - DNA, 772 bp, Homo sapiens
ctccctctaatctagaaaaatagaagtacggcgagtacgatgctgtgtgttaatgaggctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagaccagaaggatgtaaaggatggaaaataccagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtggtcctggtaagagaatgagctctgtcgcggcctggtctgttgctgatatagctttatataccacacaggaccggaatggggaagccggcggggctgtctcttcagggtcctgccagggaggtgtgtattgtctcggcgactgggcatcatgagtgtcctgtagccagattttggtccaaggggtagaactgggcgtccccagtgggcgtccttgattgggtaccggttccgctgacgggag

SEQ ID NO: 726249 - DNA, 244 bp, Homo sapiens
accggatgcgacattcactaaatgatttcataaacaccaaaaagtagttaaactttgtatacataaccaaaaaaaaaaaaaaagaaccctgtcctttcacggtttttgcgcggctgtccatccccccaaaaatccaattaagaccttattggcttctcaaaattttataaatttaattaaaacctttggctatgattgtggtgtccccccttttggcttaaattccccctccaaaattccaaac

SEQ ID NO: 726250 - DNA, 643 bp, Homo sapiens
agcgccagactccatctcaaaaaaaaaaaaaaaaaaaaaaaaaaaaaaaaaaaaaaaaaaaaaaaaaaaaaaaaaaaaaaaaaatttcccccggcctgggaaatttccccttttttgccgtcttccccccggtgtcccccccggtgtttttttttcttcccccccccccacaaccccccccccacgctttttggagctgtcaccgcgtgtttttttatttgcccaccgaaagttgtttttcgccccccgcggttatttattttcaacgccgtgtcgggggggcgcggctgtgtggtgctccctctccccagccgcactcttctatcgcgggggactatgtgacttactccgcgagcgcggcggtggtgcctctcctcctcctgtggtggtctcttttctccccactattgttttctacattcttctcccccttttttctcctccgtcagtgagagccttcttattatttgtgggtcctctctcctactcttctagaggagtgatattgtgttgccgcccccccctttctgcggcacaagatcatctgtggcgtatcactcgttggtgcatatgtgtgccgcaccccccgcattttcttttttggtgcgtctcctatgctgctttagttcctctggacctcgct

SEQ ID NO: 726251 - DNA, 182 bp, Homo sapiens
tagacgtatctctttaagttcaggggttgatgtgcaggcttgttacatagctaaacttgtgtcctgagggtttgatgacgtcatcaaaccctggtcatcacaccctcatcaaaccctcatcaaaccctggctgagtggtctacttgtagggtttagggtttcgatgaccagggtttcgatga

SEQ ID NO: 726252 - DNA, 335 bp, Homo sapiens
cccccccccccccccccctcttgggggtttttgcaccccgccgtactcccggtgttaaaagcggtgggaaatttccgtttttccccccctttaccccccccccgggtttttttaaaaaaggggtttaatcccccctcccgtccccccggggggggtggggcccccaatttttttttaaaacttcccccccgggtttttttttttttggggtttttttttttgggcccccaatttttttttttttcccgggaaagttaaagggggaaatttaacccccccccgttttttttggtaagcccgggatttttcccaaaaaattaaaaaggggccgggga

SEQ ID NO: 726253 - DNA, 162 bp, Homo sapiens
tgagccggtccgacttcgaggatggtcttcttctcggtctcgcgtggtgagcgccttcgttgtcgatctcgccgccgcaacgtcgcgccacccagtcgatgaagtcgagcacgttctgccagcggctggccgcgagcttctcgttgtcctcgccgtcgtaca

SEQ ID NO: 726254 - DNA, 450 bp, Homo sapiens
  misc_feature (198)..(198): n is a, c, g, or t
  misc_feature (217)..(217): n is a, c, g, or t
  misc_feature (221)..(221): n is a, c, g, or t
  misc_feature (231)..(231): n is a, c, g, or t
gcacagggaggactgcttaaacccaagaggctgaggctgcagtgagccatgatcgtaccactgcactccagcctaggcaacagaccaagaccctgactcaaaaaatcccaaaaaaaaaaaaaacagaaattgcttttcttatggtatatatcttgcctattataatcaataaatatcattgtttaattagatcagttnccgcgttgggcgtagttgnaagnaaaggggggnttagtataaagacatcaccagttgcctcataatactatttcaagatctcaggttatcttcttagtaattttgcctgagttcccagtcactctcaatattctgtcctctcattcagtcccaaacaaaaaataaacaaacaaacccttttctaaatgtaaaaaggggcaaggaatggtggctcatgtctgtaatcccagtaccttgggattacaggcgtga

SEQ ID NO: 726255 - DNA, 470 bp, Homo sapiens
gcctagttttcatatttttagtgaagatggggtttcaccgtgttggcggggctggtctcgagctcttgacctcgggtgatccgcccgccttggcctcccagggtgcttggattgcaggcgtgatccgccgcgcccgaccttaactatactgtttataacctgcgtggggttttaaaaagccattccaggctgggcgcggtggctcacgcctgtggtcccggcactttgggaggccgaggtgggcgggtcgcctggggtcgggagttccagaccagcctcagcatggggaagccccgtgtctactaagaatacaagattggccgggcgtggtggtgcatgcctgtggtcccggctgcttgggaggctggggcgggggagttgcttgggcctggggggcggaggttgcagtgggccgagatcgggccattgcactccagcctgggcgacaggagcggggctccatctcaaag

SEQ ID NO: 726256 - DNA, 170 bp, Homo sapiens
gtaaagtagagcacaagaagaagcggaccttccgcaattttcacctaccgcggctgtgtgatctcgcaccagctgctggacgatctcctacttgcatgcagctgatgcatcctgtacaggtgcgcgccatcgcgcggcgtgctagaacctggggctctgcggccggacag

SEQ ID NO: 726257 - DNA, 113 bp, Homo sapiens
tcgtggttactacgacaaacggctgctggaagttacctgcaggatgtgagcttgggtaaatgagttgttttacgaaacggggttaactaatccggacatagcgcaaaaacttg

SEQ ID NO: 726258 - DNA, 667 bp, Homo sapiens
taagttggggtgatgaggaatagtgtaaggagtatgggggtaattatggtggggccctccggtatgtattaagtgggggcttatgaatgaagcgaacagattttcgttccatttggggttcctccagggtttggtgtataatttttttatttttaatggggtcttgggtggaggggaggtcaggtgggtaagttgggtggtttaattatttttatgttcgggtgatcgcaggaataagtgtaacggagtaatgggggcgtaatcttatcgactatggtgcggcgttcggatctggtgaagattattggcgcgctggtgtaaattggctgcagtccatgtggtttataatctgtgaccggcaggctatatcgcaggagagaagaatggtttcccatggttcactttatactaaactattaggtcctctctaataggggctggataaagcattgggctccaattgggcgtgtagacgagacgtctccagttcataatctgtcgaggagcgatatctttacaacgcgtatgtgggcgttgtttgacgcttagaaccgcttctctaaaatcgggaggcgctgctattatagcgcctcactatgggggtggtccaacattttgtacactcttctctacaggggtttttctccctctattttggtcccaaagg

SEQ ID NO: 726259 - DNA, 279 bp, Homo sapiens
agtttcttttttttaatggaaaaatctattttaaaatctattgttactttctagaaaaggaagattgtgtgaagatgtaaggctcgccatgctgggatgtttctatccttctattttttcaaccgtgtgttaagtatcttctacataatacccactgcactcaccaagccttaaaagcacaagtagtaaaatagcccgtcgtcaaacaaatcacagcttacatgtgacatgtgaaaatgttaggtcgacgcgcccgcgaatttagtagtagtaggcggc

SEQ ID NO: 726260 - DNA, 244 bp, Homo sapiens
  misc_feature (192)..(192): n is a, c, g, or t
agcagcattactcagaagttccaaaaggtggagaaccaactgtccattgtggatgaatggataacaaaatgtagtatatacacaatggaatgttattcagaattaaaaagaagtcctgatacattctacaacacggatgacccttgaaggcattatactaaatgaaataagccagtcacgagacaaatgctntatttcactttctttttttttttttttttttttttttttttttttttttttt

SEQ ID NO: 726261 - DNA, 159 bp, Homo sapiens
ggaggtcagagtggaagcaggttttagagggtccagcagaaggaacatggctgccaaagtgttttgagtccatttggcaagttttggcctggcctttagcttgttgccagggaggccgttggttgaactcttgcctttattataaattgttggatgcct

SEQ ID NO: 726262 - DNA, 1829 bp, Homo sapiens
  misc_feature (655)..(655): n is a, c, g, or t
  misc_feature (713)..(713): n is a, c, g, or t
gctcacgtctgtcgttgagtcgtgtgtctgcgttgtagtctggatatcgttcgttgctgtctgctgtcattggtgtagcctggtgtgttgtgcgttcggcttgctggtctctggcgttctgtctgttgctctagtattgtgtttgtattgtgctgtgttgctgtggttgtgtgttgcgatcgtcgctgctgtgctccacctagtggctatccctagaaaccttgttcgttttaaacacaacccggtgtgtgggcgacaccatatatagtccctcgaggggctccccacacgtgtgcggtggccccagagagcccgcccgcggttgtttctacctctcgcccccttcgtttttttttgccggcttctctatatgggttacgcgcaccgctggggggtggacgaattcttcccccacaatgaggggctctcccccctcgtcacaaattgggcctcctgccgcccaatatttgtctccccagcagaaaagaggagacaagttgttttcctccccctagagtggggatagtttgtctacaaagctgtgggaaccgttataaagtaggttttttgtttatcctccgctgagcctcttgtcgctgataaaagtatgcggcgttatatcttctctggggaattatttatgagtgttctcacnggagggtcgtaccacccccccacgcccgccccttggccctcgtcgtgtcccttctttntgtcttgtggccccccctcctcgggaccaccccgacgaaaagtgtgtttcgttcttggtggtaataaaaagggggtctccccgcgcggggtatttcttggggggatcccttgttcttcgcttcgtgtgtgatggttcttccgcagcgaaaagagaggtgttttttggcgcttgtttccacccagaaaggggcgccacactttttttatggaggccgcttttttattgccctcggggtaaaaaggggggggccccccccctcgagagagggttctctctgttgtgtggcccacccatcagggcgccccctcggcggccgcagaggagtgttttttcttctcgcgccggtgttcacccagcaaacctcccttctctaagagtgaggggccttcttttgcttcggtgtcgcgccgagagaggggtcctctcctctctcttataggcgttgtggtggtccttcctcgggggggtttctcaacacacactgcgagaagagagatagtgggggcccccaacatagagctctctcccgagagatttcttgtggtgtttctttgtgggggatacacatctcgcgagagacacacagagagaggcgctatatatactccctgggagagatattgtgtgtggagtgcgcccctgtgagtgtgatactccccacacccgggaggaaccgccctgtgtttatacactactctctacacctgtgtgacgcacactgccctgtgtgcgcgcccccacacgggtgttgtgcttctcacacacacagaggtgttttctctggggcgcactcaacagagtgtaagaatctcactgtcttgtcccctgtggggaaccccacactgggtatagagattggccccttagaaaccccctgtcctggacacacgctggagccattttgtggacaccccaagaatatagaattactttcccccccaccccccatttctcagagcaccagaaaaggtgtgggaaacccgagcacccctgcccatagcccccgacccggtccccccccccatataccgggtttccctggccgaccgttttttggggtttggaagtttctcttcttaaaaccctctttattaaaatttggcccaaacaccca

SEQ ID NO: 726263 - DNA, 368 bp, Homo sapiens
  misc_feature (30)..(30): n is a, c, g, or t
  misc_feature (57)..(57): n is a, c, g, or t
  misc_feature (257)..(257): n is a, c, g, or t
  misc_feature (298)..(298): n is a, c, g, or t
  misc_feature (304)..(304): n is a, c, g, or t
aaacaagacaaggatgcccactcacaccantcctcttcaacatagttctggaagtcntagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatncaccaacagcgaccaagctgagaatcaaatcaagaactcancccctnttacaacagctgcaaaaaataaaataaaataaaatacttaggaatatccctaaccaaggaggtg

SEQ ID NO: 726264 - DNA, 393 bp, Homo sapiens
tcggaaggaggtaggacccaacaaccaacagacaccaaggtgattcgtgtatatccagctgagggagatagaaactcagccgatgctcccagagagaaaaagaagccatgtaaccaggaagcagctccagagctgcgcccagggctgagcggggacttccaggcttcccttggaagagagccccgtctgggattctgtccctttctccccatttcttcgggctcctcatttttcctcggtgttgcaccccagttcttggtctcctcccagtaggaaggggagagatgcaaatctggactcgggtcggtcgcccagagaagggagacttcctctcctctagcaggtcagggactgagaggggcctgacttcggcggggacagctggagaggagt

SEQ ID NO: 726265 - DNA, 227 bp, Homo sapiens
ctggcaacagttgagtttcttaagatctgcattgctgtgtatgttccgctgtattcagaaccagtttctaaccagcctgtgagatgggaagttttttccccctcattggggtgaaacctttcattccggtattttgaattgacggtgtctgtgttgtttgtacccttgtggggaatgccagtggtgttgacattctgagctcttctatgtcaccgttgaaatttgga

SEQ ID NO: 726266 - DNA, 193 bp, Homo sapiens
tccccttttggggtctttgctatagaatgtttaacatcattcccccccaaagctgttttaaccaaaaatgtcttcagacattgccaaatgttccaggaagtggggagtattgcccgcagttgagagttgctgccttagggatagttttgccttactactatggcaagatctttctgcgtactctacccaaaag

SEQ ID NO: 726267 - DNA, 281 bp, Homo sapiens
atcggtaagatttgtaatcagggtaaagccagcgcgtgaatggcaaggtatcaatcactggattgctaatggctggtttttgataacgcgcatacgcagcgttacataaacccaatatcaaacgtcacattgtgtccgatcagcaccgcatccccaacccaatcgcggaaacgtgggatgacgtcactttctggatcggcattggcacccatcgaatccgtaattgatgtcagttcagtcgtaattctgacaggggaaaccaggattgatgtattcagaga

SEQ ID NO: 726268 - DNA, 105 bp, Homo sapiens
  misc_feature (83)..(83): n is a, c, g, or t
  misc_feature (100)..(100): n is a, c, g, or t
tcatccctagaggcagctgctccaggaacagaggtgccatgcagccccgggtactccttgttgttgccctcctggcgctcctngcctctgcccgagcttnagagg

SEQ ID NO: 726269 - DNA, 424 bp, Homo sapiens
gaaaagaggtgtggatatgagagtaattatgacctctgtcacctgctaggctctgcaggagagaaaggctttggagaaaaacttctgcatcaatttagtaaaacagagattatccctggatcctccctgaagacaaagggagcccatcttaatcattgagtgatctggaacagtttgtcaacagaatcccacagctgcaagattattacagaacaatgaagatctgagaaccaagaaaatgaagaaaaagagaaaacaatggtcttagtccattttctgttgctcataacagaacaacagaaatgagtaatttattttattttgtgtgtgtgtttgtttgttcgtttgtttgtttttgagacagagtctcactctgtcgcctaggctggagtgcagtggcacgatcttggctcactgcaacgtc

SEQ ID NO: 726270 - DNA, 171 bp, Homo sapiens
ctgtgcatgacgccagggctggtcgctaaccaggccgcgctcaagtggcatgagctagcggctgagagcagcagggtcgagtaccgggcagtgcaggagattgtttaccagtcggtacttgacagaagtccttatacagcgtcagaacagccgatctgtgagagcgtgtgg

SEQ ID NO: 726271 - DNA, 873 bp, Homo sapiens
ggcacagcttgctgccccgtgaatgctccatgtccccttttcagttccaggttgttcctctgctggaagagcacgtgcctcgcctggcctctttgtctggacaccttcttttctttaagaatccacccaggaatggctcctgacgcttccagatttcctagcactgggccttataacagcatttcttaaaatggggtccccagtccaacagcatcagcatcacatgggaatttgctagaaatgcaacttttggagccctccttggacctctgggatctaaaactctgcagaactgatgctatgagaagcccaagccatggagaggccctaggcaggtgctctggtcaacagcccaagctaaatgcccagccaacaccagcatctgcggccagccgttgagaacacgagacttttgaaaaaacacagacgatgaaactatgtgctctttcagccaatacaatgtgggaagtttttctggtctgttacaaataattcaggtccttagagggtagcttggtgtaacatgtggccacagactctcagtttgggtcctctcatctggtcctccaccgtccaaagccagcacaccattcctgaagcccaagttcacaccctggatttttaccccttcatccccttgagggaccccgaagacaaacagctttgtccaacgcactaatgcttggtcttcacctcaacttgaaggtggcaatggggtcttcacaagagctggggaaggatgctccagaaactggcctgatagttgccctgacttgactgattggaaccactatgagttgggttcagaaaaaccctgggcattgaccgagatcgcctttgtctaaagagcgaagcaccatgtctctagtgacg

SEQ ID NO: 726272 - DNA, 181 bp, Homo sapiens
taaattcgcgtcccgtcgacttctaattaacttgctttttttttctagacctcaggtgatttgcccgccttgcctcccagagtgctgggattacagggatgagccactgcacccagccaatttgctaagtttttttttttttttttttttttgagactctcagaaaaaaattagtgcctgg

SEQ ID NO: 726273 - DNA, 1590 bp, Homo sapiens
  misc_feature (1259)..(1259): n is a, c, g, or t
tgggagtaaggtgggccttaataagctgagccataatttgaaagggatgaagggggaggagggggtgtgccccgatgtgccgggccggccagtgctttaggggcttggtagggtgatgtggaaaacttcgcccaggttaggtggccgattcatcttcgggcttgtgatcttccaccgtgggttgaaggtcttgtgcgcggtgtgaaaagaagcccacaaccagtggcgtgtccacaacacaaatctgcgggtataggatgtgatctcatgtgtgtccgcgacaaggtgtggcgttcttatcaccaacaaactttcgcggggtttcttcacatgtggtgcggagcgcgcctctcctattctgtgggggcgccgtgtggagacagaggcgcgctctatcaagcaggggggaggtgtgtttgcttctacgcgcgccgacagtgtgccccccgtgtgtttctcagaggcccgcgcgcggcgccggcgatgtgcgcggcgcgcgcaaggcggtggtgatcacgacgcgcggtggggccactacgaggagtgtgtgctctcggcgataaggggcaacaactgtgtgttcaccacagaccgaagagcgttggggactcccggagggggtcatcccaaagcgcgccgccggcggggcggacagacggggcgctgcggaaagaatcatcgtcggtggctggagaaaaagaaggtgggtctactcctgagaaagttatttacattatatcactaatcagacctgtgaggatgatgtaccataagaatcggtacttccacaaattactcgtttagaaggcagctacgggtgggagggatgaatcctcaacggcgggaagcgacgggaggaaatttgtggttggttgctggatgcaaacaatgaatggtacaaatacttaatccacccacccgggaggggtcgctgcgtggttgatcggcgggccacccccatattctggtgggggtcgttggttacccaccaaacttaggtggctgtggggacgaggacacccccttcctttatgcgggggccgaccctagttcgacgacagaaagttagagcaatcacttactacttgatgggggggggacggcacgccagccctccattggttagtatcctcctcacaccaaactgacacttcgactgaccccaaaagcgaggggccgtgcactcatacctcacaggtgtgcagggcaaccatcctgcgcggacgaacacaaggttggtctgcccacgccaccgatgngctgcctcctaactacacacttgggcgggggggagagcagaccactctgtttatggaagggcagaatctggtggcggcccgccccttcatttacacaaagaaataaggagggcgtatacatcactagaccgaaaaagaaattttacaattaacgttaacaacgcagcatattggttgagtggtgctagtggtaccgacagagcggcgagagaccaaagacaaacgactataatgggggtgaggggcatcattgtcatgtgatagtgaagaaggagaggaagaaacaagatatataatgtagaagcaccaaacatagtattcttcgtgacgg

SEQ ID NO: 726274 - DNA, 128 bp, Homo sapiens
tgcctaggtctacccggcgcagtacagatcattctattgccgccctctattgatcccacactccaaatgatcatcatcaacaatccgagtaatcaccaccaacagtgactaatcaagctaacctcaaa

SEQ ID NO: 726275 - DNA, 100 bp, Homo sapiens
gagacctccaggaagtctgggactatttaagcattctatccttagataattagcttctcctatcgaggaatgagaaatctaagagtttggaaaacatatt

SEQ ID NO: 726276 - DNA, 140 bp, Homo sapiens
ctgaggatcccttcgcggtatataaactccaaccccgtttcgcggtatataaactccaaccccgtttcgcggtatcataaactccaaccccgtttcgcggtatcataaactccaaccccgactggtagcgacagcaggca

SEQ ID NO: 726277 - DNA, 829 bp, Homo sapiens
ggcacctagctcaacaggccctgcacccatggcccctccaatgagccccagtgccctgagcaagcagggctctggcagcagccatgccatggaggtgcagagaaggctatggctttgggtcaggagatgatccctactcaagtgcagagccccatgtagtcagagtgtgaaacggtcccgctcaggtgagggcgaggtgatgtgtgccttatgctgcaatggtgccacgagtgagccttgaacgcctggacctggacctcacagcttgacagcacaggccacccgtcttcaaggtcttcccaggcatgtaccactgatggacatacaaccttattgttatatagaacgtggctgcatgccccgcatgcagctacactggccagcacaggggacttgcagccatgaaagagaacacccatggtgcccgcacacccatggcttggcaatggaccactatgtcaacaagacggagggagaccggaggcatggccatatgggagccaccatccatactagccacatgaagggccctgaagacacaaaaactggtgccttaatggcgtctttgcgggcagagggacacatggaacagcatcgcacgggggtccccccagcaaatgggctcatcaaacacttaaaattgggacacgcagactcgagcagatcaaacggcactgccaggacgaaggcagaggactcccacgaagcggggtaacccacaggaacacgcaacagtgaggttgcgcacagaggcagaccctaggcataacacaagagcacaacaaagagagccccgggaacaagccagcaacccccaggacgaaacacg

SEQ ID NO: 726278 - DNA, 875 bp, Homo sapiens
  misc_feature (21)..(21): n is a, c, g, or t
  misc_feature (28)..(28): n is a, c, g, or t
  misc_feature (32)..(32): n is a, c, g, or t
  misc_feature (34)..(34): n is a, c, g, or t
  misc_feature (39)..(39): n is a, c, g, or t
  misc_feature (41)..(41): n is a, c, g, or t
  misc_feature (99)..(99): n is a, c, g, or t
  misc_feature (104)..(104): n is a, c, g, or t
  misc_feature (136)..(136): n is a, c, g, or t
  misc_feature (168)..(168): n is a, c, g, or t
  misc_feature (170)..(170): n is a, c, g, or t
  misc_feature (184)..(184): n is a, c, g, or t
  misc_feature (214)..(214): n is a, c, g, or t
  misc_feature (219)..(219): n is a, c, g, or t
  misc_feature (240)..(240): n is a, c, g, or t
  misc_feature (254)..(254): n is a, c, g, or t
  misc_feature (257)..(257): n is a, c, g, or t
  misc_feature (260)..(260): n is a, c, g, or t
  misc_feature (296)..(296): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (333)..(333): n is a, c, g, or t
  misc_feature (353)..(353): n is a, c, g, or t
  misc_feature (356)..(356): n is a, c, g, or t
  misc_feature (358)..(358): n is a, c, g, or t
  misc_feature (371)..(371): n is a, c, g, or t
  misc_feature (388)..(388): n is a, c, g, or t
  misc_feature (413)..(413): n is a, c, g, or t
  misc_feature (418)..(418): n is a, c, g, or t
  misc_feature (429)..(429): n is a, c, g, or t
  misc_feature (459)..(459): n is a, c, g, or t
  misc_feature (473)..(473): n is a, c, g, or t
  misc_feature (481)..(481): n is a, c, g, or t
  misc_feature (488)..(488): n is a, c, g, or t
  misc_feature (492)..(492): n is a, c, g, or t
  misc_feature (495)..(495): n is a, c, g, or t
  misc_feature (506)..(506): n is a, c, g, or t
  misc_feature (515)..(515): n is a, c, g, or t
  misc_feature (524)..(524): n is a, c, g, or t
  misc_feature (528)..(528): n is a, c, g, or t
  misc_feature (531)..(531): n is a, c, g, or t
  misc_feature (538)..(538): n is a, c, g, or t
  misc_feature (578)..(578): n is a, c, g, or t
  misc_feature (643)..(643): n is a, c, g, or t
  misc_feature (653)..(653): n is a, c, g, or t
  misc_feature (688)..(688): n is a, c, g, or t
  misc_feature (701)..(701): n is a, c, g, or t
  misc_feature (706)..(706): n is a, c, g, or t
  misc_feature (799)..(799): n is a, c, g, or t
  misc_feature (815)..(815): n is a, c, g, or t
  misc_feature (831)..(831): n is a, c, g, or t
cagggcgggcgagcccccgangcccganggananggaanancgccgggcccgggtcgcggaggcgggcgccgccggaacgcgaacacggggctactgcnggcangcgcgaattcgccacaccgcccccggcgtganctgctggtcgcttccggcgcgggaagaaaatntngccgccttgcggangctccggaccctggccttggcgcggtcgcngggancccgggcctgcaacggggatnggggcgtttcctanacncanggccaaaatccggagccgcggacccgcaaatatttntaataaatagaccaanaangcnaacttttcctggatnattccaaaataaaaaatttnatnanctgcttcaaaaanccgcagttcctggtcancttcttctcccgcctgaaaaccaancgcancgggcgctaanaagccgctttccccttcctctcgccctgcngcaaaaaacgcaanttcctgcnctgcgangacnggncggtggtcttnaagcacctnctgaacgcngacnaanggaatanacacctctactaatgcagaggtggcgaagccctggacgtncccttaaaacggcgcgcctgctgcccctggccgccaacgggcgcctgtaccacccggcgccagancgtgcgggcngcgtgggcctggtgcgctccgccctggccttcganctcagcgcctgcntcgantacgggcccggcgcgcctgcactgccctcgcacgtgcgctggcagggccgccgcctcgccctcaccatggacctggccccgctgctgctcgcngctcggtcgccctgancggggccaagggaaangcggggggccgcgggcgcctctcgccccgctcccccgggactcc

SEQ ID NO: 726279 - DNA, 1007 bp, Homo sapiens
cgaacacgcttttgaaaccctaggcgaaggccggagcgctctgccagtcgaagcgctacacgtactcgtgccactgcattccagcctggggaacagagcaagtctttgtctcaaaaaaaaaaaaaaaaaaaagcactaatttcttgacgggttaagggaagccccatcacaacacacaacgccaaacactcgacacaaaacaacaacaagagacaaacatgaacacacacaccaaccaacacgcacagacagcagcacacaccaagacagcaacacaaaacgcgcacacaacagacacaaacgaccacgacaacgcgccgcgcaccagccgcacagagatgagtcgcagggagagggcgaccacacgccgcagcgacacacgccgcaggcagcgcacgcagaacggcggggagcgcgcgcgccgcagctcgccgccaaccccaggggcgcggcgcggcgggcgccccacaaggacagcccccagcagacggggggccgcggagacacgaaccccgcaagggcaaccgcccagggcgcgcgagcaacaccataacacagagccaagggcggcggggcaccagcacggcagggcgagcacagagagaaacacagagcgcacacaacagaaaagtcgcaggcggacgagagaaacaagcgcgacgcggtggtcgactctctgcgtagagtcagagggcattataggactgtgcgccttgtcggtacgtgtcgttaatgctaccttcgccttcatgtctgccatgagtggccctgtctcactccagatggcggcgcgtgcgttcccatggcactgaaccctcgcgcccgaactgtcaactcacaacgcgcgctctaccaaacggagaagggcggctgcaccagtggtgatcgcctgggtgacctctcagcactcgtgtgttctggggtgtcgtgtcaccaagatcataagccaccactatcgcggatcgacaacgagaacaacaaaccgtacctgcaccgaccatcgattg

SEQ ID NO: 726280 - DNA, 1230 bp, Homo sapiens
  misc_feature (768)..(768): n is a, c, g, or t
  misc_feature (778)..(778): n is a, c, g, or t
  misc_feature (790)..(790): n is a, c, g, or t
  misc_feature (792)..(792): n is a, c, g, or t
  misc_feature (808)..(808): n is a, c, g, or t
  misc_feature (814)..(814): n is a, c, g, or t
  misc_feature (817)..(817): n is a, c, g, or t
  misc_feature (838)..(838): n is a, c, g, or t
  misc_feature (866)..(866): n is a, c, g, or t
  misc_feature (875)..(875): n is a, c, g, or t
  misc_feature (878)..(878): n is a, c, g, or t
  misc_feature (882)..(882): n is a, c, g, or t
  misc_feature (905)..(905): n is a, c, g, or t
  misc_feature (925)..(926): n is a, c, g, or t
  misc_feature (963)..(963): n is a, c, g, or t
  misc_feature (979)..(979): n is a, c, g, or t
  misc_feature (991)..(991): n is a, c, g, or t
  misc_feature (1002)..(1002): n is a, c, g, or t
  misc_feature (1012)..(1012): n is a, c, g, or t
  misc_feature (1015)..(1015): n is a, c, g, or t
  misc_feature (1052)..(1052): n is a, c, g, or t
  misc_feature (1076)..(1076): n is a, c, g, or t
  misc_feature (1086)..(1086): n is a, c, g, or t
  misc_feature (1102)..(1102): n is a, c, g, or t
  misc_feature (1122)..(1122): n is a, c, g, or t
  misc_feature (1127)..(1128): n is a, c, g, or t
  misc_feature (1132)..(1132): n is a, c, g, or t
  misc_feature (1155)..(1155): n is a, c, g, or t
  misc_feature (1173)..(1173): n is a, c, g, or t
  misc_feature (1202)..(1203): n is a, c, g, or t
ccccccaggtgggatcggcctccgcggcccccgggaccttctggactccccgtgctccctggtcccccaggacctcccggaccccctggacacccaggagtcctccctgaaggcgctactgaccttcagtgcccaagtatctgcccgccaggtcccccagggccccctggaatgccagggttcaatgggacccactggctacaaaggcgagcatgggggaagtcggcaaggacggcgagaatgggtgaccctgagccccacctgggcccgccggactcccgggcagcgtggggctgcagggcccccggggattacgaggactgccagggccactcgggaccccctggggaccggggtcccatatgggattccgagggccgcctgggatcccaggagcgcctgggaaagcgggtgaccgacggcgagaggggcccagaagggttccgcaggccccaagggtgacctcggcagacctggtcccaagggaacccccggagtggcgggccaagccggagagccgggcatgccgggcaaggacggccagaatggcgtgccaggactcgatggccagaagggagaggctggtcgcaacggtgctccgggagagaagggccccaacgggctgccgggcctccctggacgagcgggtccaaaggcgagaagggagaacggggcagagctggggagctgggtgaggccggcccctctggagagccaggcgtccctggagatgctggcatgcctggggagctgcggtgaggctggcancggggctcancgggggccctcngnccacaaggccctcccnggagcnccntggtgtccgaggcttccagtngcagaagggcagcatgggagaccccggncttccaggnccncagngcctccgaggtgacgtgggcgancggggtccgggaggtgccgnnaggccctaagggagaccagggtattgcaggttccganggtcttcctggggatnaaggagaactgngtcccagcggnctggtcgganccnaaggagagtctggcagtcgaggggagctgggccccanaggcacccagggtcccaacggcancagcggtgtncagggtgtccccgggncccccggtcctctgggcctncaggnncgtnccgggtgttcctggcatcacggngaagccgggagttccggngaaggaggccagcgagcagcgcatcaggnngctgtgtggggggatgatcagggaaca

SEQ ID NO: 726281 - DNA, 731 bp, Homo sapiens
tgcctcagctactcaggaggcttgaaccctggaggcagaggttgtggtgagtcgagatcatcgcactccagcctgggcaataagagtgaaactctgtctccaggaaaaaaaaaatttattgggtgtataactttaaaagcagattttgggaagcatgtaattacattaaaagtatacttgtcccagctgcgtgtggtggctcatgcctgtaatcccaacacttggggaggccaaggcaggtggatcatgaggtcaggagttcaagaccatcttggccaagatggtgaaaccctgtctgtactaaaaatacaaaaattagccatgcatggtggccggcgcgtataatcccagctgcttgggaggctgaggcagagaatgggaatgctgtgaacgctgggaggtggaggttgcagtgagccgaggttgcaccatggtccaggctgggcaacagagcaagactccatctcaaaaagaaaaaagtgtattgtgtccttaaaaaaatttttctgaaaagtgggtaatggacataatacagctttcaaattactttatgctgttattttgatccgtaatgcgtattcacatgtgaaagcatgtgatcaattttgtgcatcagagatatcagagatagtttcaatgaatggggcattaatgaccttttctataaaagtaagggacattacaagtgtaagatgctggctgaaatatagtgggagaggctctttgcagta

SEQ ID NO: 726282 - DNA, 745 bp, Homo sapiens
taaagagccgttatgtgggggtcaaggaattccttgggtgggtgccaaatggggccgaaaacattgagtcaattcctggtaaagaccacgagagggaaatttcgggtttttcccagacaggggggactgtaaggtgacccaggattccttagagaatgttggccctcgttgtgaaagaagaacaggccctgggtgacttgtcacagttccatacgggccctggaatgtggtgtttgctgtttaggaggtatcccctctaaccgtacctggtggttcttgggccttcccctactctcgttcgtcatcttcgtatatgacgaagtcaggaaactcatcatcaggcgacgccctggcggctgggtggagaaggagaacctactatgtagccccccgtcctgcacgccgtggaggcactcaggccacacagcttctgcatccgacacccaccccctctttgtgtacttcagtcttggagatttggcagactctaaccctggtagggaagcacccgcaggcatgtggggaagccagacgtcctggaatgaagcatgtagctctatggggggaggggggagggctgcctggaaaccatccatctgtggaaatgacaacggggaaggtttttatgtgcctttttgcgttttgtatataaaaggaacacccggtatagactgaaagtaaaacattcttatatgctggatttttacaaataaagatggctattataatgaggaaagaaaaagaa

SEQ ID NO: 726283 - DNA, 166 bp, Homo sapiens
  misc_feature (1)..(1): n is a, c, g, or t
ntgctccagtaggtgctatagccctgaaaaggctgggacaaaataacagccataagaagtacctacttctttagcagttcttcaatttcctctgaggtctttataattccaagattgtctcttagccagcgaacaacagcaccagctatagctactgagcctagct

SEQ ID NO: 726284 - DNA, 995 bp, Homo sapiens
ctatccctctcgcctgtgtctcgtgccgcgtctcctggcgtctagcccgcggcgctgctctgccgctgctcttctgcgtttttgtcctcctgtgtttttctcctccttccctgctccgcctccttgcttcgcgctctctcctgtctgttcgcccctctgccccctcttcagcctcactcgccgtctcacgtcctcgctgcccttcccccactcttttctctgccgtcgcgtcctcatctgctctctcgtcatggctcgtgtctcttctcgggtctcgcgttgctccggcgtgtcctgtctgcgtctcgcgttctgttcttcggtcgcgggggctttcctgctgcccgccttgctgcgtctggtagggcgtgtgtcttctgtcgtctctgtctttgctgtgctgtgcctcgtgggtgtccgctttccccttctccgttttctcttacgcttcttcctgtccgtgccgtccggtctccccgtctcgggcttctcacttctttcctcgcccttccgttccctcttgccctcttctcgcgtggctcgtgttcttgctctcgtgtgtgtctccacccccgtctcccgctcttcgctcctcccgtcgcttttcgttttccctcccccttcgctctctgtcctttgttcctcttctctctcggctgtcgtcggcgtctgttcgtgcgctctgttgatgtctttgttgttttgtttttctgtagtatttgtgctggtgcaagtaaggagtcttgagttgatcatctttcttgtttgtgtgttatgttctctaggtgcttgctgtatgctcacgcggtaggatggggttgcgcgttgtagcaattgtttgtagtgtatcctttgcgtggtttccccgtagccatttcgttgttgactggttggtgactgcatggggataccccgtttgaagctggcctgcttcgtggaggatagccccgctcggtatttttgtgtaatgtaccctttcttcgcggatgttcaac

SEQ ID NO: 726285 - DNA, 317 bp, Homo sapiens
  misc_feature (61)..(61): n is a, c, g, or t
actccacaccacctgttcccaaaaacacctattgttattaaaaaattaaaaaaaaccatgnataagggaaattttggggcagtctgatcgtttgagcccaggacttcgagaccagcctgagaaacatggttaaaccccatttttccaaaacacacttccccccccttggttttgcccccccccccaataaaagggcttttgtttccttgtggggggaaaatgtagataaggatgggttaaataaaatattttggggaggcaataaacggggggggaacggagggtgggccctttttaaagggagggcctttaaacag

SEQ ID NO: 726286 - DNA, 1141 bp, Homo sapiens
ttcgccgtcagcatatggcgatgaccgcacggattattcgtatattgttattgattgtggtggccatttttgcacgctggatcgctccctatgacgccgaagaattatttgtcgattactgacaatctgaataatcggaccttctttgcagcactggtttggcgtcgattcactggggcgtgacattttcagccgtgtcctggttggtgcgcaagatctcgctggcggcgggcgtgttagccgtgtttatcggtgcggcgatcgggacgttgctgggcttgctcgctggatattcatgaaggctggtgggactcggctgatcatgcgcatttgcgatgtgctgtttgccttcccgggtattttactggtcgtatcgctgattgttgcggctgttgggaacgcggcattgctaacgtgattatcgctggtcgccattttttccatccccgtgtttgcccggctggtgcgcggtgacacgctggtgtcgaaacagcaaactttattgagtcagcatcgcatgtatggtgccagcgatgtgaccggattgtgcgtcatatcctagcctggggaaccggcctctttctatcgtgggtgttttttcaacaatggccgcaattggggtaccttccgattaatctcttgcggccaggctctcatttctcggctcggtgcgcagcgcggaacatgagtggagcaaggtcatgaggtcgaggtctaagtcgtgcggacaagtacctgactggcagtgcctacgttccgacccgttctgtcacaggtgaactcgggcccatggaggaaaattcaagcagtacgtccacacacaacacacaccaacaacccacacaaccacgccccgcaacacacaccgcaacacaccaacacaagtacaataagtacacagacaacaagggcgacaaggccacgcgcgcagaggcaggagagaagtgaccacgtttctcgcacaccgtgcgcacctcctcatagccacccccaccaatcacacctccgccaagacaggaacatgagtaagcagaccacgacaaccaagagaaaacaagcagaacagcaagaggaggacagcaaccagccagcacacaccacaatagacaagcacgaacacagcaacacaaaaaaaaaaaca

SEQ ID NO: 726287 - DNA, 312 bp, Homo sapiens
ttttttttttcctttttgagatagagtctcacttggtcacccaggctggagtgccgtggtgtgatcacagctcactgcagccttgacctccctgcaagcgatcctcccacctcagcctcccaagtcactgggactaaagacatgcgtcacttgcccagctaatttttctagagacagggtttggcaatgttgttcaggctggtctcaaactcctgagctcaagtgattcccctgcctcggcttcccaaagtgctgggataatgagagagagccagtgagcctggcctcggtttctatttttgattgaattat

SEQ ID NO: 726288 - DNA, 340 bp, Homo sapiens
aaaagttatttgctgggaaagtgtccaaaagcctgttttttaaacacaagctgggcttttggtagtgcctcatcacaacccaatatgggtgttcaatttttcccccctttttttccttcagcaaaggccagggtatggagcagggcccctgaatttgctgtaatctggagatgctttttactttcacccataaacggtaataacaaaggaaagggtgaagggagtttgggcaaccaaaacataaaaatggtggggtggtggtggggttgaaaaaacttgttggtataattgtcataggacttgcctaaaatattattaaaattacgggagcgttctccga

SEQ ID NO: 726289 - DNA, 134 bp, Homo sapiens
agcgtcaggtcatgcggatgtcacgtcacactacatgatggagtagaaggtagtttcgtggatgccacagagatccatgcccaggatggaaggctggaagagtgcctcagggcagcggaaccgctcatagccaa

SEQ ID NO: 726290 - DNA, 336 bp, Homo sapiens
ccccccccctttaaaccgggggggtttttttggggtaaaccaataaaactttcctggctaacccagccccctggttgggttttggccatttaaaccccccaacccccctttaaaaaggatgtttttggaaaaatttaattggttccccccccggcggccccccggggtttttttttttggtttttttggttttttttggttttttttttggttttaagcccgttttaatttttttggccctggaaagggctttttgtttttgggggttaggtaaggtttcccaaaaccttttttaggggcggcccttgggtttttaaaaaaaatttggggggccca

SEQ ID NO: 726291 - DNA, 655 bp, Homo sapiens
agcgcggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggattttttttttttggtaatggtcacagaaaatgtaatgtgtgggtatgtgtgcgtgcgtgtgtgtgtgtgtgtgtgtgtatcgtgtgtgtgtgtttggtttaggattggggggatattttgtacaaaaagaaaacccaggggaagatgtccgtggagaggacagagctttcatactgaattagatgtattttatggggaattgggctaacatttttcttggtatcttttttttcacatataagtcatatatacccttagagatggtcatatactttccaccacttgacatggatcttctggccagaaatagatctcattttcaaaagcaattctacggcagcggtgtagctgggcacagaaagtcctggcccagtaaacgcaggagggaattcccggggactctacacccatctaaggggggtatcacctccaaatccgggtacacatgggaacgaaatagcaggagcag

SEQ ID NO: 726292 - DNA, 774 bp, Homo sapiens
  misc_feature (55)..(55): n is a, c, g, or t
  misc_feature (67)..(67): n is a, c, g, or t
  misc_feature (70)..(70): n is a, c, g, or t
  misc_feature (72)..(72): n is a, c, g, or t
  misc_feature (589)..(589): n is a, c, g, or t
  misc_feature (774)..(774): n is a, c, g, or t
ccccgcacttccgcgatctcttctctactgtttactgttcatcttccggcccccncctctaactccnccntnctcccctctctccttttatttttacattagagtcggtgagcatgaggcatgcgaacctctccaaatttaatgcagacagcttgtgtgtttctattaaacacatcgtcgctatttaggaggcgaaatattggtcagtcgccattctatatcaggagcagcaacaaggcactacatataatttgtgattggtggacagaaacatgaaaaccgtgttacacacaggtgcattgttcctgaaggaagaaatacacgtactgcacgcctaggcatgatgtgtgcttgcttaatcaagctacatcaaaaatcatttacggaaagttcactaaaaatttgcttgacttgagaatcacgctgtagattaatcaggctctcatatgtccgtgctactaatgaagctggcttaacaggaacgtgccaatgggatatttaaccccagcatttttgtaattctttacaaggaaggattttaacagaattaccgcggcaacccccttagtggctgtacaccgggcctgcntaaaactttatccaaccgtggaaataactttcgtcaaaagatcaccgagtggagggaaaccaacacagggtttcttttttttccaatgaggggccaaagttccaaatttattaaccacggtccgcgattttataaaaaaccggtaaccgagacacttttttcctctgctatgcactctcatttcn

SEQ ID NO: 726293 - DNA, 204 bp, Homo sapiens
ccttactccagacacgtgaccggatggctgattatggcatcagaaatggccatttactcttcctggcattcagctgcatgggggggtaatcgccggggacagaataccttatttccttttacttctcacttactaaccacaccctttgaaaatttcctaaagtcaatgataaagataaaaagaaagcggtcaacttgtctggag

SEQ ID NO: 726294 - DNA, 1480 bp, Homo sapiens
  misc_feature (763)..(763): n is a, c, g, or t
ttctcagtgagcgccgtggtgcatatccagccatggggggtttaataacaacaccacatggtgctcttgtcaaccaaggagttctcaccttgttgggttgaaaccaccatctagtgggggccttcctcgtagagtcttcttatctcacaagtggggtcgcagttggtccctctcctaccgccccaactattgtgcggaccaccaccggtttgtctcccaccgagggggggagttccccccagttggtggagcctttttgtttgaggctccctattccattccgacgggtcaccaccttttgtgtcttttcgtagcaaccattgtttggcccaccaggacacacgttcccgggggtgtcccttccgtcgctcgtcccccgaagtttgtgtgccgtgagactgtgggggctcctaaggaaccccagcggcaagaatgtctctccctcccccagttgtgtagatgttggcaccacaaaaggaagttttcttgccggaaactgggtgaattggagtacccaccgcccaacattgagggcccccacaataactgtttgagttggggaaaaaatttcccccgcggtgtttccccacagacgagtgtttgtcccgtaattccgccttgtagaggggttggttgtcacacccctgtgaagcgcccccttgggagattttttgtggcaaggcccccccaaacacctttttggtcctcgtttgttggtccacggtaaattctgctgtccccccaccccccacatggctgagcncacgtggagaacctgtggcacagcacatacacaggtccccgggtcccctcgtggcaaaaggaatttttgggccctaaactttttggttctccacacctgcttcgatgggaaactacacaggcttttcccacgcgccctctttttcttgaactctataaactttcaccaccccacggacccctcttctgaacacaattttctccctcgccactgtgtgaactccaccgcagaatattgagtcccctaaacaccacgccacttggtcctaattgggtataccccggagaacgcccctggccctccacgaattctgtcctggaagaaatttgctgtgtgtgtggcgctggccctttggcctgggtgtgtctgggcaatcacatcgctgggcacattgtttttcactcaatttaacttccggaaagccttgctcacgaactgaatttttccacgaaccacgaagtttgaatgccacgcaagcttcggccactcccaaccacgaggatgctcacgatttctcacacactcctgcccacggagtctcctccttagggtatgaaagaaagttctcttgggaacaatccctggggtgtgtgtgtaagaatttcccaccctggggaactctgctgttcctgggcttgcatccccgggatccccgagtggcctgcctatcaccaccacatcccttccccccaacaaggccaataaatctcatttctt

SEQ ID NO: 726295 - DNA, 163 bp, Homo sapiens
tggaggtggcagccagaggcggggggtagctgtctcagcgggtggtcttggtggactgctcgcggctaaaggagtttggatcagctcggtgccccctgtgagcctcctctgacgtagtcttggtccagtgtggctccctccatggctgcctcctctgtgctgt

SEQ ID NO: 726296 - DNA, 940 bp, Homo sapiens
gctcggcaagttctcccaggataaagccatgtccggttcgagcgccgaagatcgtgtaagcccaatggcgagaagccggacgagttcgagtccggcaatctcccgagggctcttctgggagctggagatgaactcgtgacctcataggctcagttcatggagctgacctattaggggcagtgcgtagagggaacattgcacagtgttgggtgggtgggtcgtgcatgagcgtatccatgaaatcttttcgcttcccgcttccgtcaacctgatgatccttgtccaagccaaagaaccaaagatccggtcgtagtctacgcgtgacatgggtgagcacataccggttgcccgacggagaagcggagtgtcgtcttagatcgcagtcaagccggtagtaatgcgtgccgtagagcctaacatcgaagaaagccgtacgcgaacagagtaacgccatgagagacggtacccagtgagccggtattctgacaggatgtgcacgatgccattcctgtgaggaacttggtcttccctgggtcgactattgtgggccctagagagtccgtgctctaattagattggcagccgtgttcataaagggttcagtttggacaatggtacagcgaagcaagtgtggaatacaaggtttgggaatgttttttcgtggtgtctataagaagctcacgggcgatgggatgtcaagtcctgaacttcccagaggtttttcactttggtaaagcgaacgaatgactaaataacataaacaatacctaggcagggacaccctaactccaatgcccttaattggaagcgccacacctaagccgtgttcctgcctttgggggggctctacaccctatcacctgggagcgtcgggggcaaaagacgttttctttttgtcggccacaaattccggggcggaacaacattttcccgggagggc

SEQ ID NO: 726297 - DNA, 822 bp, Homo sapiens
actagttctagaccgctttgtggccgccctttttttttgttttttcacatttcttactttatatttcaacattaaaaatattcacagagtggagtattatattcagacatctccagggaaaagtgtacgaaaacaaagcattacaagcatttccacaatttacagaatttacattattgggtgattagtggtgaatgtgtcaccctacagttaatctggaaaaacacttttaaaaaaaaaaaaaaaaaaaaaaaaaaaaaaaaaaaaaaaaaaaaaaaaaaaaaaaaaagagagggggggcgacaaaaaaaattactcccgaggaggggccaaatagacgcagcacaccacacttttatgaaaaaaagggcgcccatataagaggagagcaaaatatataaaagcagacgagaagcggagggcgcaagatattaaaacaaaaaatgaaaaagagggagaaacacaatggcgccacacgggcgcaaaacaatggggagaaagacaaaaatacatagggggggggacaaaaaaggagggaaacaaaacccacaaaaaaaaaaacaaaacagccaaaaagaaaaaaaaacaaacaatccaaaggaggaaaacagcgtgcaacaagacaaacagaaacaaaagcacgcaaaaaaagaacgaccacaccgcaagaaacaaaacaggcgaaaaacaaaaacaaagggaagaaagacataaaaaacaccaacaaaccacaaaaacacaacaaaacacaccacagaaaaaacacaccaaacaccaaacaagacccacagaacaaaagaaacaaaacagaaaaaaacacaa

SEQ ID NO: 726298 - DNA, 434 bp, Homo sapiens
ctgtttgttaaggcacagttcagagaagaacagaatctatatcaaatgttaatgtaatatatatagatgtatattaaatatgattgcttacatatctagtcataaatacagcaccagagttgggagaaatatttaatgtatataaaaattttgggccgggtgcggtggctcacgcctgtaatcccagcactttgggaggccaaggtgggcggatcttgaggtcaggagatcgagaccatcctggctaacatggtgaaaccccgtctctactaaacaaatacaaaaaaattagctgggcacggtggcgggcgcctgtagtcctagctactcaggaggctgaggcaggagaatggcatgaaaccgggaggcagagcttgcagtgagctgagattgcaccactgcactccagccagggtgacagagtgagactccgt

SEQ ID NO: 726299 - DNA, 161 bp, Homo sapiens
aacagcacccccgattccgtacgaacaactcatacacctcctatgaaaaaatttccttaccactctaccctagcattacttatatgacatgtctccatacccattacaattctccagcattcccgcatgcaaaccagtgagggtaccgcagctcgatattc

SEQ ID NO: 726300 - DNA, 546 bp, Homo sapiens
gttcaatttctacacagagcaagtatgaatcaggtatttgcaagttttacaagcttaagctgtttacctactaaaatataacaatagctagttgttatctgcatataagagttcattgaaatgatatgcccttatttgcaatacttttcccataaagtttcaagtgtgaaagaattgtaatttactagatatgtttggtatgggatatttggtgaggcaagtatgcttgattcttcttaaattgcaataggcttccaaaaagagtataattgtatcagaacaaatgaagtctgggtatgatacgtctcccttagtctttacagtattagtaaaaagaaaaatggtgcgcttactgagttggaacttcactaatgtaattactctctcaagaagcttttaaaatttagattaccatcacacaacctttgttatagtaaagccaacatttgttctctcaccaaatcccatgccagattcatcatgaagaaagctcagcataagtaattcagatactgcttataattttagaggggtgtagaaattgaa

SEQ ID NO: 726301 - DNA, 118 bp, Homo sapiens
tttcctctctactcctctgtattttcaggtttcacattctagaaaacatttattagttgaataaccatcacctttgaagacatttaacttgctccaatagaccccaagctagagtcta

SEQ ID NO: 726302 - DNA, 654 bp, Homo sapiens
  misc_feature (6)..(6): n is a, c, g, or t
  misc_feature (76)..(76): n is a, c, g, or t
  misc_feature (199)..(199): n is a, c, g, or t
  misc_feature (304)..(304): n is a, c, g, or t
  misc_feature (444)..(444): n is a, c, g, or t
  misc_feature (469)..(469): n is a, c, g, or t
  misc_feature (488)..(488): n is a, c, g, or t
  misc_feature (509)..(509): n is a, c, g, or t
  misc_feature (582)..(582): n is a, c, g, or t
  misc_feature (602)..(602): n is a, c, g, or t
  misc_feature (609)..(609): n is a, c, g, or t
  misc_feature (626)..(626): n is a, c, g, or t
aagggnattcctggcccccccaggacctcctgaatcccccctgggaggaagaaggaaattggtggcgggccctaanaccctttttcctttccccaaaacacccaaggagcagggttcctttcctggttacatcccatttgagggtcacattccttgaaggtggcattttggagggaaagtcatttattttttccgctancaggcaggggacctggattgtattcaggtcctatttagaatttccagaaaaaagtaagcaaaccaaaaaaaccggtggttgggaaatttattcctccttcctagncatttttggaaatggtaccaatgggttaaatggtttaactatagcccacccatggatggtaatttgaagacccaggtccttaattcctttttttatcctaaactggtaacattttggtacccccatttaaccctaaatgnctccataggcattcaagaaaagatncaatattttaagggtggancaaatatcccccaatttatgnctggattttggatttattatggaatggtggttggaatttattcatatggttacttccccaaaaattatggcancatgcttaaggatggttatncaattanaagaattaaaggaacanaagaatttaaaggctttttttaacaggt

SEQ ID NO: 726303 - DNA, 570 bp, Homo sapiens
ctcgcctagggagcagtgaggaggaggaagacgaagagatgcatggaagaaggggatgacgctggaagatcccaaggcgagagtgaggaagacagggcgtggagatagaaaagtgagtgatgatggtgtggtgatgacttctctagtgtcaaatgtttctgaggaagtggagaaaggaagagccgtgaagaatcagatagcagtgtgggaccagctcttggaagtgaaggatcaaacctagaataagagctctggtgaccaccaatcagtttcctcaagcagatgttttgcccatatgttcaaggacctagaggtggcccagaattttccagtgccctgaaaaatagtcacaaggcacttaaagcatggtagaggtcatttggtaggtcttcagtgaagagttgcttttgcagtacccagtagattagatatctagtagatgggacaaagccgattgcgggaagtgaggagatttctagtgaagatgatgagctggtagaagagaagaagcagaaaggaataagggtctctgcaaagaggaagctgtagatggaggatattgcagcttca

SEQ ID NO: 726304 - DNA, 226 bp, Homo sapiens
cgaaaaaccttggtgcccctcgaccagcgtccttgtgggtacaggttcaggacttaaggccaaaggacatgggcgtgagggtgtacgccggagcttgacccgtttgccttgttgaattgcaagcacccattatggcactgcaacatacggtttggcgaacgcttttcggcagtttgccaacgcgatgcgataatcagggtctttgccgcaagatgcatccagttac

SEQ ID NO: 726305 - DNA, 527 bp, Homo sapiens
ggtacccctcatgactattgatgaagactagtcgggggcaggagcaccttctgagtagatcccaccaggaacccttaataaattgaaggtgggacctgagggagaagtgacattttcggttgatactggggcagctcactcctccctaattcaccaaccaagggctacagaactctctaaggaaacattgaaagtatcaggggtcaaaggggagggatttcaggttccaatatttaagaaaattttaattacatcaggagcaaaacaaattgaggcgtcacttgttcctgaagtaggaactaacctcctgtgtcgagacctgattgtgagattgggtttaggattaggaatagaggaaggacaaataaaagtaatgatgggcctgggcttctgaggtggactcctggcctgatcagggaccctccccgctttcctggggctctcagttgaacaaagcagcaaaacaaaggcagttttatatgacagattagaagcctggcataatcaggcgtcttaaatgatgtaat

SEQ ID NO: 726306 - DNA, 402 bp, Homo sapiens
tgtttataatattttaatattttttttttttaaatatggccaaaaaaatgaaaaagtataccgcggaaacgagggacaaaaaagaaaaaacgccccccaccaaaaagcgggccgacccaaggggcccgaaacagcgccggccggggcccacccggaaaaaccccccccaaacccaaaggggaaccccccccggggccccagaaaaaggccggagaaagaaacccaacccgagccttctctagagggaaaaaaaacaacccccccccccccccgccaaaagagggccgaaaaaaggggggcggcctaccaacaaatcgaaaagaaaaacaagggggccggcccccaaaaagggcccggggtaaaaaaaaaccccccgaataaaaaaacgcccccggggccaca

SEQ ID NO: 726307 - DNA, 569 bp, Homo sapiens
gacaggatgaccactctcaccactccgattcaacatagtactggaagtcctaagcttaggtgatcaggcaagataaagatatgaaaggcatatataaataggaagaggggcaagtcagtttctcttgcagaagatataattctgtatatagaaaacctgtggtctctggccagagaggctcctagatctgatacacaagttcaaaaaagtgtcaggatacaaaagtctgtgtacgaaaattagttgcatttctatacaccgagtaatgtccacagctatgaaccaaatcaagaatggaagtcccattcacagtagccacaaaaagtataaagatacctaggaactacagcacaaacgcagggtacagctcgacacagaccactaccaaggacgaattacaaagcagtgcacaaagacctcagaaaacaaaaaaaactgaaaaatatctcatgctcatggataggaagaatcagtatagtacaaatactgaccaaagcaaatctacacgagccaatgctatcctatcaaactaccatggcatatatcacagaatcagaagaacacatctg

SEQ ID NO: 726308 - DNA, 111 bp, Homo sapiens
tcagtgctgtggcttgccttctccgttcatggtgttgctttctaagtgtgatctgccagtatccctcgacggtacatgtgcacccagttcagacttccagtgtggagagag

SEQ ID NO: 726309 - DNA, 190 bp, Homo sapiens
gtatccagtcaagaaaatgtatatctaaagatagccacattaaactatatggtattgagtttcaaatgagcgtactgcttatagcttatcgcatcctgctccgctgtctggctgtctctcttccaatgaactcttcatcccatcgtatttccatccaccagagagaatctgtcctcattacatgcactgt

SEQ ID NO: 726310 - DNA, 143 bp, Homo sapiens
gtccacttcatttctgagttcccagaggttacccaaagcacccctctgacatccggcctgcatcttctcacatgacaaaaactagccccctctcaatcatataccagatctctccctcactagacgtaagacataaccgcggg

SEQ ID NO: 726311 - DNA, 86 bp, Homo sapiens
agttgctattaaatggacttcgtgatttttgttttgccctaaagtttctgtgatttaacaataaacttttgttagccagatttgga

SEQ ID NO: 726312 - DNA, 493 bp, Homo sapiens
tactttgccacaggggaatggatatagcttgactaagcagatgagccttcaggcttgtaggtacgctattcttataactggctaccctccattagtaaaagatcagatcacttcaaagatatgatttgaagggataatggccaggcctcgattctatggctcgtggaaatgtcacgaatcgactccctagtttctggactttaggacattgactgaggtgccatttacaaaaatgaggccaattccaggagaaatagtatctgggaggaagagcaagcatttgttttttatacataaagctgacagctgaatatgtaagtctctagcaagagatcaaggctggagatataaatttggggactgtggcagtcagcacaagggcttccccaagacgtccatgtccttatctctggaacctgtgaatatgttacctttcattaataaaagggactttgcagatatgattaagttacgtatattgagatggggagat

SEQ ID NO: 726313 - DNA, 342 bp, Homo sapiens
  misc_feature (1)..(1): n is a, c, g, or t
  misc_feature (56)..(56): n is a, c, g, or t
ngggtttggtttccccccccaggccttttttttttttaggggttgggggggggggnaatttttccccccccccccccccccaaaaaagggggggcgggaaaaaaattttttccctttgggggggcccccccttgaatgggggttttttgggggggggtaagggccccctttttgggggggggcaatttttgttggggcgcccggtttttggtttttttcggggggtttttttcctttgggggctttggggggggggggccctgggccggtttccctttttccctggttgggggctccctgggcccccccccccccccttttttaaccctggttttccttgga

SEQ ID NO: 726314 - DNA, 476 bp, Homo sapiens
  misc_feature (15)..(15): n is a, c, g, or t
  misc_feature (39)..(40): n is a, c, g, or t
  misc_feature (76)..(76): n is a, c, g, or t
  misc_feature (82)..(82): n is a, c, g, or t
atgggtttttcccanaaggcccccaaaaggggccttaannaaattccggccccccattcccaggcccttggtgggngtgccnggggttttaaggcccttgttaagccccagggggtttagccccaattccccaagggggttacccccaaggttgtttgattttccttcattgcccccccccagcttggggagggggtttgtgcccgtttttcccagggggttaggtttttccggcccaaggccaaggccaaggccaaggcccagggttaaacccagggcccgggtggagcccccctttttttttccgttttgggttcccaagggtccccggccccccccaagggttttaggttaattttttttcccccattggggaagaaggggtggggggcccccccccccccccccctggggttcccttttgttggggggggggttcttttttttttttttttcaaattaaccttgggggggga

SEQ ID NO: 726315 - DNA, 147 bp, Homo sapiens
ccgttcaacttctacgcctaactaaccatgtcaccagtttcacacagcccttaaagtgtagaagggaatctcttattttatatcactataaccatatggggaggataatattatgatatacaatatactatcactatttgtgtaaaa

SEQ ID NO: 726316 - DNA, 404 bp, Homo sapiens
  misc_feature (20)..(20): n is a, c, g, or t
gcccccaaggccaaaaccangttttttgcctccttcaaaagggagggggagggcaagtaccgcgctgagtgcaaactggaccccaaaacaggctttaggcccgacccccggcccgaccccaagcttggtgccaaaacccagccccggctgctggtggtgccccagaacgagaacaggatggaggacaggctggccgagccctccagggccaaagaccctcccatttccggagttgaggtggggaaagcaagcccctagcatgccaatggccccgttgtgtgtggtgggggtcggggttggggggcatggtgcagtcggccttcccgtaaactaagtaggcaggtaggtttttaaaaaggcccaggggcaagtaaaatttgtcaattaaacccctttttttatta

SEQ ID NO: 726317 - DNA, 355 bp, Homo sapiens
gtgaaaactacatgcaggtatatgcacactttctgtgaaggtgaggccaatcttgattcaaactgcgcttgttgtgctcgtgacacacaagccctaggcatcaaatgtgcatctgacagctgatattgatgatttctcagcttgtgtaaagaagtgctgcaaggctgacgatgatgagacctcgcttgccgaggagggtaaaaatcttgctggtcattgttagctggcttaggcttataacatcacattgataagcatctgagcctaccattgtgtttacaggtgtcgagcatatgctgattcatctgtttgtctttgtcgatggtgtgaagccgacaccctgtcttacatatgg

SEQ ID NO: 726318 - DNA, 183 bp, Homo sapiens
agtttgcctttctatatgagtgcagtacatggcacctgtattagtccattttcatggtgctgataaagacatacccgagactgggaagaaaaagaagtttaattggacctacagttccacatggcgggggaggcctcagaatcatggcgggaggtgaaaggtacttgcttacatggctgcagc

SEQ ID NO: 726319 - DNA, 967 bp, Homo sapiens
gtttctttgccagagagtagtacttaaagatgaagagcgcaacaaaaagagaaaaagatcgagcgaagagagggattaatctcagtcgttgctggttcccgaagagatcatccttacgagcttcatatgcgccactgtgtatcacgcggggttcccctaggctatttgtcagccaagaggggtcgataatattgccggattccagttaacccgacgactctgggggaactaacgagaacgaataagcccgctaaccacgctccttaaccgcctcgaattcgtcaccgcccgctccctcccgggttgttccgacccactctgcggttataatgagaagcgctccctcaaggagctctttaaagcaccggcacaatgaagccccattctcggcaaaggtcctatccagcctccttttcgaaaaattctacagcccgaggtgttctcccacctcagaccgaaagtgtttgttaccccacccgccgggaccattcatacagttgcatggtggccccacctgtggctccagagccaccacaagggggccacaagacgctcctgaggcagtctcgtggcgttgtataaaataagcatcgctcacaaacctcggggtagaaaatgcggacttttccccgatactcggacacaagaagcgtacaggtgcccattaggtaagacggccagacaaatgttttaagagggccaacggggtatgttacaacttcgtcactgggaaaatccagtaaacctggagaccattaagttattgaggaaccattaacgttatgtgcaactcgagtcggaccacagccggttaggcagtacgatgaaaaagtatgattaggccagctagacacgactgtgcgcaactagtgcggcgatccagtaaacgacagcgtagctctagttttcactaaaagaaaccctgggtataattttttaatattaaaagaattcccccatcataaca

SEQ ID NO: 726320 - DNA, 104 bp, Homo sapiens
gatgcccagaaggaataatactatcgctgatcattatagctactctcataaccctgaacacccactccctcttagccaatatggagcctattgccatactagac

SEQ ID NO: 726321 - DNA, 431 bp, Homo sapiens
  misc_feature (20)..(20): n is a, c, g, or t
  misc_feature (53)..(53): n is a, c, g, or t
  misc_feature (204)..(204): n is a, c, g, or t
tctggaagcccctccctaanacatggccccccaagtaagggactgtggtggtncaagcccttggggaatacctgcaccccctggcagccctcaggaagtgcctcggccctgtccctgcatgtgtccccagcaccctgctgctgaaagtggctctggagggtcgctgagagcttcctttgtagcaagacctgtcagtgtctgcgnccctggggctgtggtacccaaatcacccacacacgggtggcccagaacaacagacatggattatctcatgtttggggggcagtagtctgaaatcaaagtgtcagctggggctgggtgcagtgtctcatgcttgtaatcccagcactttgggactccgaggcaggcagattacttgaggtcaggagttcaagaccagcctagccaacatggtgaaaccgtctagtact

SEQ ID NO: 726322 - DNA, 366 bp, Homo sapiens
cttaccatttcctaaattaggtattttacttaactctgaaatcagttatttcacttatttttttcttcatatcatgaacgttctaaaaatattccttataaatttgcatcactttttctcttgtggcttttgaagttactatattctaaacttgagaagatggtataaatcaataatagaagagtcactggggagctggtgagatggctcagtgggtaagagcactgacttcttttccaaaggtactgaattcaaatcccagcaaccacatggtggctcacagcctcccatagtgagatctgatgccctattctgatgtgtttgaagacagctacggtgaacttataataataaataaatcttaaa

SEQ ID NO: 726323 - DNA, 1426 bp, Homo sapiens
tctggaaaatgaaaggttccccatcataggggattcttaagaagcacgtttcctccaggtatatgtgcgggggtgctagcgtggagtgctctttgggcaataagtgtggtcacccgttgtgggcagtggaatagcacacagggtggggtgttcttcaaaaaggccaaccagaattaggccctcacgtgggccctccgtggcaaagccacgcggagtagccgtggcgcctcgtggaaagcgccaaactcgggttataaaaagagcccgtggagccaaattttcgctcgcccacacagaacgccgggaagaggggaaggtgtgggcaacattcacaaagtatctcagagtggcacttctctgtgtaaatacgcgcctctataatttctccacgggagagcgcgccccacaacagttatcacacgaggcggctgtgtatacacgtatatgagagtgagtatctcttctcccacctccctctccgagaatagagagaggtgcgcaacactctctgtgtgtgcgaagcgagtgtctctttgtgtgtgtgagggcgcgaagatgtgagctctttcgcgtggggtgtgtggcatatcaacacacacgcgagtgtccagaactgtggggcgagacgacagaatcagtgctatgtgtgtgtcagagatagcacccgtagtggtatcacaaagagagaaacgctctctctatatacatctcaccccgcccgccactattctctttctctatgatcgagctgcgttgaaaagctcactcgggtgacgcaagcgcgaaaagaagagggcgtgcacgctcgtgagcgccgttttgtgacatgggttagccagagagcggggaagcacacatttagagtctctcagagaagaactatatagtaaaagatttactgataaatatataatgaaacaaaaacaaactaaactacaaaacaagaagatgagcataagctgaggacccacaccccccacacagaaaaacgaggtgagcaggccaacaaaccccccttatccaccagagcacgcgggcggccaaaaaatggtgccacgactacatcagagaaagccacccccatcaagagaaactaggggagtaatagccagccagccattaattactgacccaacgaacaacagagcgggatctccttgctgcggcttcacatcagtcagatgtagagtggtaaccccccccctggtagatgcatgaagggtcgaggacgggccacaattaaaaaaaccgtctaacaggaggcgaatcacggtcgagagcgtgatgagacgaaacaacttttggaagacaacaaacatatccacacccccccgatgattgtagtgaagtatattctcctacatctcccttccgccctacacagataagagttgtgtgaccacaatacggtcgtatttgatggaca

SEQ ID NO: 726324 - DNA, 413 bp, Homo sapiens
accagtactcaaaggcaaggcacatggggcacagcaagcacaaagggcagcgtggccaagtctgcagctcttgggcagtgggtcgtggcactctgtgcaccattcatcccatctgctcaccccacgcttccttcaggctccccaccctcgtggctcagcttgcagcaggcaaagcacgatggtccaaggtcacatgtctctctctccatctgcacttagggcacatgagcatttttctcactccccacaggcttgggactctcccttcatcaggcagtgtctcccaccatgcccaccatccagcaggaagtccagcaatacaacctccccaaggctgcaaaactcacagctggcagcgtcagtcacatggtccagtcaacatgtctttcagagtggctggcagcgtgcacagg

SEQ ID NO: 726325 - DNA, 196 bp, Homo sapiens
cacgaggagtgctgggaccatcccgtaattttgcataggaggctacatttgatgttaagaaatgtgtccttcaccgggtggaataacggcctcatgtcacaatagtgctcaccatggaagatgggctcaagtactacaggatgatggagactgcaggccgaatggaggtgaaaggatatcagctgtatcaacagaa

SEQ ID NO: 726326 - DNA, 277 bp, Homo sapiens
gggtttttttcccccccccccccccccaaaaagggggggggtccccccccaattttttttttaccccccccgggggccccggggtttgggcccccccctttttttcccccccccccaaatggggcccccggtttttttttttttttccccccccggggggggggggcgccccccccccccccccccccgggtttttttttttttttggggggggggggggggggggggggggggcctctccccttttttttttttccccaaaatttttcccctttta

SEQ ID NO: 726327 - DNA, 233 bp, Homo sapiens
gtggcaggtgctgtaatcccagctacttgggaggctgaggcacgagaatcacttgaactcgggaggtggagattgcagtgagccaagactgcacaattgcactgccgcctggatgacaagagcgagactccgtctcaaaaagaacaaaaaacaaaacaaaaaagatggggagattacttgcgcctaggtgttcaagaccagctgggcaacatcacaggaccctattgctacca

SEQ ID NO: 726328 - DNA, 235 bp, Homo sapiens
ttagaggatccccttgggctctttcagggaagacagagacacatgcagaaacagttagggccggaaaggaacccccgggtgccatgagatccacaacctcacagaagccgggtagtaaccaagggagaccagagggttcccgggggggaccagcacctttaatcttgccagactcaaagaatgtacctccagggggcatcatgggccccgtgaggcaaaccccgagaggctgaag

SEQ ID NO: 726329 - DNA, 153 bp, Homo sapiens
  misc_feature (37)..(37): n is a, c, g, or t
cgtagtgtcttctctttctcctctctcatatatgatntcatacaaacagaaaatacaaatgacttctctagccaggcttccttgggcactcttttggcttacctgggtcacaatggaagaagatgaattgtcttgtgccacatataaaaatac

SEQ ID NO: 726330 - DNA, 149 bp, Homo sapiens
  misc_feature (127)..(127): n is a, c, g, or t
atagactctgtcaggcagccttggacctggtaccagcccagcagagacgactgtttttgggcactgtcacttcccctctgcagggatcggtcatggatgaggcgctgggagctctagggcttcctgnggtcccttcttgggcctgcagc

SEQ ID NO: 726331 - DNA, 444 bp, Homo sapiens
gagctggcccgccttgtggggctggcgctgatgaaaactgcttcggttgccatggggcctcctggatagggagagcgggccatggcacccaatcggggcgacatggccccagtgggttgatgaatggtgcgggtctaccgagtcagttctcggaagccagcacgatgtgggtggcactgcgatccgcttcggtgaagatgcggatgcgctggccattggttgcgacatagaacgattcgagcttggcctcggattggattcccgcgatgttcgcttcccattggtcagcgggaacatcgccccaatcgccgcgggcgtgacgccgcagaaactggaacggttcttcggtgccggcacgaatcaggcgatcgacgcctttgctgatgatcagcgccccgatggggaactgcagttggtggatgtaggtgtcaatcctgatcgacg

SEQ ID NO: 726332 - DNA, 501 bp, Homo sapiens
attcgcggccgcgtcgactacagtggtgtgagctcctgagctcagacaatcctcctgtctcagcctcccaagtacctggaacaacaggcatgcacctccatgcctggctaattagagatgagggtctcactctgttgcccaggcttgtcttgaactctggggttcaaacaatctgcctgccttggactcccaaagtgctgaaattacaggcatgagccacctcatttgactttgttcacattctttactaatctgtttgtttgtttgttttttgaaacagagctgcactctgtcacccaggctggagtgcagtgacacaatcttggctcactgcagcctccacctcccaggttcaagcaattctcccatctcagcctcccgagtagctgggattacaggcgcccggcaccatgctggctaatttttgcgtgtttagtagaaatggggtttcaccacgttgacctggctggtcttgaactcctgacctcaggtgatccaccg

SEQ ID NO: 726333 - DNA, 440 bp, Homo sapiens
ccattatggccggccaggtagggattggtccattaatttaatcggcaaaggatattaaatccttggtaataataacggtccaaaagtggggcctatgaataatcggaccagcctatggccccagtaaaggtaaggatccaggaaccacagtttgtaaatgaccaactttccttggttaagttttagttttagcaaccaccacaaatatgttttaggtaccatcgttcaggtttaagtaccatcgttcaagtggataatctctggataggctctgttgttgccattttgcagggatccaccagttccattcatagattaaacctttaattttaactaatctgggccataagtggccattctttaacattccacatgatttaaaggcctacgtttggaaattttcctttcctaaatggcccagagttatcagccggattata

SEQ ID NO: 726334 - DNA, 184 bp, Homo sapiens
  misc_feature (170)..(170): n is a, c, g, or t
ggtcgttgaatggcccgggctcctcaaattgctggctactgcaggagggtcctatagggaacatgccgtctccgggaccacgcgacgccttccgtccaagcccctgtgctgggctgcagcattctcagagaccacgcgtcactcgagattcttgcgcgtcttgtaccacngtccagtattctgg

SEQ ID NO: 726335 - DNA, 625 bp, Homo sapiens
gagaaagcaggcaaccaccatgtcatttgaaaacagtttcatcgggatataattcgggggcatacagtgaatccatttaagatactctgacccatggatcccctgggtgcagccaagccacaatggccatggcgccgctgtctggccgcactgctatttcagcgtgctggtggctgtgtgtttcttctcctacctgcgtgtgtcccgagacgatgccactggatcccctagggctcccagtgggtcctcccgacaggacaccactgggagccgccgcgagacttcatggtcctgggtatggagcgatggacgtaggaaatcaccatgaggctctgtggccgctagtcagagatggtgcccgggacagagactggcaatcgtgacgaccgcgaaggtgtacccacaggcagacacgggacatcgtgcaccgacgtgggactatcatgtgcgcaaaccctaagtcagcgcctacaacaccgttacacccgaggccgacagggggccagccgctggactctggtggtcaaactatggagccacgcacccttaactgccaagccacctggaaggcccctggaaagatacctttcactctcaccatggctccttagccgcaggcgactcc

SEQ ID NO: 726336 - DNA, 1037 bp, Homo sapiens
acttctacccgttggcaaattttttacacactgtttttttccctttaatcaactgtaaactcgtaaatttcttgtttcaaacattgttggtcttctctactagtattaatttcttttcagctttcgtaagaataccgaatttttgtcgtaatttgccatatcttgtaactcacttttacggactactttctataaaacgcttcaagaatattcaccattgaaaattactattctatacagctaaaattgatctacttttagatctaaggaaatactacagagatatcttcatgggttcagtaacttttcatcagtataacattgggcacggtacagagtgattgtcacataaggtactcgaagatttatttagattaattctattatttacagtaaccttgaattcttctgagttttgcatgtattaaattcaattgaatgcttgaacagtgaagagtaaagtatttatctgaaagaagtttctgggttaggagacagtaatgaatgtatccatttgtacatggtttacatgcttgctggatgcttctgtaaacattttcctgtatgtctctaaacttgtcgtttcagcaggactgtaattgcccttgtgtcgtagttataaatgagtcatcatctggtcctttgtgaaatggaattcatggtattcttctgtcaacgttttcctgaagctgtttctcggacgagccacacatttagaatacagacagctttcctgatcattcgatgttattgtcgcacctgatgttcttggtctaaaaggaacttattggccacaagtatattttatcttacttcttgtagatgtttagccttgtatacgttagaagtgctcttacatgatgactgtcgataagctgttggtcccatttactgggtttggggggcttgttataagatataggatatgaagaatgcaaaatggttgatcgttcaaactgtccagctctgatccaataccatgttactgatagtacttccctagtatgatattataccgtagcatacaatgtcaccgg

SEQ ID NO: 726337 - DNA, 275 bp, Homo sapiens
aatccccagggcctcaaagtgaagggtccgttgtccaatgatttttaaagttatgttttcaaagaaaaaaaaattccttttttcctttttagcccatttaatattttgagggggcctaatccctcctttgccttcgcccctttaaaaaaggtgttttgtttaaaaactggacggccgcttaatttaaatttgccttggctaagttttaggggatttataaaagggggaccccggttttgaaaattaactttttttttgcccttttcaaaaacaca

SEQ ID NO: 726338 - DNA, 525 bp, Homo sapiens
acagcataaactatttatgaaataataactcagatacagagattacttcctattggccttacatatgaatataaagaaatacatattatgaacatgagcatacttattttataattatgtaaatgtttgtgtaatgttatatataagtgcaataaagtcatgcttatacatggtctcaattcatgcttctaaaaaccactcaatgtagtcattatcatatgttaataaataatctctgaaaatgtgcttctagtagttgcacaatatcccatcataaagattgtcatgctgtttttaagtcatacttttgagtatataagttatatctgatatttttctgctacatatatactattataaatctaatagtagctgattttttgtcaacacatatgattgtttcctcacaatagtacaagagttggttgtaactttatttccttccaacatttatttaggttcagcgggtacatgtgcaggtttattatatgggaaaaatgtgtgtcaatgggatttggtgtacag

SEQ ID NO: 726339 - DNA, 147 bp, Homo sapiens
gtaccgcttcacacatccctgagctgacccttgtcattcttagacagcttcagtccactggccaggcaccctgtatatgccaattcaagaagagggccaagaaatcagacccaagtgattgttccccgctaagtgattgttcccgct

SEQ ID NO: 726340 - DNA, 112 bp, Homo sapiens
gtgccttctgctgctggaactccgaaaatgcggggaaccacaggccatactgtttactgatgataaggaaactattggtatatagacgagccccatatcacgtggcaccgcc

SEQ ID NO: 726341 - DNA, 387 bp, Homo sapiens
cgcatcaaatactagagagcactgagttactggtgactcgtggtggaccgcagctcatctagatggttgttggtcatagctgcataggctctgtgttgtagctttacgaaggaggtaccatagaacacaatgccagagatgtgtgacttagttggagcaataatatacttgcagcctagagcaaaaggccaagctgtcctgagagatagaacagtattcccaaattctaactagactacaagttaagcatatatgttgcttgtaggaatatattgacaattgcaggcacagtattccagtcacgtcatataaatgcaagggcctcagcttggggactctgaagaactgcagtgcgtgtgcaagctctcaatctcacatgtcgcttcc

SEQ ID NO: 726342 - DNA, 294 bp, Homo sapiens
tctttccccttttaaagggaaagctgcaaatccccttaatttgccataataatggcaaaaggagggaagggggttttttttgaaaaaccattggggtatacaggatggcttggcaggtaacaaccctttttctacaaaatctacttataaaaaaaattttatgtaaaaaccccattctcctcaccataatcaccataagggccaaattttaatttggtatccatttggaagggtggcttggaaaaacccaactaattttttatttaaacattaaccctattttttttaaagcaa

SEQ ID NO: 726343 - DNA, 335 bp, Homo sapiens
  misc_feature (69)..(69): n is a, c, g, or t
  misc_feature (335)..(335): n is a, c, g, or t
cccctgaaactccagtttttatatgtgctacggcgggggttgttgttctcctggacaaacagggtgtangaggtttgtgtgaaggcgggggcgttgtcgttgacgtcagacacctgcacagttatggtgtgctgggttgtgagcctgggtgtgcccaggtcggtgactgtgatggtaatgttgtactctgctgttgtctctcttgtccaacggtttttgtgataatagggtgtaaaagttttacccataaagtccttagaagaacggcataattgtcttggatggaaccaggtatttttccaattttttctgatttaagatttaatactcgggan

SEQ ID NO: 726344 - DNA, 816 bp, Homo sapiens
ttatttctatgttttaatgtaggataattctgggtaaatgtgtatgaaatgtcctggtacccgttttagtaagatatctggatactggcacgtgtgtcactgcgtcagtcctaatctgttaatttaacatacttcaattacatcacgacacaacacacacacgcgatattgtgccatactacgcgaatgactacggcacagaacttagaaacatggtacaaaccactttgcccttgtgggggttgaaacttggaaggcccccagtcggtcctccacctcacatccgtgccccagaggcttggatggaccttgtctagtgtcagttacagtgtcccttcctgggaatgtgacatgaggtgccggactggggccaggctcagggggcagaggtctggacacaagggacctggcgaggtgctgcgaggccagggaagccttgagtttctggcaggtggctgagcagtgggggagcatttgttttgtgggtgtctgtgtgtgaggtcaccctcaaactgcaccgccggccagataccctcctgacctccgaggacttgctctggtctctctggtggctacaaccccagagttttaaggacttggaaaggaaagcacaatcagagaagaaaacagcccccaaaccagcaggagtggcataggcacatggacacggcctggagcgactgtgcactccacccaagcaaggctacccagggggcctgaatttctctctcactgtctcattttgataaaactgcctgcagcggctctgaccccatggggggcctttttacatactgcgaggcccagctttctagg

SEQ ID NO: 726345 - DNA, 82 bp, Homo sapiens
gacattcggattgctcctgctgccccacacacactaacccaaccatcttggggtgtactccctgccagaccaacaaatccct

SEQ ID NO: 726346 - DNA, 192 bp, Homo sapiens
aaataatgggctatttctctccccgagtctttttttttaaaacccaccgtggttcctcagctaactgcattccctacccaggcagagactgtcctatgcctcgagcttcccaacgagactcagaccgcgacccagcccccgtatttatggaatggcaaaataaataaagccccaacccctcggtttttgtga

SEQ ID NO: 726347 - DNA, 750 bp, Homo sapiens
tttctccacatccccccccacgcggcatggtcgcggcttcgcatgacaccctccaccccgcgggtcaagacgtttctccgcccggggacaccccttctcccatgtccacttctccccctcccgcccccccacgggaggttacgctgcgggggggggccggggggtgggtcgcctcctctccactcccgggggtgttgagttcccccccctcccccacacaccaaaaaaacggggggtgtgccccgggcccgcacgtgggttgggggcgcctccacattggccccctcttctccctccagggggggggcaaaccacatacaacaacacgcaggggcccctttttaggcccaggcgggggatgtggtttttttaaaaaaaaacccccgaaaaaccttctgcttttatttctttcacaagcgggcgaatttacaaccccctccccccgggaaaacagtttttttttgggttttccccccccaacccccccccccgggggggttggccccccccattgccccgggctctaacattaagaggggttccccgtccaaggccctttccgggtaaaatttcccccatctcccctccctttttttttcccccccccccgcccctgggataaaaacaaccggggtttgttttttttttggaaaccccccccggccctttttttttttttttttttttaaggtttcccccccccgggttttttttttccccccaaacccttttttttttttttggggggga

SEQ ID NO: 726348 - DNA, 310 bp, Homo sapiens
agtgaggctgtagttccttcccctggagcacctgtgtggtcaggcccctgctgggtgcctggcttggtgggtgtgcggtgtgctttcctctctgggatgctcgtttttgcgtgtgggcttggctggtgtggtccgggacccctgcgtgttgcttccctctcctgcctggctgtctcgccccctttcttctccatccctagctctgagccctgggcctgggggctgtgggcggcgctgtctctggtgctgggctggcccgtccctttgcgcctctctctttgccccttcccctctctcttcccagctctgg

SEQ ID NO: 726349 - DNA, 500 bp, Homo sapiens
gctcgacagacaattctgtgaaggcaactgcgatgtctgtggactgtcttgggcagcatgagtgctttctggacggagctctctgtcacccaggctggagtgcagtggcatgatctctgctcactacaacctctgcctcccgggttcaagcaattctgcctcaacctcccgagtagctgggactacaggtgcacgctgccatgcctggctaattttttgtattttagtagaaacggggtttcaccatgttgcccaggctggtcttgatctcctgaactcagacaatccacccacctcggccttcccaaagtgcaaggattacaggcatgagccaccgtacctggccatatctttataatagagtaatttagattcctctgggtacataccctataatgggattgctgggtcaaatggtatttctgcctctaggtctttcaggaatctctcacctctcctactcaacatagtattgaaagttctggccagggcaatcaggc

SEQ ID NO: 726350 - DNA, 433 bp, Homo sapiens
  misc_feature (121)..(121): n is a, c, g, or t
  misc_feature (169)..(169): n is a, c, g, or t
  misc_feature (183)..(183): n is a, c, g, or t
  misc_feature (196)..(196): n is a, c, g, or t
  misc_feature (230)..(230): n is a, c, g, or t
  misc_feature (233)..(233): n is a, c, g, or t
  misc_feature (263)..(263): n is a, c, g, or t
  misc_feature (285)..(285): n is a, c, g, or t
  misc_feature (303)..(303): n is a, c, g, or t
  misc_feature (341)..(341): n is a, c, g, or t
  misc_feature (387)..(387): n is a, c, g, or t
  misc_feature (412)..(412): n is a, c, g, or t
tcacttatgtttattttatgaaagtgaagacaagcttattttatggaaatgttaccctactttcttgaactgattaagaaaaaagtgatttctttctcattagtatagtggtattaaaatnaaaagaagaaaaaagaaaattaaattatttttcaagggatctcctcantaaataaaaatgcnaagtatttcctgntcagtgcagagaaagacctcttaaagtatattgnccnaaaggaggagaaaactttttacctctaggnttcccctttggggaattctcgntggttcaggtcactggcncttaccgtggcttctttagaggaaggcttctttctttnaaactttgccccaaagtgccacccttctcccctaggtatgctctgngcccatgtagtggacctatcccccnccattacccccaccctttttt

SEQ ID NO: 726351 - DNA, 915 bp, Homo sapiens
aggttcctggacctacttccccgggaggaggatcagcgctgaggagcggcctcaagcatgagtattgccgcgagagccccctccccatcgaacccgtccgatgttccgcacgtggccgccaatagcgacgcaggagtgtgtgaagcgttggcaccgagccccggaggccccgctgcaggggaggtctgggctcatccgccgagtctgttggtgaactacgagcttgtgatggagacggggcttcccactcctttccaaccaactgaagactctcgtgcggccgtctgcctgctgggtccccaggtttcagcgctcaacgttcgtgagatggtctgcgtggatcccccgctcactgggagagtagactcgagccctggcgcacccacaaggcggtggcctactggcgggtatgcgacgcgtgccgatgagactcgcaaactccttcgggcttcacttctttgcctccaatgtagcgctaatgcgtactattccgtgtgtgtacaatcctgtactagattgtgctcatctcccgctatgtatgtcgaggaaagagctggtgctattctcctgtgaacgttgccctgggcttcttcgggtgtgccctaccgttgggtgcacgccctgaacctcccagaccccgctctcccaactcctcggatccgcaccggggctgggtggttccgtgatgtgtacacggcacgctgggaacccggcgggggagaatgaccttcacggactggacgaccgggtatgtgtggccatgaacgacgaccgctggccaacccgcgcaccagaacaaccctgcagagagcccgcgccaaaccgcgcgaccgcggcccaactgcaaggaaaacccttctaagggggacacaagaacgacaacacaaacacacacaggaacacgtctgctacaat

SEQ ID NO: 726352 - DNA, 828 bp, Homo sapiens
  misc_feature (28)..(28): n is a, c, g, or t
gcgccggactcggtttctcctgcggcangggcgctccggtttcctctccgcatgacatgctccgaggagtcatcttcttgcgtgatctcctgacttctggtgacctggtctgaacgtgttggtggttagctcgttctaggcaaccaggcatgagctcccagattcgtcagaattgttcgattccgatgtggaggctggcgtgaacagactggtcaatttgtacctgcaggcctcctacattgctacctctctctgggcttctattacgaccgtgatgagtgtggctctggaaggcgtgagccacgttcgtatccgacgaactgtatcgtaggagaagcgcgatggcgctatcgagcgtctcctgaagatgcaaacatcagtgtgaggagcggctctcttccaggacatcaaggaagccagctgaagagtgatgtggtggtaaaaccgccagacggccattgaaacgcttgcatgggcctggagagaaaagctgaatcagggcctttttggatcttcatgccctgtggcttctggccgcaatggaaaccccatctctgtgaactttcctgggagactcatatctcaatgaggaaagtgacatttcatcacgaagatcggggttgaccagcttgatcgaaccttgcagaggtttggtggcctggaggcttggatgtgcaagtatgtcttcgagagggctcactcttcaggcggagttagagccttttgagccaaggaattttgagggcctgcaaataaaggggaaagcaaaggcatactccagcaaaggaggaatttaaaatctaaaactggccaaggaaaagcttgaga

SEQ ID NO: 726353 - DNA, 1369 bp, Homo sapiens
ggtggcggcgtgacctgtacagtcccagcgtattcgggaggctgacgggcagaaggacaacgggttgagactaggaaaggcggacgtggcggtgacgctgagaatcgacgaccaggtgcgctcatgagcctgagtcaacactggcagacaacgttcgctctcgagaagagaccaaccgagcacgcagaccaacaagcgaaacgaacaagaaaagcctagcgagcggagagagagacatgcgtaagtagcagacccgtccaagacaatgaagaacacacaatcgtgtacctccaatagagattcctgggtgtataccatcagtcgggcaacgttgatcagttcagcggacaacacttcttgtacacagggccaagggtcggcgtgctagtgaaatcactggcactggtcacatcgtctggagacctttggggaagcgggtgaaggcgcgggggacgggaatcctaggcatggaagaagctcccgtggtgcataacccagatgctgggccacgccaatggactgaacaacaccactaatctactaacataaaaggacatcaacaaaacgcaagggcacccagaggccagtcatgtgagacaaacatgacccatgataaattcacccaggaataacatctgagagaaaacgactagaagcgcgattgacgaacctggccatcgacaccccgggaatcggtgaaacgggattgcaaggcagaggcccaaaaattcggcgacacacagggcaaacttcgcagctcatgggaatggagaagcacggggataaacttcccactagacatcaagaaaacaaccaaccaaaagacaagggaagggaaacaaacaaaccagagtacgacgacgccgcaggggtacacgcagagagaagggcacacaaaaaacaaacacaagaggggcagaagcagacgccaacaacagagaaagaagaaacacacacacaggaggtggatcaaaacagagaaaacaaaacgaacaaacaagacaactgtagcacgggataaacacagccaaaaaaacaaaaagcaacgcagggcaaagcaaacgagagctcagacaacccacacaagagatagatcatgggcaccactggagaacaaaaactacgaacgccaaagaccagagccagcagaaaacagccccacgacacggtcaagagcaacagcgcaacaaaagacgaacagaaataagagacgcactaccacacgaagcaaaagaatccaaagaagacatagaacgcattacaacaccacactaagtagatgcaccgaagacaaaaatcacaacaacaacccaaactgcaagatgacaaagacaaagaaaaaggacgaaaaaacacactacaacaaaaa

SEQ ID NO: 726354 - DNA, 781 bp, Homo sapiens
  misc_feature (598)..(598): n is a, c, g, or t
gaggtctagtgggagatcatgaaaatggcatgaatagtgtgggatttctctaagattgttgatattaattccattagactcttatgtgagtgaagacgaagacttcccctgagtaagttcagacagcttgtgataacatttctacgtcgattcctcaggatttaactatatattcttgaaaacatctcaattttaaatgtttctttcaagatggtgaattaaacagagatagcccttcaacaggttgaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggctgggcatggtggttcacgcctgtaatcccaacgctttgggaggccgaggcgggcggatcacctgaggtcgggagttcaaaaccagcctgaccaacatggagaaacccnatctctactaaaaatacaaaattagctgggagtggtggcacatgtctgtaatcccagccacccgggaggctgaggcaggagaatcgctcgaacctgggaagcagaggttgcggtgagccgatattgccccattgcactccagcctggtacacagggagaaaccgtcgattcgagtatcctgga

SEQ ID NO: 726355 - DNA, 174 bp, Homo sapiens
ttgcggggtctcatatactgccatgcttgcatgatatggaccaaagaggaacgaagacgtgattatagcgggagtttcgttgctggctctagcagagtattgattaccactgacctgctgttcagaggatagctgtgcagcaggtttctatagtcatcaactatgagacccgca

SEQ ID NO: 726356 - DNA, 880 bp, Homo sapiens
  misc_feature (801)..(801): n is a, c, g, or t
  misc_feature (803)..(805): n is a, c, g, or t
  misc_feature (807)..(808): n is a, c, g, or t
gaggtctagtgggagatcatgaaaatggcatgaatagtgtgggatttctctaagattgttgatattaattccattagactcttatgtgagtgaagacgaagacttcccctgagtaagttcagacagcttgtgataacatttctacgtcgattcctcaggatttaactatatattcttgaaaacatctcaattttaaatgtttctttcaagatggtgaattaaacagagatagcccttcaacaggttgaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggctgggcatggtggttcacgcctgtaatcccaacgctttgggattacacgcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttttcttttctttttgttttgagacaaagttttgctctgtcacccaggctagattgcagtggcatgatctcaactcactgcaacctccgcctcccgggtgacagagcgagactctgtctcanannnannaactgggattacaggcgcctgccaccacgctcggccaatttttgtatttttagtagacaggcctcaaatctg

SEQ ID NO: 726357 - DNA, 443 bp, Homo sapiens
  misc_feature (50)..(50): n is a, c, g, or t
  misc_feature (63)..(63): n is a, c, g, or t
  misc_feature (164)..(164): n is a, c, g, or t
  misc_feature (301)..(301): n is a, c, g, or t
  misc_feature (356)..(356): n is a, c, g, or t
  misc_feature (387)..(388): n is a, c, g, or t
  misc_feature (391)..(391): n is a, c, g, or t
  misc_feature (401)..(401): n is a, c, g, or t
cccctctgcacgcccagcctcccgaaggcgggatacaagtgtgagccacngtgcccagctccnattttgtttctttataataacatatacattagaatagcctgggagtataacctcatatcaatcaacaaccaattttaacctgacagaactaacactatgcnaaatccaaaaacctaagaatttgtaactcataatttcaattattcacaggacagcaaaacagtcaaatgcttatactctattttttacaaaactaccactgcctaatagtaatttatcttaataataaaagcagacnacacttgttttccgggcataaaaaaggatagaaatggtctaagttcgtttatccnataggccttattttataaatagcacacctcnntanatctcagccntaatggatatataacctacgcacaaggctgggcgtgcagtgg

SEQ ID NO: 726358 - DNA, 517 bp, Homo sapiens
  misc_feature (277)..(277): n is a, c, g, or t
gctctgttttccagagaaatttagttctgacccgcacttgcagactccaactagaaaaacaaacaaacaagcaaacaacaatcagaggtgattaactggacccattctcgattaactggacccattctcgattaactggacccattctcgattaactggacccattctcgattaactggacccattctcgattaactggacccattctcgattaactggacccattctctttcgaaggcagagcaagtatatcccttggggctctcaacccataccntgagggtcctatcaaaatatcctttccattcacttacaatagaacgaattccaagggaagttgttacaaacacaatttcccagtgacaccagcttcccaatgatgtttttgggtccctaggtgccccaggcacctatctctatctgcctttgcttcctgtagatatctgcatcctaccgtggtttttctatacctaaaggacaaaaattgtattcctgtgttggattaaataggcataat

SEQ ID NO: 726359 - DNA, 555 bp, Homo sapiens
gaggtctagtgggagatcatgaaaatggcatgaatagtgtgggatttctctaagattgttgatattaattccattagactcttatgtgagtgaagacgaagacttcccctgagtaagttcagacagcttgtgataacatttctacgtcgattcctcaggatttaactatatattcttgaaaacatctcaattttaaatgtttctttcaagatggtgaattaaacagagatagcccttcaacaggttgaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggcaatttctacaccatagagaaagttctaacactttgtagccacagtgttggctttcatttaatcat

SEQ ID NO: 726360 - DNA, 971 bp, Homo sapiens
  misc_feature (892)..(892): n is a, c, g, or t
  misc_feature (894)..(896): n is a, c, g, or t
  misc_feature (898)..(899): n is a, c, g, or t
gaggtctagtgggagatcatgaaaatggcatgaatagtgtgggatttctctaagattgttgatattaattccattagactcttatgtgagtgaagacgaagacttcccctgagtaagttcagacagcttgtgataacatttctacgtcgattcctcaggatttaactatatattcttgaaaacatctcaattttaaatgtttctttcaagatggtgaattaaacagagatagcccttcaacaggttgaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggctgggcatggtggttcacgcctgtaatcccaacgctttgggaggccgaggcgggcggatcacctgaggtcgggagttcaaaaccagcctgacctcaggtaatctgcccgcctcagcctcccaaagtgctgggattacacgcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttttcttttctttttgttttgagacaaagttttgctctgtcacccaggctagattgcagtggcatgatctcaactcactgcaacctccgcctcccgggtgacagagcgagactctgtctcanannnannaactgggattacaggcgcctgccaccacgctcggccaatttttgtatttttagtagacaggcctcaaatctg

SEQ ID NO: 726361 - DNA, 131 bp, Homo sapiens
acgtgaggatccggcacgaggttgatcctcactgaaatagacacttactgcagatatgcatgcaatgcttctgccaagactaccatctgtggagtcatggaatgccttatccactgtcacagtattccata

SEQ ID NO: 726362 - DNA, 277 bp, Homo sapiens
tcgcccagcatcaggccgtggcgatagagcagcacgccgccgttcgaccagatatcgaaatggcccagccagacctgttcgttgatgagcgccatgacctcgaagaccgcgcccttcttgtcatcgggcacgcgaatatcgggcaggcagagaatctgcagaacgtggtcctcggcgcgccagatcgaacgaatctggtaattggcccagctgccctggatctcgcccagtatctcgtcgtccgaaacgaattcgaacgcccagccgcgcgcctcga

SEQ ID NO: 726363 - DNA, 608 bp, Homo sapiens
gaggtctagtgggagatcatgaaaatggcatgaatagtgtgggatttctctaagattgttgatattaattccattagactcttatgtgagtgaagacgaagacttcccctgagtaagttcagacagcttgtgataacatttctacgtcgattcctcaggatttaactatatattcttgaaaacatctcaattttaaatgtttctttcaagatggtgaattaaacagagatagcccttcaacaggttgaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggcaagaggaccgcttgtggccaggagttcaagaccagtgtgggcaacataacaagatactgtctctacaaataataataataattcatgttgaggtttatgatgagcttgcttctctcat

SEQ ID NO: 726364 - DNA, 1360 bp, Homo sapiens
  misc_feature (1007)..(1007): n is a, c, g, or t
gattcttttcacacctggcgagaatataaccactgtgatcacacactgttggtgtgacccgcagaaacgtcgtgggtgcaacccggcggggtgtagtgtctcacccgtccatcattagttgtttccaccacagtagccatcggtgttgaccatcttccacgtgctgggggtgttggagattttttttagtcgcgtccccccccaccaacggtggaggtgttcctggcatgtaccgccccgctcgggtttgtttcctctacgtttgtgggggtggtgacaccacgaccgttgtgtgatgcgagtctgtcccactccagagtgaggccaacgaccgtcgtctgtctttgttttcgcagaggcgctgtctctcttcgttgggtaataatacacccacacagtaggatgtttctgtggttggggtgccaccaccaccctgtgggagagctagaacaatggtctccgacccccccccctgctccctccttgttaagacatcgggcacccacgtttggggggcgcatctcctcctgatgattattccccggcgcaggctgacgatagaagggttctcaacagtgtgcggtcttatttgtgcgccctcaacactaaagatcaggggtgtggaccacccccctcctgtgggtgcccaccccgcccgttgttcgagacgccacgctttctcggggtgttgccactcctccctctcatctcttgctctcgtctccccccctgtcgcccccaaagagtgagggtgagacccactgttgcccgccccgcccccctctcttttttcgtcctcgccccccccattgtgggggggttctctgtggggggcaccacatttatggaaatagagggggagcgcccctccctccccccccgccccctttatggaaggggatattcttgtgtgaccatgatataatgcgcgccttcttctggagatttctgtaggttaatgcacaggggcgcacacgatatcacccccaatggggcacctatgtggntctccccgagaggggagtctctcccaatatttaagggggccacacccacagagttttatgtgtgcagccccacggcgcaccagcgcggcccaagcacactcacgcggagggagtgtccctcgggtctcgcccatctcttcccaaaaggccatcgggtgccccaccccaggcgggggcactccagacaaggaggcttctctccaccttccccggcatgtgccgcccctgtcccccgcacgccatttctcgcactactgcccctggtagtgataatcactttttaaaaattttggaaaacccggccctttttcccaaaaaaacacccaaaaccccccacaaaaaaaaccggggga

SEQ ID NO: 726365 - DNA, 1495 bp, Homo sapiens
cccatcgcgtcggatcgagcggcggtggcggtggcggctgagagggcggtcggcgggaagcggagcggtgacgagggaacgggaggaagcgagcgaggagcgcgcagaagcgctgcttttcgcgtcgcgcctgacggagcctgaatgcatgcccacgtgcaccccagtacgggcagccgcttggcctgctcggagaacaaatgcctgagatgcctcggtggcctcgacgaggccaattgtcgcgtcgtcaatgtcaggcaggcgagcgcaacctatgtccccaagaccaagaagcctgggcacattccgccgagcctcgccacgctgttgggcctattcgagctgaacagcccctgcggcaatgccttatccccgttcagttgaaccttattttggacaagccaatggacactctggtggggtgtgggaatctgccttccttttcttccaagaagcaagaaagcgcgggggacaggtgaaaaccttcggaaaatttcaatttttatttgcacccaaggacaacagggtttgtgcggtgggttaggggaacattcaggcttacggggcaaaacgtttcatttcgacacaattttggggccgttccaaggaagccgcccgtcgagtgcccattgtgtacaatattcagttgtggcccccaaagaagttagttcccgcgagggggacactttcacgcattaaggccgccaggtgggtggcccgtacgcgcagtattgtataaggatttttggggagaatggagaagctttcccgcaaagtgaaggggttatcagggacaccgtggttttacgaagacgactcagaaatagttatttagtggaaagcacagagaggtgagtttgttagtgaaagagtcaccagagatagtttaggtagtgaggggctaacatcatgtgtggggaacagaacgaacgagtagtttttgagacagatgaagtggagttgtgggggagtgagggcacaattttggtaagcattatgtggcgtgattgccaaagcggcttttttactcagggaacaggaaaaacatgttggggtgggaacacacataactatttccgtttggataaagacggattatcagcgtattccaccacctggttgttagtggacgacacataagtggggggagaaaagtttttcgaaagcgcagaagtcagtgttggtatacaaaaagtactaactagcgggcagataaagagggtaacgcgaagaataagtaatcagtgatgagcgtgttttgggaggacattttcttaaacgcgtttttgtagtatatcatgaagtcgatttatggggccgacacgtcgtcgcacgatatttgtggtggaaaacatttttttcagtgtggggcgagccgcccaccgaaagactggattatcaaagtaggtgggagaagcttttctagcatagcgaacggtcggagtaagtgagttatgtgagtaacatataatatgatacataggtcgataatacc

SEQ ID NO: 726366 - DNA, 262 bp, Homo sapiens
gaaattggcctaccacgccgcagtactgagtcatctattgccccctctattgatccccactccaaatatctcatcaagcaactgactagtcaccacccaacaatgactcatcaaactaacctctaaaacaaatgataaccatacacaacactaaaggacgtaacctgatctcttatactagtatccttaatcattctttacttgccacaactaatttctctcggcaccaatgccggtatcctcttacacgtcgacctgcagg

SEQ ID NO: 726367 - DNA, 140 bp, Homo sapiens
gtctgcccttacgattcacaccgtctgacattggtaatatctcatgtggccatatctagataaaaagaagaacaattacttttcacttctaattgttaaaacttccattttaaattagaatgccgttgttcttcgacgaa

SEQ ID NO: 726368 - DNA, 790 bp, Homo sapiens
gctttccgtggagctgtcgccatgaaagtcgagtctgtgcagttttatcgggtacaagatctagcccggacacgggaggcgctacgccaggaccgacgggaaggttgaccagtaatcttaatgcgaaatgcgagtctggcttgtcctttaccaagaggaagtcctcgcgcagataagactggactgtcctctacagaaggaacgtcacaagaacagggacagtcggaagaccattcaccagagaagaacccgccgatgcagtcgaattccagagggccatgactggtgcatctcttgctgatataatggccaagaggaatcagagacctgaagttagaaaggctcaacgagaacaagctatcagggcatgctaagtgaagcaaaaataggctaatgcaagctatctaaataggattgcaatgggtgctgctaaggcacctgcaaaggtcagcaccttaggcaaaagattgtgatgcctgtgacagtttcagctccccgagtgggtggagaaacgctaaagactggcgagatgagcatttttgagataacagattggcacttttatagtcctggaagcagcagacatcaaatgtccgagagtgtcatagcgatcagggtgccgcgaaaagcagcccggtccttggcgaacgggtgccctgtggcacatgcgcagtttctcaccggacccgaattgcgtatggatccgcatgtctgggacaatccgccccggtgacccctcattcggcccgcggcagtggccttgcacggaaaaccacggtttagcgtgaac

SEQ ID NO: 726369 - DNA, 300 bp, Homo sapiens
ctggattaaatacctcacatctgtttaccaaatcatatctccctttatgaactgtgtcttatactgcttaaccagagaaaatgtttaacctgtttgtagacttatacatatacaataaaagtattttccacatttttctttctctctctcttttattagagatggggtcccattatattgctcaggtagatcttgaactcctggactcaagtgatcctcccaactttacctccaaagtgctgggattacaggcgtgaaccctagggtgttaagagtataaattagtgcaaagagtaaggg

SEQ ID NO: 726370 - DNA, 1457 bp, Homo sapiens
  misc_feature (286)..(286): n is a, c, g, or t
  misc_feature (296)..(296): n is a, c, g, or t
  misc_feature (1012)..(1012): n is a, c, g, or t
  misc_feature (1266)..(1266): n is a, c, g, or t
gtgcagggcgtgggacagtgttggcggagcaagaagcgggtagcgggagacctcaaggcctgtgaggttgtggtctcggaagacagctcgtgtgcaggctagagacggatgtgtgccgatggatcggcgagagatgtcgtgcgtagcggacttgtcgacgcgttacgaaggtgttgctgccctgtacttaacgtgtataacttcgttctgcgtgccagcatctagcctctgcatatacaccattgtgtccttgtgcaccatatgagtgatgtaccggtggcgaagntagcacaggnctgatgcacgtagaccacggctccatgcgccgtacgcgtactcgtggaagacttgagatacgccgtggacatagtccgtagcgccgtgccatatcggcacagcataggggctaaactgccccgtggtggcccatgccggaaactacatattggtaacgtgggccatttgtgatttggaggcggtgggtcggccagcccatcaagcagacacagggccgtgatttgcctgctaatgcacaaggcgactaacacacttcgacttggggggaccccaaggggagctcagtaacgcggcagtggccactgccgcttgagacacggcgaggcgctcaggatagagcgacgaacgccaggctggagcgacactgtggccttgtgggatgtgcgacctatgcacttggtgcgcggaaaggggcacgcataaaaggggcctcttatacctagactgtcgatggttaatccccttgcgagaattggtggtaagaagaacggagaaactttccaatccattgaattgggcatacccagcaattcgtaggcaatttccaggagggaaagggagttaaggaggggaaacaaacttggggcgtaggaaaaggaggagaggttccattatcccaaacgataggggccatgaatttgaatcgggcggtggagacgttttgcataagcggtagggagcccgggggtgaaagaagcattggcacgccgcaacngggccctaaatctcaggggagaggggggccgccgaaaagattggcacccctgtggggggtcgcgacatgggagaaagtctttgacacaccgcaaagggtccaatcacatttacattgacgacaccctggaaaaaggggtcccgcaacccacaggtaggctaggttcgaggcggtgcatcagaacggcacggggctagaaaaggctcggggctttaattcatgccagcagaaagtaggagggtccacacaaagtnccaagggggggctgaatcgcgctattaccgccatgcaaaggacgcttggacacgctggcactcggacatggcacacattattggccattgtgaggacacaaagtgaaggagataacagctcgttaggggcgagagaattggtcgactaaaaccgacacgcaaccctcgtagcaacaggtatttgcgcgacc

SEQ ID NO: 726371 - DNA, 227 bp, Homo sapiens
  misc_feature (46)..(46): n is a, c, g, or t
  misc_feature (79)..(80): n is a, c, g, or t
  misc_feature (85)..(85): n is a, c, g, or t
  misc_feature (107)..(107): n is a, c, g, or t
  misc_feature (111)..(111): n is a, c, g, or t
  misc_feature (147)..(147): n is a, c, g, or t
ctgggcttaagcgttccatgcgccttggcctcccaaggcctcccangtgctgggatttttggtatgggccacctatgcnnagccncccatctccctcctcttgccancagntgccctgcggcaacttaagtcttcatgactttctcnccaattacaaaaaggctttattatattttgccaaatgttaatgcgctttcattattgtctcctaacattatttccccact

SEQ ID NO: 726372 - DNA, 1144 bp, Homo sapiens
gcgacagttaggcgcatcttctgtgcgtcgccagccgagccacatcgctgagacaccatggggaacggtgaaggtcggagtcgacggattgggtgcgtattgggcgcctggtcaccaggggactgctttcaacctctggtaaagatggatattgtggcccagtctagagtgaccccgttcgatatgacctcgaagcgtacatggtcttacaattgttccaaagtcatggattccacccaattggacgagaagttatccataggacgagccgctccaggacttgaagaacgggaagccttgtcaggtcgaatggaaaatgcccagtcaccccaatcttaccaaggagcgggagatccgcgtccgagaaatcagatgtggtggacgatagctggccgactggacgtgacgtcgctggaagtgccacttgtgcggtcgttactaaccgaagccagtgggaagagaggcctgggagcctacatgtgtgcatgggtggagagccgaaacacaagggatcaggtcatactcgtagcccccgtacatgtctagatgcgctcgccctagtgttctgatcaagtggcgatgtagaacccagtggacgaacgtatagacaacaaggcgcttcaaagatccatcggcgaatagcctccgggggccaccaaacttgtcttagcaggccctgggcaaaggggtcaatccatgacgaaaccttttggatatgcgtggaaagggacgtcatgaccacaagtcacaatgtgctatcaagcatggtcactccaagaaagactgttgtgataggacccctccggggcaacactagttgtgcggtggaataggccaggcggggcgctcgtccagtaaacgatgcactaccctgaccgcgtatcttggcaggctgccaagggcttgttgaggcagggtcattcccctgaggctgaactggggaaagcatcagcgtggacatgggcctttccgggagtccccaacgtgacaaccgtgtcacggggtgggactgacccttgccgtgtagcaaagaagttggcatgtatgatgacatcagtaaggtggtgaagcaggaggtcggagggccctctcaggggatcctgtgaaactggggcacactgggctcgttgattcacacgaaccg

SEQ ID NO: 726373 - DNA, 99 bp, Homo sapiens
aggctccaagcattaacgatatttgcgaggtcagcacggtgctcacgtgtcagaaggaacttgtacaaggaaggcatgcaccgccaatggtgaaataca

SEQ ID NO: 726374 - DNA, 423 bp, Homo sapiens
  misc_feature (42)..(42): n is a, c, g, or t
  misc_feature (47)..(47): n is a, c, g, or t
  misc_feature (175)..(175): n is a, c, g, or t
  misc_feature (227)..(227): n is a, c, g, or t
  misc_feature (270)..(270): n is a, c, g, or t
  misc_feature (335)..(335): n is a, c, g, or t
ttttttttgagttagggtctcgctctgttgcccaggctaaantgcantggtgccatctcagctcactgcaacctccacctccagggttcaagcaattcttgtgcctgaacctcccaagttgctgggattacaggtgtgagccaccacgcctggctaattttttgtatttgagtanacagggtttcaccatgttggccaggctggtcttgaactcctaacctcaagtnatccacccacctcagcctcccatgctgggattacatgcatganccactgctcctggcccgctctgtccttaaatagtgttattttaatttccatcccaaccatagganacactaatgtctaaacacctcattagggcaggcagtctactctgaaagtggaattgccttgtctaaggtctccttaatcaggattatt

SEQ ID NO: 726375 - DNA, 254 bp, Homo sapiens
gacatctattaaagggaaactgactggcatcaatatcaataaagccgtccagaggaccctgggaacaagctttttgcttgagcagctcgtgcaatttgttgccaaattggtaaacccatgcctgatgctccagatgtttatatccttcacaaggaatacttggctcagatggcctgttgctgtaagtttgcctgctggccactgggagccaactccaattgctggccgcttcacctcctggaaccgttcactaa

SEQ ID NO: 726376 - DNA, 685 bp, Homo sapiens
  misc_feature (79)..(79): n is a, c, g, or t
  misc_feature (107)..(107): n is a, c, g, or t
  misc_feature (638)..(638): n is a, c, g, or t
ggcagtgaatcgaactcgtgtacccaccactcctatagatcagtcaccactcctacgacctggcacccccttggatttnagcctctaggacttgtgcaagccaaccntcatccatgtctgatagcattcacatccgtgcccaatagagggacctgccccagcctctgtgtcccctccacacagtggggcctcttcactggcagtggaactgcatgcctgccatactgcttaacatcatccagttaggggccttggactgtgaatgcaccatacagatccctggctgtgatcaaacaaatcacattccctcacatgtgtttcaccccataaggcagaaactaccacccatccaaccctctggccttaccccatgaaacttccctttgaccttcgacctttcctcctaccccctctcaccttgccattgatagagattatatcccaaagccctctaaccatctaatcctgcctggtgtagtcactgactcctggcccctttgatccctgttctaattccttgaatctgtaatactgaccttctaacctccctctccccttacatattaaaaccgtgattccttaaagctttgacacttaccacctcccatgcctcctgactatttcctccccatcatccncaaccccaaaccttgctcttccagtatgagatgttctgacaactgcc

SEQ ID NO: 726377 - DNA, 721 bp, Homo sapiens
ggcggatagcggaccctagagagccctgagcaatgccccatccgccgtcctgcctgtgccatagttactcgatcctacaccccgggtaggagccgctaaggctgcctgcaagccggcaccctagatcaccatctaccgacaaaccatgatcagcgaggccgagacccatcagccgcctcggctgacccacctgcgaacgggcttcactgtgcgtcacgagactccgagcggagtgcggaacgacggacactagcggttccgccgagtgaccaggagagctgtcgttgccgccagtggcctgtcgttcggcgtgctcactgccgtgcggggtccttgctggttcctccgaccaagagaggaacctgggaggaaacacgataagaggtagagatatccacgtgtcagtggatccggcgattagtggtactgccatacatcttgagacgttttacctcgcaacttgagtaattttgtaacagaaaccaccgagagatagccatattaccatggaacttgacctgcagtgacatgatagccggtcccttcgaaccgtcctgagcaatgccaaaagaagcatgcctgagcgagtaaggtccggcacgaacgtaatggcaaatatctcttctatacagaaagactgaataatccgatcagtagtgctcggtaagaaagagcccattagaataggagaagtgtaagagcacctaggacgaaagaaacc

SEQ ID NO: 726378 - DNA, 161 bp, Homo sapiens
  misc_feature (1)..(1): n is a, c, g, or t
ngagagctgtacacaagcaactccaccttttattaacaaggtttgaatttgatttctatcacttgcatttaaaagagccatacctgagttccctagtggcctagatggttaaggatctggcattgtcactgctgtagtgtgggttcaatccctagtcaggg

SEQ ID NO: 726379 - DNA, 114 bp, Homo sapiens
ttgtagccttacggaaggcctgatctgtgtgcgtcttatcaccaatcagttcagaccgggttgatttgtacttgggaactgtaccttggctggttttgtttattaaaagagaaa

SEQ ID NO: 726380 - DNA, 541 bp, Homo sapiens
ttaccgtttgtaaagctatgctttcatacaaaatactacattcaattatttttaaagttgataatgcacaaattgaacactgttacagcaatcaagcacaaagttattacgaatcacacagcataagaaaactctgcaaataaacaaccccagagaaaactgtttttttttaacgtcacaacacttttaaccctgttttctacaggagagttaaattaaatcaaatcagttttctaaatgaagtctctaaagacaaaaccatcatacatatcccaacatagcttctacaactaatcacacaaaggtaataaaaaaaccaattcttatcacagaaaaacaatagcatataaaggttcttaatctataaatttaagtatttcaatcccataccacttcaaattcaaattatgttatgggagaatttactgtgttcagaaattacagattgctatttttctgtcagttatcatactgctacctttgcacattgctatttgacaaaagttaacaaactgatgaagcggtaatatctatgctgctg

SEQ ID NO: 726381 - DNA, 257 bp, Homo sapiens
ttctcgtacatgtctagggtgtagcctgagaattaggggacatccagtgaactgatagcctcctatggatggcacctacagctcctattgatagcgacatagtcggaagtgagctacaacgtattacgtgtcgtgtattacgatgtctatgtgcgtgagtttgctattacaatgccagtcgaggccacctacggtgaacagaaagatgaatcctacggctcagagcactgcagcagatcatttcatattgcttccgt

SEQ ID NO: 726382 - DNA, 153 bp, Homo sapiens
aggctaggtgggaggatgacttgagctggtgagttaacaaattagccaggagctggtttgcacactcccattatcttgctatcactgtaaccaactaatgccaaaagaacggttttgtaataaaattatagctgtatctacaacaacaaaaac

SEQ ID NO: 726383 - DNA, 566 bp, Homo sapiens
  misc_feature (15)..(15): n is a, c, g, or t
  misc_feature (28)..(28): n is a, c, g, or t
  misc_feature (62)..(62): n is a, c, g, or t
catccactggtgctnccaaggctttggncaaggtcatccccagagctgaacgggaagctcantggcatggccttccgtttcctacccccaatgtgtccgtcgtggatctgacgtgccgcctggagaaacctgcccaagtatgatgacattcaagaaggtggtgaagcaggcatctgagggcccactgaagggcatcttgggctacactgaggaccaggttgtctcctgcgacttcaacagcaactcccactcttccaccttcgatgccggggctggcattgctctcaatgacaactttgtcaagctcatttcctggtatgacaatgaatacggctacagcaacagggtggtggacctcattgcctacatggcctccaaggagtaagaaaccctggaccacccaccccagcaaggacactgagcaagagaggccctatcccaactcggcccccaacactgagcatctccctcacaatttccatcccagacccccataataacaggaggggcctagggagccctccctactctcttgaataccatcaataaagttcgctgcacccacc

SEQ ID NO: 726384 - DNA, 1697 bp, Homo sapiens
  misc_feature (3)..(3): n is a, c, g, or t
  misc_feature (135)..(135): n is a, c, g, or t
  misc_feature (210)..(210): n is a, c, g, or t
  misc_feature (378)..(378): n is a, c, g, or t
agngggggggctccgccaccacctcagctgcggaccgaggcgagatggcggccaccgagggggtcggggaggctgcgcaagggggcgagcccgggcagccggcgcaacccccgccccagccgcacccaccgtcgnccccagcagcagcacaaggaagagatggcggccgaggctggggaagccgtggcgtcccccatggacgacgggttngtgagcctggactcgccctcctatgtcctgtacagggacagagcagaatgggctgatatagatccggtgccgcagaatgatggcccaatcccgtggtccagatcatttatagtgacaaatttagagatgtttatgattacttccgagctgtcctgcagcgtgatgaangaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttggggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctacaacaacaaaaac

SEQ ID NO: 726385 - DNA, 274 bp, Homo sapiens
ggggggggggcccccccccccccccttttttttttgggggggcccccgcccccccctttttggggggggggggggccccgcccccccctttttttgggggggcccccagggttttttaaaacccccccccaacggggggggcccccctttttttccccccccccccccccccccccggggcccaaaatgggggggggggttttttttttgttttttttttttttccggggggcccaaattttttttttgggggttaaaaagggggttttcccca

SEQ ID NO: 726386 - DNA, 1539 bp, Homo sapiens
  misc_feature (220)..(220): n is a, c, g, or t
tccagcgagcccaatgacgcgcgtgtgcgcgcttccggccccggcgcgccaggccgaagttcccgtggcgccgtgtgggtcggtgcatggcgctgggcccgggcggctgccgggacgtcgccgcttcccagggcggcgccggcgcgagaccgcggggacgcgaagcagagagttagagatgtttatgattacttccgagctgtcctgcagcgtgatgaangaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttggggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctacaacaacaaaaac

SEQ ID NO: 726387 - DNA, 118 bp, Homo sapiens
  misc_feature (25)..(25): n is a, c, g, or t
caacccttttgtgatgacagcttgncgggtacggttgaatgtcaatgtcaatttgtcaatcatctcagaagcattcttgctggcattgtccatggctgtcatcctagggtttcgatga

SEQ ID NO: 726388 - DNA, 1612 bp, Homo sapiens
  misc_feature (3)..(3): n is a, c, g, or t
  misc_feature (135)..(135): n is a, c, g, or t
  misc_feature (210)..(210): n is a, c, g, or t
  misc_feature (293)..(293): n is a, c, g, or t
agngggggggctccgccaccacctcagctgcggaccgaggcgagatggcggccaccgagggggtcggggaggctgcgcaagggggcgagcccgggcagccggcgcaacccccgccccagccgcacccaccgtcgnccccagcagcagcacaaggaagagatggcggccgaggctggggaagccgtggcgtcccccatggacgacgggttngtgagcctggactcgccctcctatgtcctgtacagttagagatgtttatgattacttccgagctgtcctgcagcgtgatgaangaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttggggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctacaacaacaaaaac

SEQ ID NO: 726389 - DNA, 474 bp, Homo sapiens
agtgtccacagcgggcggtcggtctgcgcctattctcggagtctggggtgcggacgacgcttcgactaaagatgtttaggccacagccctgtcattatataaatccagaaacaccgggctatgttggatttgcaaacctccccaatcaagttcaccgaaaatcagtgaaacaaggttttgcgttcacagctgatggtggtcggtgactcaggtctaagaaacctcgatctctcatagacagcctattcctaactgatctgtacccagacagcgtcgtacctggagcagtacaaaccattgacagaactgtccagattgaggcttcagccgttgaaattgaagagcgaggggtcaagctacgcctgacagtggtagatacccctggctatggtgatgctatcaactgccgagattgtttagagacaattatctcctatattgatgagcaatttcacaggtacctgcgtgatgaga

SEQ ID NO: 726390 - DNA, 301 bp, Homo sapiens
tgagatggagtcttgctctgtcgcccaggctggcgtgcagtggcgcgatctcagctcactgaggcctctgcctcctggtttccagtgattctcctgtctcaccctaagtagtatttaaggctgcagtgagccatgattgcgccactgcattccagcctgggcaacagggagggagaccctatctcaacacatacatacacagacacacatctataaaatctggcatgcctaagattcatgagtgaaatacactggtatagcagtccccatccagaaactgagcatcaccaggaccctggag

SEQ ID NO: 726391 - DNA, 442 bp, Homo sapiens
tgtcggtaggactcgttctacaaaaaatataaaatagcggcgtgtgcatgtctgtgtctcagctactcaggaggctgggtggaggacacttgtccggagtgaggctgcggagctatgtgtgcatgacccagctggtgcagagtgagacctgtctcaaaataaactaagtattgagggtgactttacacaatagaacaccacaccttgtctcatgccgtttcttaactccctaatagctccctagtccacacagttggctcaagccagattctgcaagtcatccttgataccgtcctcttcctcattcccttcaatctgtcatcaagacttgtcagttctacttctgaaacacttcttgaattcatctatttatcttcatctccatcactaccacctgagtcctggccaccatcttctcacctctggacttttggcacaggtt

SEQ ID NO: 726392 - DNA, 1304 bp, Homo sapiens
ttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaatgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgagatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctacaacaacaaaaac

SEQ ID NO: 726393 - DNA, 214 bp, Homo sapiens
aattgtcatataggctggccgtggtggctcacacacataatcttagcactttgggaagttgagtcaggagggccacttgagcccaggagtttgaaaccagactgggcaacacagtgagaccccacctctacaaaatattttaaaattagccaggcgtggtggtgcatgcttgtagtcccagctactcaggaggctgaggtgggaggataggagg

SEQ ID NO: 726394 - DNA, 2072 bp, Homo sapiens
  misc_feature (3)..(3): n is a, c, g, or t
  misc_feature (135)..(135): n is a, c, g, or t
  misc_feature (210)..(210): n is a, c, g, or t
  misc_feature (378)..(378): n is a, c, g, or t
agngggggggctccgccaccacctcagctgcggaccgaggcgagatggcggccaccgagggggtcggggaggctgcgcaagggggcgagcccgggcagccggcgcaacccccgccccagccgcacccaccgtcgnccccagcagcagcacaaggaagagatggcggccgaggctggggaagccgtggcgtcccccatggacgacgggttngtgagcctggactcgccctcctatgtcctgtacagggacagagcagaatgggctgatatagatccggtgccgcagaatgatggcccaatcccgtggtccagatcatttatagtgacaaatttagagatgtttatgattacttccgagctgtcctgcagcgtgatgaangaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttggggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaaaaaataaaaaacaaaaaaaaaaaaaactgttgttgcgcccccccgcggcccccgagaagaagagctttttgagaaaccctatgagatgtgggggcgccgaggggacccccacaggaggaataagagagaacaagtggggcaaaaaagagcggaaatccactaaggaaagaactccggggagcacgaagcaacaagaggagaggaggaaatgaatgacgcacccaacaagtacaaacacaaacacgcccccgcgggcacaaacacgcacggagacgacgttatacgtgagaaccacgaagctcccaaagagagtgaggacataacgcgaagacacaatacgaacgggggctgtctattcaagcaagggaactaccaagagacagaacggagataactacaaatatagcccccccccgcgggtc

SEQ ID NO: 726395 - DNA, 1691 bp, Homo sapiens
  misc_feature (3)..(3): n is a, c, g, or t
  misc_feature (135)..(135): n is a, c, g, or t
  misc_feature (210)..(210): n is a, c, g, or t
  misc_feature (378)..(378): n is a, c, g, or t
agngggggggctccgccaccacctcagctgcggaccgaggcgagatggcggccaccgagggggtcggggaggctgcgcaagggggcgagcccgggcagccggcgcaacccccgccccagccgcacccaccgtcgnccccagcagcagcacaaggaagagatggcggccgaggctggggaagccgtggcgtcccccatggacgacgggttngtgagcctggactcgccctcctatgtcctgtacagggacagagcagaatgggctgatatagatccggtgccgcagaatgatggcccaatcccgtggtccagatcatttatagtgacaaatttagagatgtttatgattacttccgagctgtcctgcagcgtgatgaangaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttggggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcaccctctccttccatcagagcatccatctaagccctaatgtgcgcctctgtatttgttttaaatctgtttatgtcctcaa

SEQ ID NO: 726396 - DNA, 580 bp, Homo sapiens
  misc_feature (25)..(25): n is a, c, g, or t
  misc_feature (65)..(65): n is a, c, g, or t
  misc_feature (78)..(78): n is a, c, g, or t
  misc_feature (81)..(82): n is a, c, g, or t
  misc_feature (105)..(106): n is a, c, g, or t
  misc_feature (128)..(128): n is a, c, g, or t
  misc_feature (158)..(158): n is a, c, g, or t
  misc_feature (167)..(167): n is a, c, g, or t
  misc_feature (171)..(171): n is a, c, g, or t
  misc_feature (184)..(184): n is a, c, g, or t
  misc_feature (236)..(236): n is a, c, g, or t
  misc_feature (239)..(239): n is a, c, g, or t
  misc_feature (246)..(246): n is a, c, g, or t
  misc_feature (249)..(249): n is a, c, g, or t
  misc_feature (260)..(261): n is a, c, g, or t
  misc_feature (271)..(271): n is a, c, g, or t
  misc_feature (275)..(275): n is a, c, g, or t
  misc_feature (281)..(281): n is a, c, g, or t
  misc_feature (291)..(291): n is a, c, g, or t
  misc_feature (294)..(294): n is a, c, g, or t
  misc_feature (302)..(302): n is a, c, g, or t
  misc_feature (308)..(308): n is a, c, g, or t
  misc_feature (341)..(342): n is a, c, g, or t
  misc_feature (356)..(356): n is a, c, g, or t
  misc_feature (358)..(358): n is a, c, g, or t
  misc_feature (378)..(378): n is a, c, g, or t
  misc_feature (390)..(390): n is a, c, g, or t
  misc_feature (395)..(395): n is a, c, g, or t
  misc_feature (432)..(432): n is a, c, g, or t
  misc_feature (473)..(474): n is a, c, g, or t
  misc_feature (480)..(480): n is a, c, g, or t
  misc_feature (488)..(488): n is a, c, g, or t
  misc_feature (491)..(492): n is a, c, g, or t
  misc_feature (500)..(500): n is a, c, g, or t
  misc_feature (512)..(512): n is a, c, g, or t
  misc_feature (516)..(516): n is a, c, g, or t
  misc_feature (568)..(568): n is a, c, g, or t
ttgttactaatctgtaaacaagtantgttcaagtagtatttagcactttttaagctattaagaanttgaagcatgcancanntcctgtggcgacccagcttttgnntcttgccttagtgtctaagtcngttaaaggcacttcatatgtgttgtttctngcattaacnattnttggtttaaaaanaaaaagttaatatagatgactggggtgagctttttttgttgtttctttttgntcnttcgttnttnttgtttatttnnttttgttttngtgntttttntgatgtgganttngggtgggngttgtngcgggtggctgtggtcctggcgctttgggaggnnaggacgggcggatnanggggtcaggagattgggacnattctggttaanatggnggaaccccgtttgggctaggatttggttggaatttgncgggggtggtggtgggcgcctgtagtcccagctagtcgggnngctgangcaggagnatnncgtgaacntgggaggcggancttncagtgagccgagatcgcaccactgcactccggccttggtgacagagcgagantccgtctcaaaa

SEQ ID NO: 726397 - DNA, 316 bp, Homo sapiens
  misc_feature (90)..(90): n is a, c, g, or t
  misc_feature (130)..(130): n is a, c, g, or t
ccccaggcccttcaggaaatggggccttgccttgcagccacatggccccctcccagttggggaagccaggtgagcttttccccttggggntggggctttgcccctcccaaaccaggcccttgtttccctngaaaggggccctggtgttttcccccccgcggtcccccccccccgaaatgccccgggggccctgggccctgccccgtccatgggcctttgcggggcggggcctttctggttttgttccctgcgggaccccaatgcccccccccctccctgccccatacggggggcccataaacccttgtagggccga

SEQ ID NO: 726398 - DNA, 1031 bp, Homo sapiens
tatgtgtctggtgctattatccggctctccgctttttctcgtgtccctagtttttgttttgtctttgtctgcccgagcctctctgtttgtttttgttgtgtcgcccttatctgattccgcgcactgcctcttcttcgcctgtcgtcgtgtcctggcgtgtggggcctagtcgttctgtgcctgtacgtccttgtgtcggttgtgtcaatcatcttttcacgtgtcttggcttagtgtttcttctttatggatctctagttacgtccagtttccttgtctcttgcaggtttagccgctttgctgtattgttgtgcatgtgatctcagcttcacgacttcacccttacaacgggtgctgaaggagtgctcccttcctctttggtggatacgtctttttgtgttattcctgtcattctgactttttttaacgtgtttggctcatcttccagcttatgttatgaatgtgacatatattattttctaccttggagcttgaagagggcagaattccgcagctctctgtcattgtgatgctgtagcatgtctgccctctgactggtacatcattgccattaactttcttctgggcatcacggcaaatgtcacgatgcccagactgtggagcaaggcaaccttggagtcagtccactctataaaatatggtaacacccattttacgaatttatagttttgtccgttatagacaacttcagtggttatattatataagttgtgttacttcgtcctagtaattaaattcgatcgtacaagatttgaaaatgtgttttgtttctactattcagaaactgcgcaactagggtaaggttggtatgaatgaatgtctttccttgtttctatgtacatagttcaactctttcgtttgttacatgtagacaatatccatgatatcagtggctgtgactcctctgtaccgctactggatgaataacctatcgcgtgggggtggcgggtgggtgcgggttgtgggtgggggtgtcgtggtgcggggggtgttgtggtcgtgtgggttgt

SEQ ID NO: 726399 - DNA, 1156 bp, Homo sapiens
  misc_feature (3)..(3): n is a, c, g, or t
  misc_feature (135)..(135): n is a, c, g, or t
  misc_feature (210)..(210): n is a, c, g, or t
  misc_feature (378)..(378): n is a, c, g, or t
agngggggggctccgccaccacctcagctgcggaccgaggcgagatggcggccaccgagggggtcggggaggctgcgcaagggggcgagcccgggcagccggcgcaacccccgccccagccgcacccaccgtcgnccccagcagcagcacaaggaagagatggcggccgaggctggggaagccgtggcgtcccccatggacgacgggttngtgagcctggactcgccctcctatgtcctgtacagggacagagcagaatgggctgatatagatccggtgccgcagaatgatggcccaatcccgtggtccagatcatttatagtgacaaatttagagatgtttatgattacttccgagctgtcctgcagcgtgatgaangaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttggggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcgttatgtgttaaatccaggagttgatgtacagccaagtcatagtgccgcccgacctgatgagcttttgagtgaggatatgtacggcgacaggataggatatcattatgacaagaaggtggacatgattaagtcaggcagttatgagaatatgagtgatactattgttcaagacaacaacactatgagtgagggagaattggacagaccacaggtcgatccgggtagggcgaaca

SEQ ID NO: 726400 - DNA, 425 bp, Homo sapiens
  misc_feature (33)..(33): n is a, c, g, or t
  misc_feature (398)..(398): n is a, c, g, or t
tatttttcccgtaagaagatgggggtttccctnaatgttgggcccaggctgggccttaaaaaccctggcctcaaggtgatcccatcccagtctcggcctccccagaatgctgggattaacaagacatggagccacccatgccctggctttttatttattattattatttttattttttatttttttattttttttgagacggagtcacgctctgtcgcccaggctggagtgcagtggcgtgatctcggctcactgcaagctctgcctcctgggttcgtgccattctcctacctcagcctcctgagtagctgggactacaggtgcccaccaccacgccaggctaatttttttaattttttttatttatttttatttatttatttatttttagtagattnttgggttcaccgtgttagccaggatgg

SEQ ID NO: 726401 - DNA, 182 bp, Homo sapiens
gagctggaccggcactctagtcaggaactgttgaaatgcccttggctatctaagaaatctaaatcaggctaggcactaccatgcctgtaatctcagcactttgggagggcaaggtgagaggactgcttgagctcaggaattcaagaccagcctaggcaacatagggagaatctgtctctact

SEQ ID NO: 726402 - DNA, 911 bp, Homo sapiens
  misc_feature (3)..(3): n is a, c, g, or t
  misc_feature (135)..(135): n is a, c, g, or t
  misc_feature (210)..(210): n is a, c, g, or t
  misc_feature (378)..(378): n is a, c, g, or t
agngggggggctccgccaccacctcagctgcggaccgaggcgagatggcggccaccgagggggtcggggaggctgcgcaagggggcgagcccgggcagccggcgcaacccccgccccagccgcacccaccgtcgnccccagcagcagcacaaggaagagatggcggccgaggctggggaagccgtggcgtcccccatggacgacgggttngtgagcctggactcgccctcctatgtcctgtacagggacagagcagaatgggctgatatagatccggtgccgcagaatgatggcccaatcccgtggtccagatcatttatagtgacaaatttagagatgtttatgattacttccgagctgtcctgcagcgtgatgaangaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttggggataatgagctgcagtatgtggaccaacttctgaaagaggatgtgagaaataactctgtctggaaccaaagatacttcgttatttctaacaccactggctacaatgatcgtgctgtattggagagagaagtccatacactctagcatgtcttcatagatatccacagaaagcaattaggttggggaactatgacttggttgtaatcaagtagtatacg

SEQ ID NO: 726403 - DNA, 563 bp, Homo sapiens
  misc_feature (3)..(3): n is a, c, g, or t
  misc_feature (135)..(135): n is a, c, g, or t
  misc_feature (210)..(210): n is a, c, g, or t
  misc_feature (293)..(293): n is a, c, g, or t
agngggggggctccgccaccacctcagctgcggaccgaggcgagatggcggccaccgagggggtcggggaggctgcgcaagggggcgagcccgggcagccggcgcaacccccgccccagccgcacccaccgtcgnccccagcagcagcacaaggaagagatggcggccgaggctggggaagccgtggcgtcccccatggacgacgggttngtgagcctggactcgccctcctatgtcctgtacagttagagatgtttatgattacttccgagctgtcctgcagcgtgatgaangaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcagagaaatgatgtttgctgtacatgcatgggcttagacaccatttagggggatc

SEQ ID NO: 726404 - DNA, 285 bp, Homo sapiens
taggctggagttgcagtagctctctcaaaatgaatgagatgaatgaaagaaggagagggaagggaagctcctctctcttcgtattcccagtctagcacccgcaaaaataagttatccataaacccccaacgtatattactgttctgttaactagttctgaacagaatgtacagtgtagggtgggcatggtgtgtcacgcctggtaatcctagcacatcgggaccgcagccgtgatcgcatcacaacccggccaggttttcttttccttttttttttttttttttt

SEQ ID NO: 726405 - DNA, 214 bp, Homo sapiens
gatctgaacatttaaaacctgcgcataatcagtcacatcgagtgccttgacactgactttaatcgtcggactatcggctaacaggtttgctttgagttgttctaggcgttcggtgcggcgcgcacaaattgccaggttatagcccatgcgagcaaaatgggtcgccatgcctgcccccaaccccgagcttgcgccagtaatcaaaatggtttta

SEQ ID NO: 726406 - DNA, 323 bp, Homo sapiens
tggtgcaccaactaggaagggtccccaggattggggagagccccaagattgagaacaataatgaacaattagtgtatgaagcagttgttagagacagcgtaatcacaaagcaaactgcgggcacaatgacctcattccacacgtagcagccttcagcaggaccctataaaactttcctccagcccttgcctcttggcaggtagccccttctctgctgagctgcccactgcaacatattttcacaatgtgctctaataaagtatgcccttctttacctacactatctggtggatggctttaccacctgcaaaactgaccctagg

SEQ ID NO: 726407 - DNA, 168 bp, Homo sapiens
aacagagaaaaagcctgagaacttgacattgttgagccatggcaccaaaacaaaatttgcttctcaaactttaataagcataaagaatcacctggagaatcttgttaaagtgcagattttgattcaataggtctgaggtggggcctgaaaggctgtagttccaataag

SEQ ID NO: 726408 - DNA, 493 bp, Homo sapiens
tcccccgtgcaaaaaaaacaacacagtgtaggggccccccccctcccgtgccccttcaggccccgggcagggaaggagggggcccttttttcccttaaccccctccttgagggggtgaaaacaaaaggggtttttgatgtttttccacctttccaaaaccctcgggttcaaaggccccccctgggtcccaccctgggacaggtttagttttttttccaaggggggccgggggaaatttatgccttttccaaattttcccccctccagttaacggcccccagggggcctgggcccggagggttgcccttaaaaatttggaaaaatttggtttggttaaaaaccccccaatgggggtaaattttttaaccggttttaaaaatggggccaagggctttttttcccctttggggggaaatttttatggtaaaggggttgccccgaaaggcccttttcccaaggttttttgggggatttaaaaggggggtgtttggga

SEQ ID NO: 726409 - DNA, 775 bp, Homo sapiens
tagcacaatagtgggaagatttataggtagaggcgacgaacctaccgagcctggtgatagcgtggttgtccaggatagaatcttagtgtcaactttaaagtttgcccgacagaaccgctcgtaaatcccgctgtaaagtttaactgtttagtccaacagaggaacagctctttggacacgtaggagaaaaacctgtagagagagtaagaaaatttaagacccatagtaggcctaaaagcagcctaccaatgaagaaagcgttcaagctcgaacacccactacctaaaaaatcccaaaacatataagctgaactcctcaacacccaattggaccaatctatcaccctagtagaagaactaagtgttaggtataagtaacatgaaaacattctcctccgcataagcctgcgtcgagattagaacacactgaactgacaattaacagcccaaatatctacagatcaaccaacaagtcattattacccgtcactgtcaacgcaacgacaggcatgctcataaggaaaggttaagaaagaagtatcaaggaactcggctagatcttaccccgcctgtgtaccaaaaacatcactctagcatcaccagtattagaggcaccgccgtgcccaggtgacacattgttttcacggcgcgggaccccttaccgtgcaaaggtagcatatcaacttgtccttaataaggggaccggttgaatgctcacgagggtcaggcggctcttactttaaccagtggaattggccggccgtgaaaagggggca

SEQ ID NO: 726410 - DNA, 1129 bp, Homo sapiens
ttccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatacacactatttcaaggttgcaatggacactccccttccgttagacaccaggacctctatctccattggacagccgacctggaacacacagacgaggttggaaagagtggacaaacccatttccagggacgtcagaagccaaaacattaaaggagatgcatccgtaagaaagaacaagattcctttaccacctcctcggcctctcataacacttccgaagaagtaccaacccttgccccctgagccggagagcagcaggccacctttatctcagagacacacctttccagaagtccagggaatgcccagtcagataagcttaagggacttaagtgaggtccttgaagcagaaaaagttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatccgcttcctggagaggaatcagcagtttgccctggggacaggactcagaggagatgagaagtttgattcagtagaagacatcatcgaacactacaagaatt

SEQ ID NO: 726411 - DNA, 798 bp, Homo sapiens
gggaggcgacatggagacaggtgcggccgagctgtatgaccatggccctttggggcatcctgtcagcacgtgggtcacaggtccaggatttcctgtcgcgttctctgtggcttcctctatcggaagacagacttcgtatcgcttgctgcgccacccatcggagcgcatgggcttcccggccggggccgcgcaggccttggtgctgcaggtattcaaaaccttggaccacatggcccgtcaggatgatgagaatgagaaggcaggaacttgaagagaacagatcagaatgacacaggaagaggaagaggccgcgactgtgtcagctgctgcagctgagaaggagccggtcccagttccaggccatggacatagcagattgacgtccgaccagtagaattgggatgggcatcaggaagtagagaaagtgcagcctccaggccctgtgaaggaaatggccctatggttcacaggaggctagaagctccaggagcagttgctggatgctgctgaagtccctagggaaccacgcaattcttcccaggattcaggagcggttccagaaaattcccgacgagttacgatggtgctgtccgagagaactacagctggtcacaggactatactgacctggaggtcagggtgccagtacccaagcacgtggtgaagggacaacgcaggtctcagtgggccttagcagcagctccattacgtgtggacatgactggaggaagatgggggagcgcggtctcatggaagggcacgctcaccgacaaggatcaacactgagagttctctctg

SEQ ID NO: 726412 - DNA, 163 bp, Homo sapiens
atatatcatacaaagtgaaggaagtcagaaggagaaagacaaataccatatgatatcacttatatatggaagtctaaaatatgatacacacgaacttatctacgaaaaagaaacagacacacacagagaatcaacctgtggctgggtggtggcgggagagccg

SEQ ID NO: 726413 - DNA, 444 bp, Homo sapiens
gttcgatcggctcggacccctccataatgtgtgcccatggctggaatgcagcggcatgatcacagctcactgcaaacttcaactgccaggctcaggcaaccctcccacctcagcctcttgaatagctgggactgcaggctcataccaccacaaccagctaacttgtatttttggtagagacaaggtttcgccatgttgctcaggctagtctcgaactcctggactcaagtgatccacctgtcttggctgcctacattgctgggattacaggcatgagccaccatgcccagccaaatttttttttttttttaagggaagggatcttgctatgttgcccaggctggtctaaaactcctaagctcaagcaatctgcccacctaagcctctgaaagtgctgggattacaggcatgagccaccatgtccagcacactttaatattcact

SEQ ID NO: 726414 - DNA, 629 bp, Homo sapiens
  misc_feature (234)..(234): n is a, c, g, or t
cgtcgacgaaagaacaagaaagtttcattagagtaagcttattacaggcttaaccatctgacttcctgacagtcgcttaaccatctgacttcctgaatgtcacacaccgtagaggaagatgaatttttatctggtgctgcatatcgaaaaaaggtccgacttgtccacagacactgggctcacttgctcccagccatttactctcacttgcagttgatgaatccggaggtcatnggtgtgtctgtcaggcagaacaaagaaaaagatattaggcacaatctccagaagggatgaaaagtagaagcaaagacacaaatctgatttagtacatatgatgtaaaaacccagttagctaaaccttttggagattacctaatgcaagggaaatcaggagcacagtttaactgggttttacacttacaacacaaactgcaagatctgtaaaggcttgactgagtaagagtggcatttatcctccattgtacaaaccacgcaaaatctaaacacgagccaaggtctttcccccaccaatcctcaccccaagctatattatgatgtcactggggtggtaaaaatgcagtagcgatttaatcatattaccatactcttgggaatgcgttaaaaattat

SEQ ID NO: 726415 - DNA, 255 bp, Homo sapiens
tccgcagggtgactctaccaggatccccactctcgcacttccgtattgatgccccagggacacagagactttatcatgtacgtgattactggcacatctcaggctgcctgtgctgtccggattgttgctgctggtgttggttactttgaggctggtctctccatgaatgggcagacccccagagcagtgcccttctggcgttctccccgcggtgtgagaccactcattgtcagtgttaactcaaatggattccac

SEQ ID NO: 726416 - DNA, 664 bp, Homo sapiens
  misc_feature (313)..(313): n is a, c, g, or t
  misc_feature (361)..(361): n is a, c, g, or t
ctactgtcttagtcttttacacagaagatgttaaaggtggaaatagctatatgcctgttgtgtatcaccactctaacgcttagcctgcattgtttcgagcataatttgcttatttacaattgctctatctcagacttcccaccaatactttgatactgtgtactttgtcactactttgatgccatcattgatattgctcactggcggatgagaatatctgcaagttgtttataactttttaatcataaccgccttgacgtcctgttacatatgtctttaacaggctctgtgcccaagtagtctttatttcggntaccctaaacatatctaaactatccgaccaagactgtgtaagttggcnttttctttttcctccccctgatcattcatttagcatgttatatttcattcttaatgttttgggtggtgcctcttatactatgttgtattcctagacaaggaaatgtatatcaaaatatgttagatgatggatgttgttatctccttgatgatagcaccgtcttatactgctttagcagaatcaggaaaaagtaaactgcattttacatagtggttttaaatattgatcgattgatattctaaacctggtttcctatataaagttgtaagttcaagataaagagagcagattctttattaaaaa

SEQ ID NO: 726417 - DNA, 1651 bp, Homo sapiens
  misc_feature (371)..(371): n is a, c, g, or t
  misc_feature (375)..(375): n is a, c, g, or t
gagtgaactaggccttagagaaggaacattgacaagcaaaggaatccatcggactgacagtgaagattgtcctcttggaaggtctgactgagtggcatcaccacaaaagcagtgagagactcgtcgtcatgttcgtatgctgattgggcaagacatacgctatgaaagatgagctgcatgctctagtgggctcgttctcgacccatagatcttgcttcggactcgatctgcagccaagactcgctgaggcactacatgtggtcagaacaaacgcggacgccagcattgtctggagatagcatggacggaaggcctggtatctctgagctggtagagcttcgacagggttgtgtcaagtactgcgtaggcgngcgntgagtaccctaggaacgtagagtgattccgcacgattcgacggaatgggtagctaccctgtggtaggcaagtatacctgcgtgcgtagacagatggtccacacgcattttacgaggcatgccaaaggaagccggtgtccttccaaggggtctgcatggcaagggtacgaagtccgaataggaaactaccgagtcaagtgtggtaccccatgcgcatgtgcagagtgggaacgaacactcatcttgtatgccctggttgtacatgtacagtaccctcgtatgcatgataccaacttgtagccataggtcatggtctgcatgaaagtcattcagttcctatgtatgtctccccagagttctgaatgcctatcatcgaagggcatcatgtgctccggcgcgattcatgctggggcattctcctttgttaagttccttccccggttcctggtgtatgtagcggttgctcgcccccgtcaaagatacctcacgcgcatgagtagtcgctggtcccttagtatgctgtatttgccctattccatgtctttagacgcgttgcctagcgagacttttccagcggcactccccggttggtaataattctccatgcactaaggtacgggaggacaagtgggcggaaagtccatttccaccctcaattgttccattatatatcgtaaagacacgtgggcacattcattggctacaccctaatgtagtaccgccaatggtaagctcttgcaacaaaattgtgtcgggggacaggctttgccatggtgtggcccatgttttgcttgtgagtaccccttcacacattacaggttctcagaaaggaagcgatggaaaccacatgggtgttcccaaagtggcttatcgccacccaatagttgtgagcccccgggggagcccctaatacccaaggagaggccccacatatggggagccccccaagcgaaaagactcctccaatgtgggaacccctacggcgggggaagaacaacacaggaggccacaaaaaagcaacaacaggagcgtggacacacctaagaaaacccacagaggtgcgcacacaaacaacagcacgggcaccgactgtgaacacacactggtgattacaaaatcgaagacgagcggtaacacacaacgacacgacaatacacagacgtaaagactacgcaactagagacacaaacatgggaggaggggcacgcacaaagacgacaaaccagcaagactgggcttgtgtcacaacacaacaacagaccaggagattgagctac

SEQ ID NO: 726418 - DNA, 270 bp, Homo sapiens
taaccagcttatttttctgaggattttacccctcagcaattgatgtgattcaagactgcactaaagtactctttagcaaggtactctacacaaacaacagccacccctggttaaaggataaactaaggacattataaactgttttactaatccctggaactgtgtttcaatgtttagcacctgtaacaggagagtcaaagtggcaaatagggcagtttggctaccttgcaaactcatgtgctgacctagggcaccagggcaatgggctaa

SEQ ID NO: 726419 - DNA, 378 bp, Homo sapiens
  misc_feature (371)..(371): n is a, c, g, or t
tccccaccgccaaagccgctccccacccggatgctaacacccaggaaggccttcagaacctgctccaaggcgtcggggcttgcggaaaccgagaacttccggcagactcacaccttgcccccgggtcttgctttattgaatgggcttttgttgccacgcgaacaggaaacccgggaaggaagacctgcggttccgtaaaaggcgtccaggcctccaggccacggcgacaggctccggggaacatggggctttccctgtcaactcccaaggagtgtgggcctcaacgcattggcaggggacggccgtgtgccctctccagaccccacccccagatgcatttattagaaataataaagttctttcttagctanaaaaaaa

SEQ ID NO: 726420 - DNA, 780 bp, Homo sapiens
gacactacaggaagtcgtgctacccccgcggagtgtcgtgtgttctggcattcattccggcaccaccactgtctgaaggtttcctttaaggatcacgctgacgtcggatccacggctgccgtacaaagtatctcagatgttcctgaaagtacaccattatcacagcagtcattaaagtttgcaagcagaagaatttaaagttcctgcgtgccaacaagatgcaattatttaccaatgagtggaataggaaattaaatcctgcacagactgctggaacatgttttctaaaacatggttcagaactgcggatgtattcctagagatcgtgtgggacgttgttaatatctgctacttggaacatacgattgcctttcagaatagatattggtatatcttggtgtagtaaaattgacatcaggcgtttacacatactatgacataacaccaggagtcaatgattaatgaaaggtgactcatctgtcccttttggtgtccatactcttcctatgacagagggactgcgtatgaattacggctactactgtctacggaagatcatagtctcttgatgctatctccataacacaaacgaggtacgttcgcttgggggtcacatggatttagcctcactgtctaacgtgggaagccttctggctcaatcttgtcttttcagacgctatatctgggtcaccttcacactgttctctgtaattcgctatatttccctcctgctcattgcaacttctactcgacttatggccccggatgggacatgctcgc

SEQ ID NO: 726421 - DNA, 117 bp, Homo sapiens
gtgatgatgctgcacgtcgggtgagacacgtcagagcgtattcctgtgcccctcatcctgccagacctgcggcgagagagaggccgtccagcagatggtcggatgcccatgcagtac

SEQ ID NO: 726422 - DNA, 998 bp, Homo sapiens
gagcgggtgcgtgggcgcggggcctgtgccatgctgcagctaaggcccgcgttgacagcctgggtgaaggggagcggggcagaggagtgccttgggctgttttcggcggcgggtgggggctgaggggctggctgggtcagagtccctggtgtccagggccggggctcttgactctgctgtgttgtgtgttcccccgtaccccgctatgcgcagtgtgtgtgtccttgtccgtcgctcgatgtagtgcctgtccatggcatgtgctgcactggtgtcccgtgagaaaggttgttcacttcaggcgatgaactacatgtcgatgtggcatcactgtctgccatggttcctagatccaacgttctcctgcgagatgcttgtgagacactcggagttgactatgtgctagcagattttgcaagaagaacagcttctgacacgtctaagataaaccgtttaatgccaagaacgcgcagagacagctccggctgtgcccagttccatatcgtcgaaacgtgttgctctggcgtctgtcttaagcagctagtatacgcaggtcttccttatgcgatgtgaagactcagttatgacgaagggttcctgagagacaatgtctccagaatacgattcacagagcgagaactgagcacagagtctagtgctaacactaagtgccttccttccttgacagaaccgctaattgaggcgaaggagcctgcggagttagttgacacagcttaccgatttcatgcacagaacatgacgtgcatgatgcaacgtggacaggaatacaacgcgaacgaaattcataagagtacccacgttcctagctcggtgcccgctccattggtatccacatgggcctgatcgcgaggaggttgtccgcttaacctcgcttcttccaagaagcattcattcgcttttctaatactgcatgcccaagaagccgacgtgttgccagtttaactccaagggaactctactttctaaaaaattccacg

SEQ ID NO: 726423 - DNA, 673 bp, Homo sapiens
  misc_feature (43)..(43): n is a, c, g, or t
  misc_feature (67)..(67): n is a, c, g, or t
  misc_feature (83)..(83): n is a, c, g, or t
  misc_feature (98)..(98): n is a, c, g, or t
  misc_feature (112)..(112): n is a, c, g, or t
  misc_feature (157)..(157): n is a, c, g, or t
  misc_feature (175)..(175): n is a, c, g, or t
  misc_feature (197)..(197): n is a, c, g, or t
  misc_feature (206)..(206): n is a, c, g, or t
  misc_feature (216)..(216): n is a, c, g, or t
  misc_feature (221)..(221): n is a, c, g, or t
  misc_feature (223)..(223): n is a, c, g, or t
  misc_feature (232)..(232): n is a, c, g, or t
  misc_feature (242)..(242): n is a, c, g, or t
  misc_feature (259)..(259): n is a, c, g, or t
  misc_feature (275)..(275): n is a, c, g, or t
  misc_feature (299)..(299): n is a, c, g, or t
  misc_feature (324)..(324): n is a, c, g, or t
  misc_feature (328)..(328): n is a, c, g, or t
  misc_feature (346)..(347): n is a, c, g, or t
  misc_feature (349)..(349): n is a, c, g, or t
  misc_feature (372)..(373): n is a, c, g, or t
  misc_feature (376)..(376): n is a, c, g, or t
  misc_feature (383)..(383): n is a, c, g, or t
  misc_feature (387)..(387): n is a, c, g, or t
  misc_feature (391)..(391): n is a, c, g, or t
  misc_feature (414)..(415): n is a, c, g, or t
  misc_feature (425)..(425): n is a, c, g, or t
  misc_feature (433)..(433): n is a, c, g, or t
  misc_feature (469)..(469): n is a, c, g, or t
  misc_feature (476)..(476): n is a, c, g, or t
  misc_feature (481)..(481): n is a, c, g, or t
  misc_feature (537)..(537): n is a, c, g, or t
  misc_feature (541)..(541): n is a, c, g, or t
  misc_feature (668)..(668): n is a, c, g, or t
caacaaacaaactacacggtaagtattcggtgtaatactttantttctattgtattaaacgaaagcnaggaaaataccaagtnatttaaaggcaaatntttactccttaaanaaaaaatacaaactgtggtatttttaagaaatcgttatattttanataatataaacaaaatcnctaatgcatctatatgcttggnttccttaanctacaatganccccngnctgggtganaatgcatttnctttttggtggccaatnaccctcctgggaaccncccgtcacacatagcatgcctttntttccttcctgtctacccccagggnctgncataccccagtttttttnncngccgcctccccctccctgtcccnngtngcccggnccanaggnccccctgccacctccgcgcgggnntcccccagancctctgtngcctccactaggccctctgtagtctcctccagagtngcctctnaagcnacctcgggaaactcctctatagcctccaccaacacctgcaccatatcctgcccganaggngttggcgctgccaccatagcctccgctaccatagcctccactgctatagccaccgccatagcctccaccactgttactagaacctccccttctatatccgcttccattgtcgtatcgggccatctcnggagg

SEQ ID NO: 726424 - DNA, 384 bp, Homo sapiens
tcaaataaaatctctacctcattggcatattgtcatgtacacaatgactatctaatgaaaccaagtgtgtaccagttgtgactttcaaatatatctgctcagccacagctttctcacaggtgcttaatggtaggacaagtgaataaattgtggaagacaaatgcataggtatagtatgatcacaacacgctacaaaatgatacatccacttttcttggctagttatataaaatagattccattttagagaatactgagatgatacagtatattcagaaatacaacttggagcaaaccttacttgccagaccttgatcctggagatttgattaaggatatagaaataaaatctgaatgagacgagaggaaggttaaaaaaaaaaa

SEQ ID NO: 726425 - DNA, 418 bp, Homo sapiens
  misc_feature (4)..(4): n is a, c, g, or t
  misc_feature (42)..(42): n is a, c, g, or t
aggnaagtggatgatcttttcaaggaaagcaggcattgaccnaaacggcccaagtgaaatatgacacggtttatcccagaggatcaccattcctgtgcgagactactaagggagccaagatcaagagagcagatgagagcttcggggcctgaaaacctagactgattcctttttgtaagggaagtctagagatgacacaaccactgcatggcataagtaccaataaatgatgtagccatggcattggataactgtaataaggtctgtcttgatttcggtactaacattagtctagccatttgcagcatagtctagccctatgatttgtagtcagggttgtgtgccagtgctgcctctgcaacatcatcccctcacccattgtacttctcaaagcctttggacctcataaggatgaaga

SEQ ID NO: 726426 - DNA, 882 bp, Homo sapiens
agctgttaggatattcgtacattttggtaaattttggaaatgctagtactgtgtttcaccagcacgtatttgtgcacattaatgtcattttccttaagatggttacagtatgtaacctgtattattctggacggacttattacaatacaaacagacaaaaaataaaaaaaacttgagttctatttaccttgcacatttttggttgttcacagtgaaaaaactggtccacgaccctgttggccatttttgcattgtttcgtttttaatgaaccatttagaacgacggacatgaatgtgcattttatcaattccttaggggcacaaggaggacaataatagctgatctttgaactttgacaaacgtctttagatgaccaagcaaaacgactttaaaaaactggtactgcacctggcctgcagctactgcagtaatacaaaacttttagatcgcaatgtgttacaacatatgcctttaattagtagactagacttatgatagcctgagtttctacattctattattttcctccctttctcatgtttatccatcggtcatccacaatgtttgctgccatgactgattcgtcgctgacgtaccaccttcaggtttctgtcgcattacttgtcgacactggcgtggtcctactggagaacctctcgtgttgtctaaatagcagcaaggatggcgtgtcgatctctgatttaattctcgcacctaagcatgacttacacgcttcccctgctccacctggctactgtcctccctttacaacatttccgtcacacaaaccaacacccacaacgaccacccacacccaccacaaccacacaccaccccctcgccccccccctccttcccccccttctctctccctcgccgca

SEQ ID NO: 726427 - DNA, 1382 bp, Homo sapiens
  misc_feature (1218)..(1218): n is a, c, g, or t
cgccccgtactctttctggtgttagatcgagcaaccctctaaaagcagtttagagtggtaagaaagaaaatacaaaagacccaccaaacgctcgcgagtgcacaaagagggtatgaaatttgcttctggacatcctcctgcttctcccgtgacagatctgctctagctgccctagaagtccttcgatgaaggctatttctaattgcctataggaggcagaaaaattcatgtcaccggtggtaattatcgtggctcgatcacagggagccagggcattggaattggaagactgactggcgcatatggaatttcggcataagaagtctagaaagccaagtcgtggtcctcatgggaatatataacactaaagccattgtggacctggtagcgacataccatgccatgaccaaacagtgcatagtgcggacctggtgatgtccaaacggcttcaatacccccttatggtgcgttacccagcgtgcacggtcaaacctcgtagcaaaagcatttacttcagcaggccctctgcgcacacagagaaccgtgttgtaccgggtggcaaggacaaaattttggggccaagcagtgtttgtcagagtaattgtctgtaaggatacacactcacatggctgtgggcgtgcttaggctctattcaatagcgactcacagagaatccggggtaatttggcgctcacgacccaaagggaagtcgccttccagacaattgtgcaagagacaggcaccttttcttcgtgcaaagaggtcttacacgttgtgtcaccttgtggcccaacgaagtttctccgttggggaaccttaccctacacatggggcctcttttttccttatccaccgtgaccacatgttgcactcgggaacacagacataatttaaaatcgccatgtggtgtgccccaagatcatcttggtttcacagccatagaatggggtggccttactccgagagcaaggatcagtggagacaagccatagttgtcttctctccggcgaatccctccgcgtgtgtgcggttataaccatggggccttataacctgggttattccaaaggacaagaagggctatatgtggctgatggcgagtagcttccggggcaattgtttggcatctaaaatcacaacttatattgtggaaccagaggcatattgaaaacgaatgcgcgtgtggcgcatttttatctagacacaatttaacgcttnggtatagggctacaacacataccagaacccatatggctcctagtatagattcccagtaacatatatccgtgattaacacatcggcgtgagggagctttcccattccaaacaaagaattcccaaatagggataaacacaaggtattagtgggaggcaccacccca

SEQ ID NO: 726428 - DNA, 241 bp, Homo sapiens
  misc_feature (48)..(49): n is a, c, g, or t
cggggcccgaggggggtttccccccttttccccattttcatttttttnnggggcaaaaccccggggccccgggggggggagtttttttttggggggggggggggccccccaacccccccccgggtttttgggttttgccccccccggccccccttttttttttttgggaaatttttttttttggggggggggtttcctttttttttttaaaaaaaaggggaaattcctttgggggggccca

SEQ ID NO: 726429 - DNA, 150 bp, Homo sapiens
gctatacaccaagtcagacccgttcacaccctatagttaaggtggccattaaggggccaggggtggcaatcagtaagctgcctcctgcctcactctctttctccaaccattctctataggctccagcgtaattagcgagccccagatgta

SEQ ID NO: 726430 - DNA, 220 bp, Homo sapiens
ggttgggcgcgggcgcatggttgtgggcgcgtggttgtggcgcgatgtaacagagaaagccatacaagtcacacaaccacctgtcaaaaaggcttcgatacgggataatcctatttattacctcagaagttttttcttcgcaggatttttctgagccttttaccactccagccgcgcccacaacccaggcgcccacaacgcatgcgccccgtgcccacaa

SEQ ID NO: 726431 - DNA, 375 bp, Homo sapiens
cataaaactcacagggcctataaaacaataacacaatgaaaaaagaggtattcaggcaataactagcttgatgaattgaacagtacctcacattgcaatattaacattgaatgtaaatggcctaaatactccacttaaaagatacagaatggcagaatggataaaaatccatcaaccaagtagctgctgtcttcaagggactcatctaacacataaggactcacataaatataagttaaaaagtggaaaaagatattccatgcaaatggaaaccaaaagggaacaggagtagctattcttatatcagacaaaaaacagattttaaagcaagacaaagaggaacattacataattataaaatgattagtccaacag

SEQ ID NO: 726432 - DNA, 100 bp, Homo sapiens
ggatccagctgctgattgtaatcacctctccctgatcaccgctgagccctgcaggataacctatctcctgacctattacaccactgattgcttatgctgt

SEQ ID NO: 726433 - DNA, 1159 bp, Homo sapiens
tcctttcccgccgccgcccagccgccgtctggcctcctcgtggcccgagcgcagaccagggtccagcctgcgctggcgcctggcagcctcgctgctccctctcgggtctctctcggtgcctcgtggcaccgctgtcctgtggggctggcctgcctgcctgcccgcccgcccgagccccttcgctgcttcggccccttgggctggcctgttgccattggggggcctgacagcctgcgcggccaaggcgctcctggcgcgggcccgaccctgcacctgcagacggggaacctgctgaactgtgggccgcttgcggaagaatgtgccccgtccacgcacagcgaggagcttcattgattgtgtatccaaaaaaacctttgacctgacttgggagttcccaaattcaagcccagatttggggtcagggcagtttcccagatgtcttgggaattgcacgtggtatctcattgcacgtagacaacggatcaattcctgcattgacgggagacagaattgaacagtttctggcaaaaccggtccattggtagaatcaaaacttctttcatcattcaattagaagttgcagttgacattggccttgtccagtccttggagttgcacagctggattctggtgactcattggcttcacctcctatttgacgatggcagttaatcttacttgagagcatttaccagccttaactgcggcaggaaattacgaaaacttaagtcagaagcaaaaacgatttgttgccataaggtacctctgatcttagaacacaacacaggttggaaccagctgtatccgtggggccacgggtaaaccgaaatatgttaaccaaggttaatcttggcgtctcgggttgtggtgtttgcccccagaatttgcattggccttttgccgaacccaatttggacccacacgagcgggttgaagctcccacaggtgttccccaaagaaccgcctgtttctgttcaagcacagggtttcccgcagaccctttcggagaaagacgttcttagaattaaacccccgcaagtgagtttcgcccgggagatgatcgcgcggaaaagcccacgtgtgaacaagaggaagtctacacacacggcaccacataatgcaccacacagcggcgtcacatagagaaaacacatgtaga

SEQ ID NO: 726434 - DNA, 776 bp, Homo sapiens
  misc_feature (294)..(294): n is a, c, g, or t
taacccttcccttatgagacatgcctgtgtggggttgacagtgagggtaataatgactgtgtgggttgatggtaaatttggggctgttaatggtcagtccagggtttataatctcttgaccgcaggcttattgcggaggaaaatgtgtttccagtgtttactttattactaacatttagttctctctcatattaggggtgatagaatgtggctccaatgtggggtggtgagggagtctcagttaatattgtttgaggaacttttctataggatagtgtgggtgtgttgtgcagncttgtaaaccgctttctcttatacactgtgaggtggcgtgctttttagagccatactatatgtgggtgtgtttaacattgttgttatactctctctcctcttacagagggtttttgtctcctatagtgtgctcccaagagaagcgtggtcccctcttttggggaacttaacgagttataaatttcttacacgaggggggaattattaatagaagggggctccgtggggggggccaaaaatttttacaacgtctgtggacacctaaagataattccttactcttggggacacacaccccaagtctatttccaccccgagggtctcccgcgaaacgtgttttgtggtgccgcctttctaaaccttattaaatattcttgcccccccatttaaatattttggggctcaacataaagaaccgggggtgggtggccccctttaaagactgagtcccttagaagggtaagcccccgaccgaggataac

SEQ ID NO: 726435 - DNA, 721 bp, Homo sapiens
tcggacatgttccggatcccccgttgggggacgcggtcccccactcgggttaccccgcgcctgattgttatacgccccctcttatgggcgtatctcgcctacgctaagtacggggccgcccgaattctttggcgagggagccggtccccgcatacttctgttgccgcgaccacgtataactcgagtgtttccaagcttgcctgggtctcgggaaaaaaatattgccccgggaattttgcgccacattacgactccgggggtactacctccgctccagccacaaccgtactttcttgggggaacacgcttcgcgcgcaccctcacacgccccatggcacgaagaaaccacaatgcggcccggtgtgatcacccgcccaaagaagaatatcatgacctgaggcggccgagtcaaccgccgactcttgttccacctcgggggcgcccccggcgtctagaacacgttggcagtcccgtccctcgggaaggtgcgggcacacacgtgtgggctggcaaggtgccatgttttatgcagtccttgtgccatggggcctggttcaactttgtttcgccccctttagtttcgcacctccccctcgtggcgccccccggtgctgatatacaccaagcgcccccgggtgtgtccctgcccccggggcctcctcttgatcgcttctgggttttctttttttttttttggcccgaggtacccccccacataaca

SEQ ID NO: 726436 - DNA, 267 bp, Homo sapiens
  misc_feature (5)..(5): n is a, c, g, or t
ggttnaacagtccccattagcagaagtcatgttccagcttagactgatgaggatttaaaaatctgcatcttccactattttcaatatattaggagagataggtgcagcatttgtgcatctgacatttacctaaaaaaaagacaccaacttggcagagaggtggaaatcagtcatgattacaacctacagaggtggcgagtatgtacacaagagcttataggccctcatagggcttgattctggtatattgatggtgtcttttcttcc

SEQ ID NO: 726437 - DNA, 134 bp, Homo sapiens
ggtggggttgggggtgaggtgtgcttgttggtaagaagtgggctaggtgtattagtatgttctcgcactgctatatatcccgaggatgggtgtggtggctcacgtctgtaatcccagcactggcgcggcttgga

SEQ ID NO: 726438 - DNA, 161 bp, Homo sapiens
cgcataatcggactcgctatcatcggcacctcgctatcatcggcacccatacgtaacctgagcagtatacactgaatttaatttgtagtcttttatccctcacccacttcctacactttcccactgagtccccaaagtccttgtgtcggtgccgatgaata

SEQ ID NO: 726439 - DNA, 255 bp, Homo sapiens
tggcagaactatgcgcacgggaaccaaccgcttacgcccgcaccacaggcgatcctcgtagaagcgcgaagccgattaacagcgcctcgttcatgctgatgcttcccgatccgtctaaatcggctaacgtcggcctttttaaaatttgaatgacaattccaagtcgcttcagatgaacgcgccatattcgcattgttgctatcgggcgaggcgcaacgtcttccagttcatcttctcgtttcttcacattcggtg

SEQ ID NO: 726440 - DNA, 252 bp, Homo sapiens
tcgacttggtacacattcagctgggcgggcgtcagcacatcaatgacattgaatggccttcgccacagggaccgcagcttcctctccagcaggtctatgaaccatgtgcaggtatgtcagcggccctcaccgccgtcctggttggctgccaccgggctgcttgaatgtaggatagggatgttccatggtggctggcgtgagcctgctgcgaatgccgtctgcttgagtgctttctcctgccgcagtccgggc

SEQ ID NO: 726441 - DNA, 154 bp, Homo sapiens
tagaacattctatagctcacatcgggaactgcccgtagaggtgttatccctacccctgtgaactctgttcacagcttacatagggtttcccccttactataactctagcatccccatacccattatgacactaaggggcacgggttcttcttgt

SEQ ID NO: 726442 - DNA, 916 bp, Homo sapiens
  misc_feature (23)..(23): n is a, c, g, or t
  misc_feature (61)..(62): n is a, c, g, or t
  misc_feature (70)..(70): n is a, c, g, or t
  misc_feature (83)..(83): n is a, c, g, or t
  misc_feature (93)..(93): n is a, c, g, or t
  misc_feature (106)..(106): n is a, c, g, or t
  misc_feature (128)..(129): n is a, c, g, or t
  misc_feature (131)..(131): n is a, c, g, or t
  misc_feature (135)..(135): n is a, c, g, or t
  misc_feature (173)..(173): n is a, c, g, or t
  misc_feature (180)..(180): n is a, c, g, or t
  misc_feature (344)..(344): n is a, c, g, or t
  misc_feature (358)..(358): n is a, c, g, or t
  misc_feature (361)..(361): n is a, c, g, or t
  misc_feature (363)..(363): n is a, c, g, or t
  misc_feature (365)..(365): n is a, c, g, or t
  misc_feature (370)..(370): n is a, c, g, or t
  misc_feature (372)..(373): n is a, c, g, or t
  misc_feature (378)..(378): n is a, c, g, or t
  misc_feature (383)..(383): n is a, c, g, or t
  misc_feature (416)..(416): n is a, c, g, or t
  misc_feature (447)..(447): n is a, c, g, or t
  misc_feature (464)..(464): n is a, c, g, or t
  misc_feature (467)..(468): n is a, c, g, or t
  misc_feature (471)..(471): n is a, c, g, or t
  misc_feature (473)..(473): n is a, c, g, or t
  misc_feature (486)..(486): n is a, c, g, or t
  misc_feature (490)..(490): n is a, c, g, or t
  misc_feature (492)..(492): n is a, c, g, or t
  misc_feature (495)..(495): n is a, c, g, or t
  misc_feature (497)..(497): n is a, c, g, or t
  misc_feature (500)..(500): n is a, c, g, or t
  misc_feature (504)..(505): n is a, c, g, or t
  misc_feature (512)..(512): n is a, c, g, or t
  misc_feature (515)..(515): n is a, c, g, or t
  misc_feature (537)..(537): n is a, c, g, or t
  misc_feature (542)..(542): n is a, c, g, or t
  misc_feature (550)..(550): n is a, c, g, or t
  misc_feature (562)..(562): n is a, c, g, or t
  misc_feature (566)..(566): n is a, c, g, or t
  misc_feature (570)..(570): n is a, c, g, or t
  misc_feature (572)..(572): n is a, c, g, or t
  misc_feature (697)..(697): n is a, c, g, or t
  misc_feature (701)..(701): n is a, c, g, or t
  misc_feature (706)..(706): n is a, c, g, or t
  misc_feature (711)..(712): n is a, c, g, or t
  misc_feature (716)..(716): n is a, c, g, or t
  misc_feature (749)..(749): n is a, c, g, or t
  misc_feature (786)..(786): n is a, c, g, or t
  misc_feature (812)..(812): n is a, c, g, or t
  misc_feature (830)..(830): n is a, c, g, or t
  misc_feature (858)..(858): n is a, c, g, or t
agactcgccagccagatgccaangatggggattcatacgacccctatgacttcagtgacanngaggaggnaaatgcctcaagnacacactccnaaagacggcagantcacaggagaccaaggaatccnngnaagnggagttgagtgaatccaggttgaaggcattcaaggtgnccctctnggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatctggngggtggggggaggngtngngngtggngnngggtngtgcngagagagtttgttctgtgtttcccacgcctctncgtgacccaagtctttgcctcgactcccttnacagtgttgaattcaantgnnggngnggaatgttggtgntgangntgngntcngganncggtggnccntttgggaatgggtcatgaaggntgccntggggtgnggaaaggggggncagngggngnggacaatgactattgcatcttcattgcaaaagcactggctcatccgccctacttcccatcccacacaaacccaattgtaaataacatatgacttctgagtacttttgggggcacaactgttttcngttngctgnttttnngttntgttttttttctccagagcactttggtctagantaggctttgggtggttccaattggtggagagaagctntgaggcacgtcatgcaggtcaagaangctttctttgcagtagcnccagttaaggtgaatatgtattgtatcncaaaacaaacccaatatcagatgatatccgagatgttgaataaacttagccatttcgt

SEQ ID NO: 726443 - DNA, 396 bp, Homo sapiens
  misc_feature (196)..(196): n is a, c, g, or t
  misc_feature (396)..(396): n is a, c, g, or t
aattggacgcgcgcggcggagctgtgcgcgagacgcgggggggccacacgcgcgcgcgcggtgttttatactgcgtggtgttcgcctgtgcgtgcgttggttcggggctgtggtatacgcgcgccgcggggcctcgggttatatcgcgcacagagagttaacgtgacagggcgcggggagagctgagagacaccgngggtggcgcccttagagtccagacacggaataggttctctcctctcaaatgtgtcctgtgaggcacggacacattacacggggcacaccctgtgagaggtgtggcacacggccaagagtggaggcattaagacacggaaagcgccgcgagtgtgttgcgcctctgtgcggggacattggagggctcaactgtgtgggcgn

SEQ ID NO: 726444 - DNA, 126 bp, Homo sapiens
tgagtaatagccgcacgtgctacatgctccacggtctattggagtactggaatagcgatgaatgcagctcttccggaatccagcttgaagcacattatctccgaagttgggaaatatagggagtgg

SEQ ID NO: 726445 - DNA, 98 bp, Homo sapiens
  misc_feature (55)..(55): n is a, c, g, or t
  misc_feature (61)..(61): n is a, c, g, or t
ccttgtcttgggtctgaaaaagctgagaagaataaaggaaacattgctcaacttntttcancccccttccccctgacacctgttttctcatttgccct

SEQ ID NO: 726446 - DNA, 595 bp, Homo sapiens
  misc_feature (12)..(12): n is a, c, g, or t
  misc_feature (104)..(104): n is a, c, g, or t
  misc_feature (125)..(125): n is a, c, g, or t
  misc_feature (144)..(144): n is a, c, g, or t
  misc_feature (171)..(171): n is a, c, g, or t
  misc_feature (182)..(182): n is a, c, g, or t
  misc_feature (226)..(226): n is a, c, g, or t
  misc_feature (228)..(229): n is a, c, g, or t
  misc_feature (231)..(231): n is a, c, g, or t
  misc_feature (236)..(236): n is a, c, g, or t
  misc_feature (253)..(253): n is a, c, g, or t
  misc_feature (265)..(266): n is a, c, g, or t
  misc_feature (268)..(268): n is a, c, g, or t
  misc_feature (275)..(276): n is a, c, g, or t
  misc_feature (287)..(289): n is a, c, g, or t
  misc_feature (292)..(292): n is a, c, g, or t
  misc_feature (297)..(297): n is a, c, g, or t
  misc_feature (301)..(301): n is a, c, g, or t
  misc_feature (307)..(307): n is a, c, g, or t
  misc_feature (314)..(314): n is a, c, g, or t
  misc_feature (316)..(316): n is a, c, g, or t
  misc_feature (318)..(322): n is a, c, g, or t
  misc_feature (324)..(324): n is a, c, g, or t
  misc_feature (326)..(327): n is a, c, g, or t
  misc_feature (329)..(342): n is a, c, g, or t
  misc_feature (347)..(347): n is a, c, g, or t
  misc_feature (350)..(350): n is a, c, g, or t
  misc_feature (352)..(352): n is a, c, g, or t
  misc_feature (360)..(360): n is a, c, g, or t
  misc_feature (363)..(365): n is a, c, g, or t
  misc_feature (368)..(370): n is a, c, g, or t
  misc_feature (372)..(375): n is a, c, g, or t
  misc_feature (382)..(383): n is a, c, g, or t
  misc_feature (393)..(393): n is a, c, g, or t
  misc_feature (400)..(400): n is a, c, g, or t
  misc_feature (404)..(405): n is a, c, g, or t
  misc_feature (407)..(409): n is a, c, g, or t
  misc_feature (412)..(412): n is a, c, g, or t
  misc_feature (414)..(414): n is a, c, g, or t
  misc_feature (416)..(417): n is a, c, g, or t
  misc_feature (421)..(421): n is a, c, g, or t
  misc_feature (423)..(426): n is a, c, g, or t
  misc_feature (430)..(432): n is a, c, g, or t
  misc_feature (434)..(434): n is a, c, g, or t
  misc_feature (437)..(437): n is a, c, g, or t
  misc_feature (440)..(440): n is a, c, g, or t
  misc_feature (454)..(454): n is a, c, g, or t
  misc_feature (475)..(475): n is a, c, g, or t
  misc_feature (486)..(486): n is a, c, g, or t
  misc_feature (578)..(578): n is a, c, g, or t
aagttgggagangccccctcctcagctccctccttccccaacaactcttctacagcccagcccccagggcccagaggcagggctggcgtcaggcagactgtacngcataaatacgtggaggccanagcccgaatcagcagcgtnagggggcagggaaactgggtttgggangagaagtgggnggctctgggggcacgtcccccagtgcttgtccagagcccagggncnnanagagnaagagaggggaaaagtnggccagcttggnntntggctcnngcccgccctgnnnagngaggntggnaggtgnatatggntntnnnnngngnngnnnnnnnnnnnnnnaagtnaanangcaaagangcnnnagnnntnnnntaggcgnnatgttcaaangataagntganncnnntgnantnnaatnannnnttannngnaanggnaaataaagaaaganatggaggaagaggtggtgaangtaatatatgngaatagagatgaaagtatgggaaaggtagagatgaagaagagaaggataaaaagaaagaagataatgaagaatggagaagtggaaggaatanatagtaaatagtatagt

SEQ ID NO: 726447 - DNA, 125 bp, Homo sapiens
ccactggttgactatattctcttactgtatccgtgtataatggcgcttaagccctgactatgagggactgtcagccgtagttatcacgcctgccaggtttctaccaccttggattctcatgtgca

SEQ ID NO: 726448 - DNA, 400 bp, Homo sapiens
cgttactggcatttgaagggcaagtaatatttaggttgcagaagaaggctaatgcagcctctgaagggaactgttctaattattacctaataaatatagttacacaactatattcgaggacatgagatatagcactgcttgataaccagaatgactgaacagttaggttacaaggaacagctgtaaattggatcggggaaatggatctgccgaactaatttgactcgggacagtgatccatcagtcctagatgcttctggtatgtaaatctcttgaatcacattgttccctttcttctgaaatctccaaggagaattctcacagcactacattcaggttgccatttagttaggattcaacatttccatccagtagccatcaggatcttgaataattgcca

SEQ ID NO: 726449 - DNA, 263 bp, Homo sapiens
ataatatatctcacgagaaatggtaaaattatgaaaaaatttataaggaaatagaatgtatgcatagctagagcacataataaaattgctgatgtgctagaacagcaaattcttcaagcaaaacgaatacgacaaaatcgccaagaatataatgctttggcaaaagtgattcagcaccatccagacaggcatgagacattgaaggaactagaggctctgggaaaagaattagagtcatctttcacacatagttcagcgtctga

SEQ ID NO: 726450 - DNA, 834 bp, Homo sapiens
ttttatttttgagacggagttccactctgtcgccaggctgagtgaagtggtacaatcttggctcactgcaacctccacctcccgggttcaagcaattctcctggctcagcctcctgagtgctgggactacaggcgcgtaccttctttagtagagactaggtttcaccatgttggccaggatggtctctatctcctgaccttgtgatctggcctgcctcagttcccaaagtgctgagatgacaggtgtgagccatcagacccagcattttttttttaaatttaaatttaaattttttccattttttgggagaggtttcttggttcggtcggtcgtgtgtcgtgtggtgtggttttcgagacagtcttgctctgtcacccaggctgggagtgcatgtggcttgatctcttgaacctctacctcccaggttcaagcaattcttgtgcctcagcctcccaagtacctgggactacggggtgcccgctaccacacctgggtgatttttcattgttagtagagacaggctttccaccattgttgcccaggttggtctcaaaacttcctggagctcaggcaatccaccgcctggcttcccaagttgcaggattcacgctgtgagccacacacgcaggtaattttcttccggtttaatttaacagtgggggggctcaatttgttcccctggtggccgacccgataacagaccttgtcacccaacagtcaggttttcaaagaacaactttttccttatgcaggagatgtgccacgcagaggtgccccccgagagttttctacttttttaaaattttccacaaaattggtgccgagaatgcgga

SEQ ID NO: 726451 - DNA, 157 bp, Homo sapiens
gtacatatttaaatcgacatgatatattaataattaattgctgtacactatacagctgaagaatttcacgacatacagacagcaaagaggacagaagggatcatgaaaagtttctggaaaaagcaagacctaaactgtaacctggaatttaaggggt

SEQ ID NO: 726452 - DNA, 764 bp, Homo sapiens
cactgtgttacaaaggtgctgctttacatcggtacgagaaaaacccgagagttcccagccatgtgtctggatatgacatttcaccaacccagtttcacagtgtgcacggcctccaaatatctacctaaagattatgatagattaggcattgtatcactacaaatctgtggcttcgttgtccactagagcctgactgagcagtgcctaaaagaaacagacggataaccgtgatccctcaggaacagatggtgttctagacttatgtggccgtgcatttcattggtatggagcacttgaggggtctttgaacacctgtccaggtctcacatctctgctttgggtgcaacgagctcatcaattaacagtagtcaggaatgtgcctttacttcctggggctggtctgttgaaatttctgtgtgtggacatatggataacatccaggcagtcatgtctgctttcctatagcctcttacctaattgatgccctaaagtcctatatcctttgacttcctggatggtacctagatttcatgcgtgtttaatctaatctgcaagaaacctgagcgttaatctccgatgaatagaagaacttgttgtttcttatttacatgctctttgtgactcttgtcttagattcttgagcaggatttccaatacggtgttgaaaagaagtagtgagagtgcgcatctaacttattgataaactcttaaaaacaattccgaaattgcaccattgaccagtaatgtaaccatgggattgtcct

SEQ ID NO: 726453 - DNA, 197 bp, Homo sapiens
attgttgattacatttacccaataatattgatggtttttgtcattggggctttaaagggaggccttatgggtgctaaattttatttctcctcctcttcctcctcctttttcccctttttcatcttttgtctccattttctttctcttctcctcctcctcttactccttttttgctccccctttttttcagagttcca

SEQ ID NO: 726454 - DNA, 158 bp, Homo sapiens
gatcaagatcccaagaagacactctgggtgtctgggtgccagacaaggtgggcaggcttcaacagatcaagccccacagaacagctggtgcccatgcgctgctggtggtttggggccttctgtttcttcttctaactgggagtaatcacagttgtctg

SEQ ID NO: 726455 - DNA, 310 bp, Homo sapiens
  misc_feature (177)..(177): n is a, c, g, or t
gagcttatactgtggtgtacgtaacgcagtattaaccaaacatttgaaagtatgattcctaatgaaaacactgcatattaaaactgttagcatttactcaccgcactatgatgatatgtgttttcttgtggaagacacaagaatacttaaaatcaaattgttgtactactctcctgnggatcaaagatcactctgtaggattcaccctgaaggcataaaacactcctcaagtgctttcaatctcatccgtttgaattctgtattcaacaagcagccttaagtgacggtacacaccaccagtacggggtac

SEQ ID NO: 726456 - DNA, 185 bp, Homo sapiens
acaggacttatcaccctaaattaattatgcgagtagatcttaatgttcttaccacatacacagcatatacaaattggtaactatgtgatgtgatagatacattaattggcttgattatggtaatcattttcacaagtgatatacacattattttcaagaataccttaacttgttatacgtgataa

SEQ ID NO: 726457 - DNA, 614 bp, Homo sapiens
  misc_feature (96)..(96): n is a, c, g, or t
  misc_feature (593)..(593): n is a, c, g, or t
ccgctttttattttatttttattttgagacagtgtctcactttgtcacccaggctctggagtgcaatggcgggaggcactgcagcctcaacttccngggcctcaagctgtgctcccatctcagcctctcaagtagctgagactacagaaaagcaccaccacgcccagctgatttttatattttttgtagagatggggttttgccatgttgctcaggctggtcttgaactcctgagctcaagcagtccatctgcctcggcctcccaaagtgctaggattataggcatgagccactgtgcctgccctcactgtagttttgatttgcatttccgtaacgatagtgatggtgagcatcttttcaggtgcttgctggccacatgtacaccttctttagggaaacatctcaaggcctttgccactctcatttttttagagatggggttttgctgtgtcgcccaggctagtcccaaactcctgggctcaagcgatcctcctgcctcagcctcccacattgctggaactacaggtgcacatcaccattcctagctaaaagttttaaagtttgatgaagtttacttcatccatgttttcccntgttgcctgtgcttttggtcc

SEQ ID NO: 726458 - DNA, 100 bp, Homo sapiens
gtacatacacagaatgggataggggatacagcatctggtggccggcatcctcaatgggcatggttgtgagaccactattacttctgcttgagtctatctg

SEQ ID NO: 726459 - DNA, 433 bp, Homo sapiens
gctgtgaaatgagcgaggaagagtgtcgggaaggtttagactctgatatcaacaatagagtggttaaacatgactcctgcagagaccctctcaactggtcaaaacctaaaaatgcctttcctgaggggccgctgggagccttgagagccatgtgcaagaggacagatcctgttcctgtcaccattgctctcgattcactcagatggctgctacttcgacttccctgcaccacactctgccaggtcctgcatgctgtgagccatcaggaccctagtcctggtgacagctcctcagtgaggaaagtgagtgtgcttgggcttgctacatgaagagcttcatggaccaggccctgtgaagagctctcaaccagccttgctccgactgaggtgaccctgggccggaccatgggccaggcctcggcccacatcctgtg

SEQ ID NO: 726460 - DNA, 695 bp, Homo sapiens
gttcacgccattctcctgcctcagcctcccgagtagctgggactacaggcgcccatcaccaagcccggctaatttttcttgcattttatagtagagatggggtttcaccatgttagccaggatggtctcgatctcctgacctcgtgatccgcctgcctcagcctcccaaagtgctgggattacgggcgtgagccaccacacccggccgctgttgagctttttttcatatgtttgttggctgtatgaggtcttcttttcagaagtgtctgttcttgtcctttgcccactttttaatggggatttttcttgtaaatttgtttaagttccttatgggctggatattagacctttgtcagatggatagattgcaaaaatgttctctcattctgtgggttgtctgttcagtgtttcttttcatgcaggttctttattttatccttaatatttttactgagtcacacaaaatacctggcagtacccctgaatttacggtttttacttcacattgtcagtttatacatttattttctcatctagactacaagaaggaattcatgtctttattacaaaatatgtgctgagttcgaattttatcctgggacagctagaaaaacaatgacttgattcttgcattgatctgatctttcttctacatttgcactttcggtgagacggagtctcactctgtcgcccag

SEQ ID NO: 726461 - DNA, 218 bp, Homo sapiens
agaatggtccttccaaagtagtttcagctggatgtggtggcgcgcgcttgtaatcccagcactttggaaggctgagccaggtgggtcaactgaggtcaggagttcgagaccagtctggccaatgtgaggaaagcccatctctactaaaaatacaaaaattagctgggtgtggtggcacacgcttttaatctcaagagtgagactctgtctccaaaaaa

SEQ ID NO: 726462 - DNA, 355 bp, Homo sapiens
aattcctgagctcaagcaattcgctcacctcagcctcccaaagtgctgggattacaggtgtgagccactgtacttcgctgtatattttacattatagtttttgaggtacttgtagatttacatgcagtttaagaaataatacagaggccaggcacagtggcttacatgtgtgagcagcatagtgagaccccgtctgtacaaaaaaatttaaaaattggccgggcgttatgtggcatgtgcctgtagtcccagctactcaggagaccgaggcaggaggatcacttgagcccgggagtgcaaggttacagtgagtcatgatggtgccactgccctccagcctgggcaactgtcttta

SEQ ID NO: 726463 - DNA, 201 bp, Homo sapiens
gaacgagccactgtcacgccttctcgccccgggcctcctttggcgtagccagccttccttaacgatgccgctgccggtgctcaaagcccttgtgtcttgtagacccatttgcgcaccgtgtcgcgcagctgttcctgtccagtcggctgaagctcaaacgtccatgtcaaacccgctgggcaagtcagggcggatcctcta

SEQ ID NO: 726464 - DNA, 593 bp, Homo sapiens
aggacacataggacacagtcggggctgggtcctgagccatgatgtgccatgtggtaggagcacaggacacaggaatcctggaaagtggtggcttcagaagtgatcttggtcgcaggcaccagtgccacctaccaagctgtgaaactaatccttctccactagacgtcgtagggcctcaggggctagacgaggtcatacctgagttcacctgcacgtgcttgcccccgggtgctgagccatagagcatacaatagcgccctacttcacggaaactggtgcctttaaacttaggtaaacttagaacacagccgagaaggtgcttctgtggtactgttatgctactttttcctacttttttgtaggaaaaacagaaagataatgcctctgcttctattgtctctgggggtgtggggtgggggccgggagccgtcgcagacccgtttcatgcagcgtctccctcggcaccgcgtacggaggacgcaccctcactcccctgctgccttcactcctttctgaccaagcaacgctaacctttggtacagatcgattgataaaattaaacaaagtgcttttgatgaaagacaaaagaaaag

SEQ ID NO: 726465 - DNA, 1545 bp, Homo sapiens
gatgctggcttcagaccgagcgtgtctgactccgttgtgtggagccatgtacagatggtgcatccgcctctcatgactcatcgagcgttgctaccagaaacagcgggagcaatcacccttagcgtgcaattgatgttcaaccgtaatgcctcctgctaggtatactataggattcagtcattcgcatacagactgtacgcagcgaaccacgctatggtcgaaaccttgaagccgaaccattagagctagatcatgagtcagccacttgatgagtgtggtgtcatcgaaagctttaggcattgcgtgcctttcaccaacgtgacatgcttcaaaattgcattggaagcgtagctgagagaagacatgcgcgtggtgaatccaatagagtatccaccgggaagatctcccgcgaggcatgagcatgagtgtacactttcaaatgggccctgcgggagatatctagggccgacactgaacatatttaagccaaggacacggagagtgctgaataccgcagcagcagggtaccaccaggagtgcagtcatgaaaatctggatagaagccgccaggaaagacatcgaagacgcgaccggaatgtcaagtcggatattctggaataggaccctagaaagacaaccaatagtaactcgagacaatggagccgtagataaaaaacccaagctggatagcgacatggtagacccgacatagaaacttggaaccagcggatatagcaccgtaccccgattgctatcccatggaggtgcacctggtcaattgagatccgccgatttcgaacaaccgtggaacgctgattgccggacacgtaggaacggtctagcgccctttgggccatactatcaacgtgggaatcgacggggacataacgccttcatgagaacaagcgaagttcacacgggccttaacgttaaacactggggtctcagacacgaacttgtggacaatgttcagcgccccgacaggccaacaccgtgcatatggaacaaacactggcgggtgcccctgtggatccaactggaatacacaagcacaaaataccacacaaaccaccatgctggacaaggtgggcccacttaacaccacaaacatggtaataccccggccactcaactgccgactctccacacactatcatgggcgagccaacacacgacggagacgacaaaggacgagcgccacagctaacacaccacggagcaacaacctagcggcaagcacaacataaaacaaggccgacatcccatacaccgacaacgagcccacaccatacacgagccgacagagagcagcacatcggacatatcacgcgagcagaatcagaccacacaacaggagaggcgaacaatctacaacaatgagaacaacacaatagagaggacaaaaacacacaggaggagccaagacaaaggcggaccacaaatagtacgacgcaacgaacacaaatatcgggagcgaatgacacacagacacggaacgcagtaccgaagaaacaggcatacaaagacactaaacaacatctaaca

SEQ ID NO: 726466 - DNA, 1617 bp, Homo sapiens
agaccccatctctaccaaaaaaaaaaaaaaaaaaaaagtgcaactagctgtgctgggtgattgggccctgtattcccagtgggcttgggaggtctgaggtggggaaaaattggcgtggggcctagagaagctgggcaggttatgggtggagaaacactggagatattggcgaccaattggcactggtagcctggagtgacagagcggagaccctgtctcaagaaaagaaagttattggggaagggtctatttaaaaggactctcttactttttaaatctcagggcggtggcaggcctcacggccttgtaactcccaggcattttgggagagggcttgaagcgcaaggcagaaattcacttgtgaggggctcaggagaggtctcaagaaccaagcctgtgggccaaaaactgggttgcaaaccccaattcttctttactataaaacattccaaagaacacttaaactgtgggggcaagtgaggtggcggggaccaccctgtgtataatctccccagagcatatacttgggggaagggacgtgagaggccagcgaagaaaactccctcttttgaaaaccccgtggggaaagggttttgacaagtgtgaacgcctcgtgaagatattacaccccaagctggtggcacttttacaggcccgtgggggtttggaccaagaaagcccaaaaaagttttcacaccgctttcaaaacaagacaaaacaaacacgagagattctgtgctacacttttttacagacaaatttctctccgaaccacccatagaaaatgcgaatttgtgcgcactttgggcgtaatacagcaatatatcgcctaataccattatatagccccatgtgttggaacagccaccacttgtgctcccgcgcgtgattttataacgcccgcggtgtgttcacccccatatttatcttgggaaggcggggccgaaacactttccaaacgtgttggggcggccccacacctctgatggtggaaagaccacgcctaaaacccgcgtttatttatatccccaagcaggaacgataactattttagagaccgcctggtgggtcacacacaagcatagtggacaccggcatacgatcagccagcgacctacaacattcgactcgcccaacctacttaaccagcgcgccacagtcgatcgacctacacacatacagcacacggaggggcgcggtagcacgcacaaataataaaaattaccttcacgacagcggggggcggacacacgttcattaataccagtcagtacgcaaccagcattagtagtttagttaagaacagaggggcgatcgtcccataatatagagaggtgtcgtatttaataatagacgataggagaaggtagtggtcgcacgatagatactaaccacacagttgatatgtgagtagaatcgaaacagatgattgatcagtagaagtactatgtatgaaggaagaaagacactatctctgtgggggtgatgcatatatttgtgatgactgagaatctacagtagaattatattaatcggtggaaacatataaatagatgcgtagatgtatatgaacaagacgatttggttgcgagtaagatgatcgtgtttatattctac

SEQ ID NO: 726467 - DNA, 175 bp, Homo sapiens
gcccctttattcctttaaggcccttttcccttaaaacctaattttaaaattgccttttttggcaaaataaccccaaaacctttaattttaattgaaaattttttttggctttaaagaggtggattgaaagaaaatttgaaatgactttatattatgcataaatatttatatttta

SEQ ID NO: 726468 - DNA, 180 bp, Homo sapiens
actaccaccatgtgagagctttatatattggtacatataaaaacttttctggggctgggcatggtggtgttgcttgtggtcccggctattcgggaggctgaggtgggaggattgcttgagcccacgagttcgagactgcaatgagctatgatcatgccattgtgcttcagtctgggtgat

SEQ ID NO: 726469 - DNA, 273 bp, Homo sapiens
tgcatggctcatgctgttatcttagcactttggtgaggcgagacaggcagatcacttgaggtcaggagtttgagaccatcctggccagcatggtgaagcctcatcttactaaaagtacaaaaattagctgggcatggtggtaggcacctgtaatcccagctactcaggaggctgaggcaggagaatttcttgaacccaggaggcaaagattgcagtgagccgacattgcgctactgcactccagcctgggcaacattgcaacacggtctctca

SEQ ID NO: 726470 - DNA, 775 bp, Homo sapiens
  misc_feature (338)..(338): n is a, c, g, or t
tccagcccccggtaccggaccctgcagccgcaaaaattttgatgcctaaaaaaaaccggtattgccatttataaactcctttttaaggagggagtcatggtggccaaaaaggtattgtccacttgcctaagcacccggagcgtggcaaacaaaaatgtgttgcccaacctttcatgtgttcagtaaaggccatgtgcagtcttctctcaagtctcccgaggtcatacgttgaaggaacagattgtgccgtggagcacatttctcatacgtggatacctttaccaatgtgagggatactccaggatattttccgtgattataccttctcatctctgtgncccccgggagaattgtgtgcctgtgccacccttacgccgttagccgttccaaagaactgtggcaggccactcggccataaaggctcgtggaagggttgagcgacctgtgcgagaacttcacaagaaggggaagcttgacagagaattccttacagacggagttgctgtgccacctgtggttgccgacaaaaaagccgaggctggggctgggctcagacacccgatttccagttataaagggcggatttgggctctgtggacgttggctcagccaccttcagtaaaattgggacaagcgactctctttgggctttgaaatatctttacagccaaaaaaccttaaaacaacaactaataacacaaaaaaaaaaacacagcgggcattttagtagggggccgcaaaaaagtctaataaagcaccataggaaacgattcca

SEQ ID NO: 726471 - DNA, 137 bp, Homo sapiens
  misc_feature (32)..(32): n is a, c, g, or t
tattgaggaagtattttgccttccctactcantgagaagtattgacttcgtggtacacattttaaagcatttttgatttgaatatttttgtacatttttatcaattattaaaccttctcttctagaaaaaaaaaaaa

SEQ ID NO: 726472 - DNA, 84 bp, Homo sapiens
ccaatctgaagtgggagaacagcttgagcctgggagccagacgccactgcactctagccttggaacacagccagaatctgtctc

SEQ ID NO: 726473 - DNA, 288 bp, Homo sapiens
taagcaagctggcagcccgggaacagtgcccacaccccgaggtgagcatctgacagcatggagcagaacccatagcccatggtgagcatctgacagactggatcagcacccacacatccaggtgagcatctgatggtctggagcagtacccacaaccacaggtgagcatctgacagtcaggagcagtgtccagacacccagagggtaacatttgacaggctggagacagatgaccatagccccaggtgatgcatctgacatcgtggtggaacatcctgcaaatccagg

SEQ ID NO: 726474 - DNA, 1071 bp, Homo sapiens
gttggcttacgcctgtaattccagcgctttgggaggccgaggcaggcagatcacgaggtcaggagttcaagatcaccctggccaacatggtgaaaccccgtctctactaaaaatacaaaagttacctgggcatagtggcagatgcttgtaatcccagctactcgggaggctgaggcaggagaattgcttgtgaaccgggaccctggaggcagaggttgcagtgagccaagatcgcacaactgcgaactgcgctccagcgtgggctgcagaggcagactccgtctcaagacaaaaaaaaaatcagcttatctttccttcccctgaatcttctgcagtgccagtatcatacctcaggcccacttgttacatgtagaaaaaaggccaaccaggttcatattcacgtatcaacccctgcagtaggagaaaaggccaatcctaggagctcaggatattaaccagaagacctatcagacagacttcccttgtatcagcccaaatcaagtcaccatgacactgcctaagccagcacccatgatgatcagggaactgccagtctataacacaagtcacctacaagcagaaactatagaagacaagaataaccctacatagtcaaaaggccaaataaaggaccatcctcagaggatgggacaacatgggcaccacgccatacctcagcaagcacacaacagtagcagcacgcagtgaataaccgcgcacgaaacaatcgcgaaacaggtccacaacagacacggaacggatgacaagcagacagaaccccaagaacgactacgaaacacgaaggacaccacacaaacggaacaacacaacgcgtggcacacatcagcgcagcagaggtgaacgcaatgaaaaaacagaccaaaaccggctcagaggaacaatcgggaccaccgcacccacacaacactgggagccggaacggacgcacacacgaaaccaccaaaggcgacccagggcagcaccagacgcatacacataccgaggccccacgccaccacccaacaaggcaacacgccgcaagcccagcacacacacatagcgaagcagaag

SEQ ID NO: 726475 - DNA, 692 bp, Homo sapiens
ggattgtctggtacacctggtcatgggtggtggtattctctgaaatctgtggttatgaaaattaggccaatatgattttattccaaatgtaatttaatcgctgctgttgtggggttctcgcttatctgctaatctcacgcattagttgtaaccagtgattttgacaataatactgccattctgtaatcatatccagtgcgcaatcatgataagctgttggtgagatagaatgcttttcattcttctcacttgcctttgttacttaatgtgcttctcagtacagcagatatgcaatattcaccaaataaatgttagacttgtgttcaatatttattgaatctcctgatgtgcacaatgggctcgtagataatgagcttgcatgtcagacgaaaaatcataaaaagcatggattgatatagccaatgacttaggagatacaagcataatatgcatatgtaaatgatgaatgcatgtggctaagaacaccatgaccaaaatccagcaaatcaactggattgcgaatctaaccgtagagacaataagatattatgagatgggattctgaatctcaggtttaggattacagagtggagactttccagcataacccaggatctttatcattacaaatacgcgtactcgtatctgaggaagtttatgtagagttatacaccttctgtcacagggctcat

SEQ ID NO: 726476 - DNA, 2824 bp, Homo sapiens
aaggcggagcggtccctgcaacccggccggcgggagctgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaaaaaaaaaaaaaaaaaaaataaaataaacaaacaaaaaaaaaaaaaaaacaataaatataaacaaaaaaaaaaaacacataaaaatcatacaatacctatcatcaatccacacaactagtatctgcacagcgcggcaacggagatatgaccgtattgtacaataagtacgaatgggggataccctggcagggcgcgctcctccggacagtgatcagcaactgaagcccaggacgtcgtcaccacgcgcctcagaatcttgacatagacggtgggagagacggatgtatgaggatacgagaaacaatagtcagagccgctgtccgcggttcggcgcgaacagaaagtgcaaaaagactaacgaggtcgatgggatg

SEQ ID NO: 726477 - DNA, 148 bp, Homo sapiens
  misc_feature (40)..(40): n is a, c, g, or t
  misc_feature (46)..(46): n is a, c, g, or t
  misc_feature (131)..(131): n is a, c, g, or t
tacaggatgctgtagctcccactggtgccaggtctcctanctcagntgggattataggcatgagccatcacacacaagatgttaccccttttccagatcttagcatctcacagatgggccactgcaacagntttcccactggccccca

SEQ ID NO: 726478 - DNA, 2851 bp, Homo sapiens
aaggcggagcggtccctgcaacccggccggcgggagctgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacagcccccagccctgttctctgccctacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaaaaaaaaaaaaaaaaaaaataaaataaacaaacaaaaaaaaaaaaaaaacaataaatataaacaaaaaaaaaaaacacataaaaatcatacaatacctatcatcaatccacacaactagtatctgcacagcgcggcaacggagatatgaccgtattgtacaataagtacgaatgggggataccctggcagggcgcgctcctccggacagtgatcagcaactgaagcccaggacgtcgtcaccacgcgcctcagaatcttgacatagacggtgggagagacggatgtatgaggatacgagaaacaatagtcagagccgctgtccgcggttcggcgcgaacagaaagtgcaaaaagactaacgaggtcgatgggatg

SEQ ID NO: 726479 - DNA, 1234 bp, Homo sapiens
gctccttcaacttccggcaccgagctacttggacgcttggcgacagtgaatcgagaatagccagtgcattcttgtctctggtgctacatccgtccatgcgtggacagagccgtgtgcgtgccgtggtcgcacatgtctcacctggcatgaggatcgccctagggcagattgctgaccagaagacagatacttgcaccaccaatgagatgcagtgatcagcccaatcattcaggacctagattcagcccgcgcaatgcttgggttgacgtttcggccctttcgaggctattgaccagtcatgctaggcaagaggccaggtcccaataggcaagcaatatcttcttctctccagtcgagcatcagcatggcgagcgcttagcgaagatgcgtacttccaccattggggtggatcgaaggatttgaggcgtcactgattgaaagtccgtaggaaggagtctgagattgtccggatcgtcgtactggtaggatacccaggcaggctgcaagtatcctacttgcaaaggggctttaccatggtagccttccattccggttaccgccctcaaatgcgatggctaaggactgaagaacaagaacgtcccaagtgtatgatccgacgccgggcaagagtgggcccattggttaccgtccaaggtgcagggagccattaggagaggatacggctgggaaatagaggctggtatatgggacgtggaagctggtttgagtacacttggtttgatattccacgacccctcaagtaatgacccattttccagcttgtgtcgaattcttttccgtgcggggaacgagacccgcacgttgaacgagcgtcccaattcattggtctcaggtactctaggcctgaaagtcttagcgattggcaacgtacgctagtgctcaccgtccataaggggggacatatacattacgctcgagggagttaactgcgtccaacagagagcagtgctttagcacggagtaggtaacaccctagtattacagcgaccatactggggttgcaaaaattggatcaacctcgtgttcacttttgacgacagggccatgatgtggtgtcactgaaagtcacacccttggtgcaacagaatcaggggacaacaagccgaagtgaggaaagaagcgatccatggccaaacggatgtggtacccctagtggcttgggaacccgcacaccgtgtgacacgtgtggtggcgcctcagtacgttgtaacgg

SEQ ID NO: 726480 - DNA, 782 bp, Homo sapiens
gactctgggcaggatccagacctgtcgctccagctgctcttgtagagtccacagtataccccgtaagccatggcaagcaaagggcttgcgggacctgaaatgcaacagtgggggagcgggagaccgtccatagaagcctgtggtcaggctgtccgggagcgatcagctcacgtcagagtagggtgaaccatggaccatcagaggcgtgtgggcaagaaaaagcccattggggccaagactgactccacaggacaccaccacaagagtacataatcaatccgatagagactttggataaagtcaagagccttagtgaggggcacttactctgaggagagattgggcgaaaagataagttgacggcgccttccattgaaaattagtacttcgcatgagagctgacttttgggagtcggcgcctcccttgaaagtagcaccagtagaggaagaacttgggtggtgacctcgctctttactagtccgggtataacatagtcatatgtctagtccccttggtctccggggaatatagccatacttcttggatcttggccccccttcatgttagacacttctctagggttcttccgagtaacattaccatatattgtcctttatagtgtcatgggctttattttcactttactcatacactgtttcccaatgttccaatctggtacttggttaaccattgttgccaaagaatagcacaaagaaaaccactttacaaccttcaaatttagcgaaaaaaaactcctctttggcaagaaaagggggcccaa

SEQ ID NO: 726481 - DNA, 621 bp, Homo sapiens
  misc_feature (31)..(31): n is a, c, g, or t
  misc_feature (47)..(47): n is a, c, g, or t
cggcacgaggcaggccctggactcctacccnggtggtgagggctcgntagggcctcggcgtgggggacgagcaggcctggcgtgcccgcctcgcggggtcatcgacccaaaaggcgtcgcattttctctgagagcgggtctttcccttatggcggatttagggaaggaggtttgggaaggggagttcagtttagcacctggaggaggttggaacctgaaagagaagacggtctggctgctcacataaatccctctgccctgtcagcctgagtaaaggagaagggggtcaagtttgggaaggacgcccggtccttacagccggaggtcttacgtgtgtgtgtcttttgttgaggtgaatctgattaacgagcccctggtgatatttgtttgtgcaactacaggccaaggagacccccctgacaacatgaaggtaaggctggcctgatgtggctcctcagatccctgccctcgaccctcaccccgttttcattgcctggcgtctaggtgcagtaaatagctctcctttatctcatgcaccttcagaggtggatttgagagaacgtccgtgagtggggctgggggctccggttgccctctctaataaactcgtcgtagccacca

SEQ ID NO: 726482 - DNA, 2726 bp, Homo sapiens
aaggcggagcggtccctgcaacccggccggcgggagctgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggagcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaaaaaaaaaaaaaaaaaaaataaaataaacaaacaaaaaaaaaaaaaaaacaataaatataaacaaaaaaaaaaaacacataaaaatcatacaatacctatcatcaatccacacaactagtatctgcacagcgcggcaacggagatatgaccgtattgtacaataagtacgaatgggggataccctggcagggcgcgctcctccggacagtgatcagcaactgaagcccaggacgtcgtcaccacgcgcctcagaatcttgacatagacggtgggagagacggatgtatgaggatacgagaaacaatagtcagagccgctgtccgcggttcggcgcgaacagaaagtgcaaaaagactaacgaggtcgatgggatg

SEQ ID NO: 726483 - DNA, 2958 bp, Homo sapiens
  misc_feature (31)..(31): n is a, c, g, or t
  misc_feature (47)..(47): n is a, c, g, or t
cggcacgaggcaggccctggactcctacccnggtggtgagggctcgntagggcctcggcgtgggggacgagcaggcctggcgtgcccgcctcgcggggtcatcgacccaaaaggcgtcgcattttctctgagagcgggtctttcccttatggcggatttagggaaggaggtttgggaaggggagttcagtttagcacctggaggaggttggaacctgaaagagaagacggtctggctgctcacataaatccctctgccctgtcagcctgagtaaaggagaagggggtcaagtttgggaaggacgcccggtccttacagccggaggtcttacgtgtgtgtgtcttttgttgaggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaaaaaaaaaaaaaaaaaaaataaaataaacaaacaaaaaaaaaaaaaaaacaataaatataaacaaaaaaaaaaaacacataaaaatcatacaatacctatcatcaatccacacaactagtatctgcacagcgcggcaacggagatatgaccgtattgtacaataagtacgaatgggggataccctggcagggcgcgctcctccggacagtgatcagcaactgaagcccaggacgtcgtcaccacgcgcctcagaatcttgacatagacggtgggagagacggatgtatgaggatacgagaaacaatagtcagagccgctgtccgcggttcggcgcgaacagaaagtgcaaaaagactaacgaggtcgatgggatg

SEQ ID NO: 726484 - DNA, 118 bp, Homo sapiens
aagatttttcctagtgtcaaagagctgtcctcttcggactaacagttaaatttacaaggggatttagagggttctggtgggcaatttaaaagttggaactaagattctatacttggac

SEQ ID NO: 726485 - DNA, 798 bp, Homo sapiens
agcgggggaggcggagcttgcagtgagctgagatcgcgccactgcactccagccaggcgacagagccagactccgtctcaaaaaaaaaaaaaaaagattcagtgaagctaatttcccatacccatcacctcaccacatggtcatcccaaaagtgggacttgatccctttaggagtgctggtcctatggcttgtggaaagggatggagacatttggttgcatttttcacccattttcacagtacatataaatcattctgtggggaaaaaaatggcagatgatagaccaccgtgtgctatggtagaagccagagggtgctcaagggtcttcagccaccatctggtgcattctctgccagtcatagaactttaggagttacacagtacgatagtaaagaacatctgggtcaagggtcacttcatcatggatttagtaattccatctgatcattcctaacggtcttatagggtaaggtgatatgtgaaaacattttgactttgacttgcttattggaggctaagttatacagttccactttgtggtaaactgcaactacttcatcaaggaaggatataaggaattccaaaaccgaggattctagctgaggggtttaatagtattagtagatacggatagggtgggcaaaacatttcgggaagacttcatgccacaatacattggacatggaaatatgtagcgcttctacctaggtacatgcggggaccaggaacctagtactgggataacctgatttaaacagaaacctttaagaataagggtcccgatccggggtaccata

SEQ ID NO: 726486 - DNA, 1120 bp, Homo sapiens
  misc_feature (225)..(225): n is a, c, g, or t
  misc_feature (245)..(245): n is a, c, g, or t
  misc_feature (283)..(283): n is a, c, g, or t
  misc_feature (378)..(378): n is a, c, g, or t
  misc_feature (418)..(418): n is a, c, g, or t
  misc_feature (424)..(425): n is a, c, g, or t
  misc_feature (428)..(428): n is a, c, g, or t
  misc_feature (467)..(467): n is a, c, g, or t
  misc_feature (469)..(469): n is a, c, g, or t
  misc_feature (475)..(475): n is a, c, g, or t
  misc_feature (477)..(477): n is a, c, g, or t
cttcgtctgtgccgtctgcctcaagcagctcaacaatgggcaccttcaagggagcagaacgacaagccttactgtcagaactgcttcctcaagctcttctgctaggtgccctgcccctgtctctgccccccattccccagcacatgcatccccaactgcgacgtgtgaccgtagagacttcacccgggggtgaaggggtaaacccgactgaaactggaacccttntcctccgctggtgcgggatngacagagggccatgaggggtccccctgcttgtcttcanccctgccagagcctctgggccccctcctccctcctgtagctctccctaggctgcccactctccatcctccccagggtagaggctgggggctccancccagcccatgtacgtccccacagaactggcctggccagnaccccnncantgagccatctcttcctcatatttcagcagtgcagccggngnggcagngnaacgggcaggcaggggtctgctagaggtgtcgtcgttgtttagtcctgtattgcctaccctcgcgatcctagacttgtcttctgcttctgctgaattcatttggtggggacaccacgagctcccatccagcacctaatgccatggccatacaatttccagtcccatccaagaggacgagagacaccacaaagcgaggtccatgtgcaacggttcctctgttgcttcctcgctacacacttcgcagtgtccgctaggccctgcgcgacgtgcacacctgcccttctctagcacccgtcctcatcccccttattataacctcgcgtcttgattcttcactgcacgaacacgcctctccagccaactaactgtctatccctacgtcacattccctccgtccttccgcggcacacgctgttgcctgcgacacctgtacccgcacctactcactacattttcttaccacctgcaggctttgcacattccattacttcgccctgagctttgccattctacgtatcctctataccaacacatgacttcttgacacgcacgattctaacacgaccttcccctttggtacttctcctttcccctcctccaccggccctggggcctgtcactccctggcggccctggtgtcac

SEQ ID NO: 726487 - DNA, 750 bp, Homo sapiens
  misc_feature (225)..(225): n is a, c, g, or t
  misc_feature (245)..(245): n is a, c, g, or t
  misc_feature (283)..(283): n is a, c, g, or t
  misc_feature (378)..(378): n is a, c, g, or t
  misc_feature (418)..(418): n is a, c, g, or t
  misc_feature (424)..(425): n is a, c, g, or t
  misc_feature (428)..(428): n is a, c, g, or t
  misc_feature (467)..(467): n is a, c, g, or t
  misc_feature (469)..(469): n is a, c, g, or t
  misc_feature (475)..(475): n is a, c, g, or t
  misc_feature (477)..(477): n is a, c, g, or t
cttcgtctgtgccgtctgcctcaagcagctcaacaatgggcaccttcaagggagcagaacgacaagccttactgtcagaactgcttcctcaagctcttctgctaggtgccctgcccctgtctctgccccccattccccagcacatgcatccccaactgcgacgtgtgaccgtagagacttcacccgggggtgaaggggtaaacccgactgaaactggaacccttntcctccgctggtgcgggatngacagagggccatgaggggtccccctgcttgtcttcanccctgccagagcctctgggccccctcctccctcctgtagctctccctaggctgcccactctccatcctccccagggtagaggctgggggctccancccagcccatgtacgtccccacagaactggcctggccagnaccccnncantgagccatctcttcctcatatttcagcagtgcagccggngnggcagngnaacgggcaggcaggggtctgttggggtctcttctttatccttatatcctcccaccgagctaattgtcttagtggctcgtgactctatgggggagacacccgggtcccgtccagaaaatgccagcataaatccatccatccaaaggcagagaacccacaggggcaagggaagggttcccgggctcctagcgtaacctttcaagtgccctaaggactgcggaaatggcgccggcctttaaaaccggcctctcccacttaaaacgggctggacaaa

SEQ ID NO: 726488 - DNA, 149 bp, Homo sapiens
cggaatcgatggatggtggtctctagagtctccaatcattggttacgatagtcacgcggacccaaccaagtagtctgcatctgccaacattgctcagaccagaagttatgacttcaagcactgatgccacagttttgaagatgagctta

SEQ ID NO: 726489 - DNA, 225 bp, Homo sapiens
tagctgttcagaggatcccgtccactgttcgactctgtaattcgaaaaataatgttagtaaataatcttaccttaaaatgttagtcaaagatagttttgtctctcccctcattttttttttttggccttggtttggtttttttccctgaaaagtctcaggtattaacccggatcggtaagtttccttcactaagtattttggaagcttaataataaatgaagtgt

SEQ ID NO: 726490 - DNA, 215 bp, Homo sapiens
ttacaaccccacgatcactcacaaccccaccatcacagccaccatcaccctccttaacctctacttctacctacgcctattttacaccaagccccgtgatcgtggggttgtaattacaaccccacgatcactcttcccctataaggggaaataaaataaacattctttagctagttgcttggcaataggtattcgtggtgtgttgaattcaacta

SEQ ID NO: 726491 - DNA, 914 bp, Homo sapiens
ttgtgtaggctggatgtgagtcggacgagtgtggtagctagagtgtagctatacgcctagtgctgaagagtgatccatgatttggaaacgggagctgctgctggcgagtggaatggctgcaccggtttgaggagagcctggtccccactctcaatggagaggtgtgaaagcctgggtggacatttattcccagctacagcaggaggtaggggcggctggtggggagcttgagcccaagacccggggatcgctgactggccggctgatagaagtgctgagaaccctcggttcaacagtttggtcgtttctctgtgtcggagtaacgtcatgactcgtccagagtactgaagcactcacgaccacagttccagcgctggatgttcgcattcctcgttgggacttgagtgttcctgtggggctcccagaccaatgcctcctgctgtgtcaggtgccgacatgtgtgaccagagacagcagtgcgcgggagcttgagtgtgcctcagcggtccttgggtgctggaagcagacaagcacctggagaaactcatcacacaacgactgtgcccttggagacacagcattccctgggaacgtgctgctctgccctgttcaagaacctgcttctcaagaagatcaagcggtgtgagcggaagggcactgagtctgtcacagaggagaagtgcgctgtgctcttctctgccagcttcacacttggccccggaaatccccatccagctccaggccttttctctgcccctggtggtcatcagtccatggaaaacaagagaaacaaatgccaaagccaatatcctggtgggacaatgccttctctgagatggaccggtgctctttgtggtgcctgagcggtgccctggggagagcatggtgaaccccttgaaccggagttcatggtg

SEQ ID NO: 726492 - DNA, 192 bp, Homo sapiens
tgctcagatgttgcccttgcacagctgagtcggctgactgtgcagacaacacggaactgttgcaaaattggtaactaacaaatgcttggatggttaatcacagggtcagttggttgaagagagtccttgcttttctttctttcttttttttccctttttttcggaaacacgtcgtcgcttcacacgtcgtgc

SEQ ID NO: 726493 - DNA, 640 bp, Homo sapiens
  misc_feature (1)..(1): n is a, c, g, or t
ntggtgtggtgtgtagatgcccccaacgaatgaacagcatggggggcaaggcatcccgttcttgcttaaaagaggtagtgggtagtgaccatcgcaaggtgcttcatggactcccatggcgctcgccccaacatagcgcgaccagtggtgtatttgtagtggcagcgccgctcccctctcgcccgtgttgaaggctagcgcttctgttggagattatgtagcagagcgatcgccacaccgtggctatcttctcttcccccggaggaagacctctttcttagcgaggtctaaagcaaatagagttgaccaaacgttcgaattcatggtcttcccttggggcagacgggtacaataaaccattcataggaggtccgttgtttttgaggaagcgtggccagacccacaccggcctgttatctcctttaaggggacatcgcatctgggtagttctctccggtcgctctcccgcaagattgcccccggagacacctgctcgggctcctattagatacgccccgcttcattgttcggagcgaacatcacttcgaggagcgtcgtatttcgcccttgggcaaaggattatagctgtttttggattggcttgaaaaaacaaatgccgtttttaaccggaaacataaac

SEQ ID NO: 726494 - DNA, 231 bp, Homo sapiens
ttagatgaaaggcacacgctactccgcctggcttatttcaaaaaatcaggctggacacggtggcttacgcctgtaatcccagcaagttgggaggccgagaacggggcactgcttgagtctggcagttcaagaccagtctggacaacaaggcaaaaccccatctccacaaaaacaaatagaaaaattagctgggcatggtggtgcatacttgtaattccagctacttgggag

SEQ ID NO: 726495 - DNA, 1059 bp, Homo sapiens
tccaggtgcacggctgtggatggaagacaggcattggcctgtgcttcagcgaccagagatgggcatgtcagagctgcgagctgggggctcttttcctggtcattgccgtgcggtgctgtagtggcaaatgttcccagatttaactatagggggcggtccagggctgtgtgagtgtgtctttctgtcgtctactggcgctcgcggccgcgtgacgtattgtgctcgaaggatctgtcccgttcgcaggcagtcgccctcctcgcgctagctcgctggatccccctactaggtcggtctggtgccttgtccgctgtcgtcaaccgcctcgccctcctagggctctgatgcctctcgaagtggaccccagcgccattgcacgagaacgggggcctctgggtgcggctcgtctcacgctgtctcctatgcaccttgttcccttttattgtccagcccattgccgtcgttgcccctgcggcatgggccttccgcgtgcgtccgtctagggcccaccctcgcgtgtcgtcctggtcgtggtacagggccccttgctgatgtgtgccccttgcttctcttgccacctggggtccattccgccttcttgcgacagggtccccactctcgtgtcaccagggccagaggtggcgccttaggagccctggaagaatgcatcctctgctcacacctccggcccgagcttctggcagcgggttcagtcaccgggcacggagggactcggtgcccggcgacttgacgatacttgcaagacgccagcgcttgctccccggctccttgcggaataaggtgcccacatggaaccttccggccctggatgatccaggaagcaaaagcctggacctccaaagcccactgtgacaccctgccgacgcggggaaccacaacagcggcggggactacaagatacccccgggggccatcctcccccccacctttctcacacagcccataagaggcctaacccacacggcgcacacacaagcgccaccaaacaactccctctgggcccttcgggcacacccaccaacccggcacacgcatcta

SEQ ID NO: 726496 - DNA, 563 bp, Homo sapiens
gacatatccctaaccagaacaagagtgcccgtgcaggcatgctgtgggtgatcaggccacgtttccactcagatggagtggggcaagttccaaagactagtcttaccaagtcaagccaagtcaaaaccagaacaaaagtgccaatacaggcacaccgtgggtgatcaggccacgcttccactcacgtggagtggggcaggttccaaagactagtcttaccaagtcaagccaagtcaaaagcagaacaaagatgtcaatacaggcacaccgtgggtgatcaggccatgcttccactcacatggagtggggcaagtaccaaagactagtctggacaagcttcagatgtcgggactgcaagggccagttccttcccggtgtacagccagtgtcaatcctactcgggagccggctatgcgcggctctggcaaggcgttccaccgggggcatttcctacccgggagcgctctttggattgcgtcactcaggctggccggagtcctctgcagggacgctccacgggtctcacagggcttgtcagtcacctcgcttcctggttagggatg

SEQ ID NO: 726497 - DNA, 277 bp, Homo sapiens
  misc_feature (19)..(19): n is a, c, g, or t
  misc_feature (183)..(183): n is a, c, g, or t
gttcaagaccagcctgggnaacatagtgagatctctattgctaatttaaaaacaaaacgaaacaaaaaaagtttggcaccgtggctcacacctgtaatctcagcagtttgggaggccgaagtagggggatcacttcagcccaggagttagagaccagcctgagcaacatggcaaaaccctgtntctgcaaaaaagtacaaaatttagcagggcgtggtggtatgcgcctgtagtcccagctactcaggagactgaggtgggaggttcacttgagccc

SEQ ID NO: 726498 - DNA, 425 bp, Homo sapiens
gtcttgtaaggtaggttgatgggtaacaaattccttcaggcattggcgtatatcctaaaagaatgcattttgccttgtattacaaagtttagttaggcgatatatggaatggctggttgaaatttcttttgggaaggagtgtgataataggcctccaaactcttctggttggtacagtttctgcggacagggtctggtgtaagccggatggagttcccagtggtaagtgatctgccccttctctctagctgtctttaagattttttctttcatgctgacctaggagaatctgacgactacgtgtctgggggatgatcgtcatgcatagtatctcacaggggtttactgaattgcttgaatttgcatgtggcctcggtagcaagattggaacaaatttggtgaaccgtatcctgaaatatgtgatc

SEQ ID NO: 726499 - DNA, 286 bp, Homo sapiens
  misc_feature (124)..(124): n is a, c, g, or t
ctgccctataatcgacatggccagtgcctgggcaaagagggcccgaggaaacgttttcatgtaccatgctcctgaaaactacggccatggcagcctggagctgctggcggatgttcagtttgcnttggggcttcccttctacccagcctatgaggggcagttttttttggaggagaagagcctgtcgctgaaaataatgcagtacttttcccacttcatcagatcaggaaatcccaactacccttatgagttctcacggaaagtacccacatttgcaaccccctgg

SEQ ID NO: 726500 - DNA, 296 bp, Homo sapiens
tgactctagacgatccccctaggtggaaacgcgacgttaggtggagtacgtggaatacaggtcaacgggcagagctcttggcccctgtggggcagggcgaggcatggcagatagagtacgtgggatacagtgtcacgggcagagttcttggcctcaatgatgcctcctgatctatcgctgggcctggacgaccaacactgggatgatgacgagcagaatggtcatgaagatgcccaaaatcagggcccagatgttcaggcacttggcggtggcggcataggcctgggccccggttc

SEQ ID NO: 726501 - DNA, 112 bp, Homo sapiens
tcagccatgtgaatatgcagtatcctaccacacttgcctctttctggctcgaattgcctctttctgattattccccattaattatcagatgcagctctctgtctctgacgct

SEQ ID NO: 726502 - DNA, 872 bp, Homo sapiens
  misc_feature (320)..(320): n is a, c, g, or t
  misc_feature (342)..(342): n is a, c, g, or t
  misc_feature (429)..(429): n is a, c, g, or t
tcaccgaaggtgagggatcatgatctgtaggtgtaagctgggtagaagtatagtctattccatcgtatctcacagggcaagggaggtgaagtaaaatcataattagagtaagatgctgtaaatatatataattgatgtgaatcaaaaatttgaatcagtatcaaagatgactaattacaaatatgtaatgggagaaagtcagaaccggggaactctgattggaaatgtacccttctagacacagttgtaaaggagccacatatatttctctgatagtttaatgtgccaagtatcagtatggccagcaaatgggtagcttngtgataataagataaacccttntacgtgccactgcaaactctttatgaggtggcagggtagaaaaaccaactacctgttcatacatatacctccccaatagcttttatnggtatatattgtacaattgttaaaacattttacttcatttgatctccataaccacctttgaagtctgcaggctagataaggttactgttttgcagagggaaaaggagattcaaagaagtgacgtgacttgccaaatgcagcatgacacataagtgtagggcactctattttgagtcgaacagaactgggtccaaatcctagtcttgtcattttgtgaccttaaaaaaactgctgggtgtggtggctcacacctgtaatcccagcattttgggaggccaaggtgggcagatcacccgaggtcaggagttttgagagcagtctggccaacatggcaaaaccccgtctccactaaaatcacaaatattagccaggcatggtgcgggcgcctgcaatcccagctactcgggaggctgaggcaggagaatcgctcgaacccaggaggt

SEQ ID NO: 726503 - DNA, 148 bp, Homo sapiens
acagtcagcagaactggtatctaaacgtgcagtaagattctgctgctatttgggttagtgggttattgacttaaggccattcattataacttattttgagactcgaccccaaactctaaatagagattaaaacatacaatccgttgag

SEQ ID NO: 726504 - DNA, 404 bp, Homo sapiens
  misc_feature (23)..(23): n is a, c, g, or t
  misc_feature (107)..(107): n is a, c, g, or t
  misc_feature (403)..(404): n is a, c, g, or t
tcccccaccctcagccatccccnaaagcatgggtgaccccaattttgattttctagttaatgttttttccctaaagttatggaataggatttaaggtttaaagatgnaagaaagagcagggccttggcacaccttgccttatgccctgtaatcacagcactttggaagactaaggtggttggatcacttgaggtcaggagtttgagaccagcgtggccaacatgatgaaacccggtctccactaaaaatacaaaaattagccaggcatggtgatgtgtgcctgtaatcccagctacttgggaggctgaggcaggagagtcacttgaacccaggaaatggaggttgcagtgagccaaaatcccacaactgcactcctgggtgacagagcaaaactccatctaann

SEQ ID NO: 726505 - DNA, 950 bp, Homo sapiens
  misc_feature (26)..(26): n is a, c, g, or t
  misc_feature (116)..(119): n is a, c, g, or t
  misc_feature (138)..(138): n is a, c, g, or t
  misc_feature (156)..(156): n is a, c, g, or t
  misc_feature (162)..(163): n is a, c, g, or t
  misc_feature (189)..(189): n is a, c, g, or t
  misc_feature (198)..(198): n is a, c, g, or t
  misc_feature (267)..(267): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (290)..(290): n is a, c, g, or t
  misc_feature (294)..(294): n is a, c, g, or t
  misc_feature (299)..(299): n is a, c, g, or t
  misc_feature (361)..(361): n is a, c, g, or t
  misc_feature (368)..(368): n is a, c, g, or t
  misc_feature (387)..(388): n is a, c, g, or t
  misc_feature (400)..(400): n is a, c, g, or t
  misc_feature (407)..(408): n is a, c, g, or t
  misc_feature (419)..(419): n is a, c, g, or t
  misc_feature (422)..(422): n is a, c, g, or t
  misc_feature (425)..(425): n is a, c, g, or t
  misc_feature (431)..(431): n is a, c, g, or t
  misc_feature (435)..(435): n is a, c, g, or t
  misc_feature (437)..(440): n is a, c, g, or t
  misc_feature (466)..(466): n is a, c, g, or t
  misc_feature (470)..(470): n is a, c, g, or t
  misc_feature (474)..(474): n is a, c, g, or t
  misc_feature (480)..(480): n is a, c, g, or t
  misc_feature (489)..(489): n is a, c, g, or t
  misc_feature (526)..(526): n is a, c, g, or t
  misc_feature (647)..(647): n is a, c, g, or t
  misc_feature (652)..(652): n is a, c, g, or t
  misc_feature (825)..(825): n is a, c, g, or t
  misc_feature (874)..(874): n is a, c, g, or t
  misc_feature (886)..(886): n is a, c, g, or t
  misc_feature (937)..(937): n is a, c, g, or t
aagatactggataaatatcttaatantcgaacagtaaagctctaatacagtacaaacattttaccattatgtttgccaataattaagcaaactgagcatcataagaatgagcgtgnnnngtaaaattactggaaagtntaattcactagaaatganaaattnnacatttgtcatattatcctgtatttntctactacntttttctggcagaatgactccttgctgaaaaaaatggcttaaagtaggtgcttttttaatggttttgcnaattctggngancagggnctgcntctncctanacaagatccccggtcttgctattagtctagaatagtgaatatatatttaataaatgcttgtngagtganccaatatgtgaatggtttnnttagtggatttntattaanngggggggaggngtnggngtgtcnatgnannnngagcatttttactttcaaataagggnggcnattnattgtngtgaaattncattgaagttttatatatgacccccaatgcatataanatcatttacctccacattataggataggatatcatgaactacaaagatactcaaagtgctatagatgagttaatattgatgtaatacattttcattaatctacccacatttaattggatgnttganagggcacgttgaagtgtttttcatgatttttgctacggccccagcttttactggagtttttaatgcctttgatgactccagacactcaactctgttccttgcagtctgtttctttcttctatggtggtgattagttattgcaagactgcttatatagagtaatatatagtttntctggtatggagtaacttataccagagttttaacattctccctaatggngtttgtggaggngtgaaattggcgtgtcattgaggcacattaaaaagcgagatatttttaacnctaacaagagaaa

SEQ ID NO: 726506 - DNA, 408 bp, Homo sapiens
ttgttggcgatcactgtactatatgcctgttttcaatctacctgagcattgtggtatttttttaatctacttttttttttaagaggtgagggtcttgctatattgctcaggctgacatcaaactcctggactcaagcactctttctgcctcagcctcctcagtagctgggtattatggtatgtgtacatatatacttttagagacagggtctcgttctgttgtccaggctggactacagtggtataatcatggctcactgcagcctccaacacctgggctcaagcaatcctcccacctcagcctcctgagtagctagggactacaggcgtgtgccaccatgcctaatctttttttttttttttggagagggagtctcgctctgtcacccaggcgggagtacagtgatc

SEQ ID NO: 726507 - DNA, 235 bp, Homo sapiens
cgagtggtcggggctgtgcatcacaccaagggtgatccagcggcaccactccaagcacagcggggtcccagtgcacgtgcccaccattcacacggtccagggccgcaagcgcagcaaacctcctcccagccagcatccggcttgcccagcaaagcagcagccagccagggcaagtggcagccccttcaaagccagcccaggcattcagtgcccccaccagctcgaacaggggggt

SEQ ID NO: 726508 - DNA, 1394 bp, Homo sapiens
  misc_feature (431)..(431): n is a, c, g, or t
  misc_feature (639)..(639): n is a, c, g, or t
gcctgtgcatcacactgatcatgctctatccaagaactaccgtgtgtcgctgcaggatgtaatacacctaggatcatatcgcatatcattcacctatcagaagcgatcgactggtactcaagggtctgagtgtcactacctatgcacaacagggtgcccacaccgacaaggaatgcatagctgtacatgcctgacctgttcattctctgtgtgccgctgttatcagatgcctcgctctagcatcgtatgcatgtacggatggatggcggaactgaccataaattggtgcggcaatgctgggaggcaggggtctactaatgacgcgcatgcgagagtattccatgatgcctccttgatgtcatagcttctctcagtgtgtggtgtttggcagcagagaatatgtaatcgtacgtattcacgcgaaccagagntattcctgcatgcatagctacgtactgtcccatcgactacttgctcgtctttgcagtacacatcatcgtccgagtgggcttgcgccccacgaaagccccatgtgccgtgtctctatccgttatccttcgtcacctattggagaccgtccttgggggcactcacaagtttaaaggcatcaagaaatacattgtactcaaacggtgggcnaaactatagcacatgcagctaagtgtgaataccaggggacgtggggaaaacatgggaaatacctacgcaaggtgagacgacgacgaacaggcccagtgcccagcgttcgcaaaccccattcgtaaaccgtttgtaaacgtccttttcatttctcgttactgaaccacaaaggggacttggttcggcggctcctcggttggccccagaacgtggacagcgcgttggtctgcaacggccccttctatttccttactctctacaagtttacaggctaatggggggctgccaagtttcccatttagaacatctagggacagtgggttcgcggccacaagaagcacacctccaggatgcacacaaaggggaagaggaatcacccgtaagtatgatatggcccgcctctctcggtggagaatcgaaaccccttggtgggcggagttacaccacctgaaggtctgtttccaaccttagcggaaaaatcctttaacgaaacagcttaagctttaacacaaaaggaaaaggttcttacagtcattagtcgaacaatagccctactttgggttcaccatctgcgagagacagtccttcaccttggtacgcggcctaaactcgaactgcggtcggcggcagagaagtcgccacacagctccctagctggggactctccggtgacctcggttttgcaccatcttgcctcttctaaacgcagagtcttctaggccgcgacaggcacactccccatggcgggcaagaat

SEQ ID NO: 726509 - DNA, 185 bp, Homo sapiens
  misc_feature (103)..(104): n is a, c, g, or t
tggtctcgttgtagtttagatacaggtgggcctggatttcaaaggtgttctgaggtgtctttctggttaggggttcgtgaacttatgagtctttattttcctnngatggttcaacacagcgttcccttgatggtccttgatcaggcagcgagaccccgcatccctgtggcatgaccccatcattc

SEQ ID NO: 726510 - DNA, 795 bp, Homo sapiens
tctgcttgagccagacccgttcctcctctgaccttgtctgttccagccatgggacatcgagccctcctgtgctatacgctgctccccttcccccacagtgggggacctgaggttatggggaaacaggcgggacaatactcttttgtggccgaggaattgaatatctaatccaatatgtggggtcttcctttggtcagggtcctgcgtgcgagttagtgtgggtccatcggggctctactgcctcctgcccattactgctcctagtcgtgacgcccctactgtcagcccatgtcattctgccatttagcgagcctacgcaagtgttaatagttactgaagatcggaaagtatcgaacgggggtcaatgcatagacctctcctgcagcccagtgcacacagctgatcagcgagagaggctgtcagcggaggaagcgccttgttgactgggagcaaccttctctcttgccgttacctgcagagagggactatgccctgaccccgtccatttctgaaaagtcagtgcaccgtcccgtgttgctctaaggaggctcctgcataggcattggatagaagacagaaattcgatctgccgtgtcccatttttcgccctggggatttgacagcagcaggcatcatctcagcaatgagctggagcagtgacccaggtggagcagtgaccaggacgcctctggcccagtgctgcacagcctccacgcccgctcccaggcgccccatgtcctcacaggccaggacgccatggcaggatggagagacttggtgatttttgtgtcttta

SEQ ID NO: 726511 - DNA, 293 bp, Homo sapiens
tgcaactgtgaaagaaacaagacataaaaggccacatattgtatgattccatttaatatgaaatgtataaaataagcaaatccacagatacagaaaataaattagtaattgcagcttgttgagaatgcctaaacgagcattttcatcttgtgcctatctgttggctcatttcacactctggggtatgggttaaacaaactggcttgatggcctgtggcgcgaccctgctctgggggaccatgtgccagtgtggcggagtttgacttgggggcggcaccaccttgtcaaactgg

SEQ ID NO: 726512 - DNA, 389 bp, Homo sapiens
agtccttagagaaaaggcttcagttgatgttagctgtaggttgtcatatatggcccttatttagaggtatgttccttttataccaagttttgacagagggtttttatcaaaaagcaatgaattttatcaaatgcttttcagcatctattgaaataatcatatggtgtttgttcttgattatattaatgtgatatatcacatttattgatttgcatatgttgaaccatccttgcatccctggagtgaatcccacttgatcatggtgaatgatctttttaatgtgttgttgaattcagtttgctagtgtttcattgagaatttttgcacctatgctcatcagtgatgtaggtctgtagttttctttttattttgtatcctagtctagtttg

SEQ ID NO: 726513 - DNA, 196 bp, Homo sapiens
  misc_feature (11)..(12): n is a, c, g, or t
ggtcaggcacnntgaaagcgggcgatagagccagactctctctcagagaaagactctgtctcaaaaaaaaaaaaaaaaaaaaaaaaaaaaaaaagggaaaaaaattatttttttatttttttgggggtatttaaacccggttgtttaaaaaaaaataattttttttttaaattttaggaacttttaaaaaattgtt

SEQ ID NO: 726514 - DNA, 280 bp, Homo sapiens
agctgatcgcttacgcccacgggactattccacataaggttaaacaaactaggtgcttgtacctaatctattacaatttactctatcgcatttctgtaacatgaaatggcatgtcctccttcagagagaagactgtggtcaagttaaaaaaaaaaaacaatattaaacaccatgaaactgcagtctgtttttgaacatgagaatgtcttctgtatagaaccacagccttctgtccttgtgacaggttattttaaagcctgatgtcctccgaagcaaccca

SEQ ID NO: 726515 - DNA, 772 bp, Homo sapiens
tctatcccaaatacggattctttcttctttctttggcaggaaggcactttgctatgcctagcccccaccaggtagtggtattctccatggaatgtgtgggcttttccaaagctctttcagccatcagttctcatagccctcccagtcttgcaggcaagatatgagctttagaaataggcttttatcattcagcttgctttgtgttgttttgaggggttggggtacagtgggacagttttattttgtttggcatttatagaaaattgagaagtttcctttgatcaagccatatttttgatttaaaacaatgattagcagtttagaaaactatctctgctattttattctgcttttaaattctttgttttttatatttctgtcccttagactttaacattttaaagtgtgtaaaaataaaacactgtcagtgctaatcatagaaaatcagactatggcttgaaatgactagaaaaacatttcaaattaggctgctttatgatttgcatattatgattccggccattggagtttttggatttctaagtgttcataataccatgaaaagtaaatattttaaacaattgtatccccgtttaaaaactttctaatgttaaaactgtatttttttcatgtattagcccatgtgtgataatcttagttttccaattatggagggcatgaggagtagctttatttttaatacatagtacttgaaaacttatttcattctatattggtgttgaataaattgaaaatgttaaatgtttttccg

SEQ ID NO: 726516 - DNA, 104 bp, Homo sapiens
tactagtactgtcactatttgatggaatcgctacagtgctcctggtgctgaagggcttagggatacaggtggaccgctaaattgcctcggaggtgtgtgaggac

SEQ ID NO: 726517 - DNA, 459 bp, Homo sapiens
gaggctgatctagaggatcccgacagtggtgtgatctcagcacactgtaacctctacctcccaggttcaagtgattctccggcctcagcctcccgagtagctgggactacaggtgtccaccaccacacctggctatttttttttttttttggtattttaagtagagatggaagagacagagtttcaccatgtgggccaggcgggttccaaaccccagacctctctccccaaactaagtgataatggaggtgtgttactttccctccccgggtgatgtgcaaagagattgaaaggggaaagggggccaggaaggagatgtattttctccttcattcattcaacagctaatctggagtaccaccggtgtccaaggcactaaccaagatgccgggaacacataaagaacaggtagacaaagactccaacccttaatcatggagttaatcccagtgggacgag

SEQ ID NO: 726518 - DNA, 183 bp, Homo sapiens
tgatgccttccccattccctctgactacagtagtacagagaaagggcccctctgagtgaggctgcaggcggtgctggccaagcaggttcgtgtgactgaacgtgagccgctgactcagaatcagaggacatcctagtggcagcatagcgaggtatgggcagagagtattggggcatgccatgc

SEQ ID NO: 726519 - DNA, 152 bp, Homo sapiens
  misc_feature (42)..(42): n is a, c, g, or t
  misc_feature (125)..(125): n is a, c, g, or t
caatggtgggcagttgctcttacatgagctaagtttgagacnctgaggccctctttggtcctcgctttgggtgggcccaaggtctggggacccctgtcttggactggtgggagactcaaccctcnatccttgccaggcctctcccctgcagg

SEQ ID NO: 726520 - DNA, 139 bp, Homo sapiens
tggctgagtcaacacatttttattaaacccctgaagttacggggagggggccatgaggctggacccactggcaaagccaattttttccacaaggttctggggttaaaggctcttttttgggctacaaatgaaaatctgc

SEQ ID NO: 726521 - DNA, 424 bp, Homo sapiens
ctggagtcttgctatgttgcccagcctggtcttgaactcctggcctcaattgattctttcaccttggccttccaaagcattgggattacaggtgtgagcaccaccacgcctgacctccttttttagaaaaacagcaatcctaggccgggcacggtagctcatgcctgtaatcccagcactttgggaggccaaagcgggcaattcacaaggtcaagaaatcgagaccatcctgcccaacgtggtaaacattttttgtaaaaatacaaaaattaactgggtgtgctggagcgcgcctgtagtcccagctacttgggaggctgaggcaggagaatcacttgaacctgggaggcagaggttgcagtgagccaggatcatgccactgcactccagcctggcgacagagtgagactgcacctcaaaaaaa

SEQ ID NO: 726522 - DNA, 336 bp, Homo sapiens
acgggcggcctactactactaaatccggggcggtcggaatggcctaaatggcctgaaaggtcatctggcaatgctgaccggacctttaaatcaccccaggtttccttttattccatggaaatgctatggaaataggtggtataccgtatttaggggataatggttagaaaaaaagtccggaccaggtccgttccagatgcccctggagtttttctttggaataattttttatctcaggaccgagcccccaaatgcagaattcatagatacagagggccaactgttcttggaatttgggttgaaagctgttaaagttcttttcagccaaaaagtcga

SEQ ID NO: 726523 - DNA, 1068 bp, Homo sapiens
ctgaacaagagggagcatgggtgctgccgcctgcagtggaccctgccacccacctcccggggcctgcgcagcggcctctcgtctactgccaccatgacctgccaacggcacagcctgaggctggtgcatgatccatgttctggtcctcatcaactgctggcaacaatgtacctgactggcctgaggcgttctgggttcaaggtgaacgcgtcctgccagcagcctgaacgaagaagcagatctggacgctggatgcagccccctgacgagtgcgggcagctgcggccgtgtgcctgctgcagccacctgggcctgctacctgtgcggctggacaatggactggcaactgtgacctgcgagctgcgaggtgcccaggtccctgacttgcctgtttcctcatctgtggcgcactgacgacaggtcgctggtcgctgcatgtccgaggctgcaccggctgctacttcggcggcaccgaggaccgcctgtcctgcttcgcgcagacggtgtcccccgacgagaagtggagcgtgcacatcgccatgcaccctcaggtcaacatctacagcgtcaaccgtaagcgctacgcgcacctgagcgcgcggccgggcgacgagatccgccgtggaccgcgacagtgcctggggcgtcgactcgctcatcacctcgccttccaggaccagagctacagcgtgcagaaccgcgaacaacgtttcttgcgccacgagggcgctggtgggggcccgaagccggccctggtaccgctgagtccgatcggcaggcggcctcccgggacctggcaaggcagtaccttgagcacacggtgccagtggaacactaaggggtcatggccccacagtggggcacggaagcgcaaggcatgggacaagaagggcgagagcgtcgtgcgcgcagccccaacgaagagcacgcgccgggcagtcacctcccccgcggcaggccgcccggaacccaccggaacagcggacaacagtgcagacaacacaaacgacaaccagcagacacgccaaacgcagagggagcgcgcgcacacacacaacacagagagac

SEQ ID NO: 726524 - DNA, 963 bp, Homo sapiens
gtttgcgctattccttggggcctcgatctagaaaatagcaggaaccttgggcaccgttggccgggtctgcgagtccgggctgaagctttagcctcaatgagaccttctctgagctcgacgtgctaggacagcgtgtgatccaggtggatggagcatgctcgaggacattaggccctcgctcagcctccccattgttggcttcacgcaatgaaggctatcaaatcgctgtggcttgcttgtccttcattggtggcatcaggcgtctacttcagcagctcacgattgcacagtatgctcacaggtgagcacaggaaagggacgtgaagatcctgcataattaaatgctgccaaatggcacgagggcttgtccacatgtgacctgcgtagggttgggctcgccacgactcaaccttgttcaccttcaagcacgatgatcgacctagcgagcgcctggggcgcatggggtagaggtggtgtggagtgtccggccatgggctttggctccgctgtccagggcttgtggggaagcccttgtggggaagagcactggcattgtcacatcggacttgctctctgctctcccagcaccatgcgttcctcgcattgcgcttgcgatcgagaaagtattgtggtcgcaggcggccccccgaccgttggggttcctccgtgggtttatggggacgcgatgctagcccaatacttccttgaggggctgtatacgctgaggtgcgcggctcggtgctgggacggaccttgctggagctgactggcacacctccaatccctcgggccgctatctctttcaacctggccccccgtcaagggagggacccctctcttgttggggtggtggctctggcaggcgtgaggtggggcaaatccgaggcagatgcacttttccggtggacccctgggccgtttgaaaggcaggacggtgaagggcacgccgccgggggcctagaa

SEQ ID NO: 726525 - DNA, 375 bp, Homo sapiens
aacatctacaagtataaaagacagtccatggaaacatgacctcaccaaatgaactaaataaggcaccagggaacaatcctggagaaaccgagatatgtgatctttcagacagaattcaaaaaagctcttttgaggaaactgaaagaaattcaggataacacagagcaggaattcagaattctattagataaatttgataaattgaaatagttaaaaagaatcaagcagaaatttgggagctgaaaaatacaattggcatattgaagaatgcatcagtgtcttttactagcagaattgatcaagcagaagaaagaaatagtgagcaagctattgaaaatagggcaggctgtttgaaagtacgtagaggagacaaaa

SEQ ID NO: 726526 - DNA, 719 bp, Homo sapiens
acatgataaggacgctgcatgctgtaccactttggctggctggagtctctcagcttgtggggaccccgacttacccaccttatgttgcactagggtggttggcggtgaataagcgaggcccaaaagctggtcacctgtgcaaggtctccgcatgcagatacagcgtccatatgtgctacgttgcgtaccacacctgcgagcaggtgtcctcgtgatacgccaatcggagcctggcgtcctgatcggtgtgcccactgcatcagctcctctcaggaccttaccgcgtggggctgggccggcacaaactctacgttgcggattccggctcgctggcagtcagtgtctctaagattgttggtgcacaagggctggagatcgtccaatgcaaatctcacaaaggtgaacgacgattgccctgcatcaacactggctaaccccgatctccctcactcgacaagatccatgctggcctgcctccctcctgccggcactcattctacccaacatctaccccatgcatactgctcgacggtgctggggaaggctgcagagcaacggggctgttcctgatgtactgcatgtagggccggttgctggttgtggactatgccaactgttccagctctgcctggtggggcacgcatccgtgacaaagcctacgtcatgatctgtgctgggcgtgtgatgcgcgtgatctccatgttgccacggagactctg

SEQ ID NO: 726527 - DNA, 310 bp, Homo sapiens
aaagcgacggcgggtgaaccacaaggtcaggagttcgagactggccgggtcaatataggtgaccccctgtctctactagacatacaaaaaaactagccggacgtgatgactcaagcatatagtcccagctagtcgggaggctaaggcaggagaatcacttgaacccaggaggctggggattgcagtgagccgagactgcaccactgacactccagcctggccaatagagggcgactccgtctcaaaaaaaagacaacaaaaaaaaagaaaaattagtttaccaagcaattcccctttcatggattatacc

SEQ ID NO: 726528 - DNA, 125 bp, Homo sapiens
tccagttagatggttccactagatgtctactggtacattggcaaactatagtgttgctaatctgggctgagggcacctctgcctgtcagagcagctgaccaggcttgagagcatgaaaacgggtt

SEQ ID NO: 726529 - DNA, 762 bp, Homo sapiens
gggggcaggagcggagactggaggaggaggagggagaggctgaatgttggctcggtaattgagaggagcggcgctccagagcttgcctcccggggcgccccctcgagtccgtccgctgcttctcagccgccagtctcctggccgcgcagtccccgcggacgtgcgggccgcgagagaccctctgcaggaagaaggcgctgcctggcgagcagagggacttggccggctggatccagaggccgcgcggcccaaaacgtaaaacccaaaccgagctgcaagacgggtccctccgggccggcggcccaatcgtcttcctcccctcttacctcgccccaggggaggaccgtaacgaagggagagcaccgggcgcgattacgacgaagccacgggacccaagggtactacagggaacggaggacggcgggagaatccgacatagtatcggcccggagggcaagggaggagaaacgcgccgggaacgcccgaaaggccactgggggcggggacaccgcaatgggacgtgccggcagagcaagagccgacgaagcactatcgacgctcagagccggagcagcgcaagagcgggacacgcaccactgacgcgaaaagattccgggggcagcgaccccggtagcggacccacaggctccgcgcagggaccaccgaggcggacaaacaaggcggggggggacagcccgcaaccaccggggggcgaaggcccgggggccacagaatacgggggaccaacaacggcaacatggg

SEQ ID NO: 726530 - DNA, 129 bp, Homo sapiens
tatatagagtggcatataatagaggtgcatacaactaggtgggcccctacttatcagccggactaggtagctagcgatagccgaccagtatagggtacaggccagtagcctatagcgcgtcgggaaggt

SEQ ID NO: 726531 - DNA, 429 bp, Homo sapiens
agtaggtatcatacgcgtttatgacatgaagtttgtacaggctgactgtgtcatctctggtcacaaggtcattggttcccgatcggaccacacagatcttgctcgatcagtcagctacgttgcttgcaaatagagtgcggctgacgacgtacaatctagtgaacgcaagcgtcatagtctatccgtgtgatctcagcgttattggcgactctgaccagatgcctgtttgcatcatcgtaggcaagttcagtggtgccatcaaggcacagcatctcatagtcttgctcactcatattcttagcccatggttcagggattgcacactcagtgctgtgtggcacagtatggtgtatcacaaagcgctcttctcccttgtcaagcacactccataaagcgcctgtgtagccgtagtacacctcattgatgatg

SEQ ID NO: 726532 - DNA, 104 bp, Homo sapiens
aggtgtgtgccttcccgcatgcgcaaggagtctaggtcaaatgtcgatgaatatgaacctcgagaaagttctggaggccaaaaagaaaaagaagaaagtggacg

SEQ ID NO: 726533 - DNA, 280 bp, Homo sapiens
ggcattgtgtggggagtgcggctcactctgggccgagcgacgcttagcctctcctatgagcagacttggcagaacttcaattcctaagccgtttcctttttgcaggcaaaatgaagtgggagaaaagtgtaagcactgacattttcaggaaaaatattaagatggaaactgtgaatgtaaagacagatatatacaccactttagaatatagcctctccttcacaccaagtctcacttccaaaaaattgatctgatttacaaagtgatatactatacctga

SEQ ID NO: 726534 - DNA, 120 bp, Homo sapiens
tgatgaacagccccattccaggaggctgaggtgggacaatcacctgagcctggaaagtcaaggctgtggtggcgccattgcactccaagcctgggcacaaggcagtgggaccctatctcc

SEQ ID NO: 726535 - DNA, 306 bp, Homo sapiens
gttgtgtatccgcacaagagtattacatgtgactagagcaagaagttattatctcgaagtagacactagagacacaagccaaagaacccagctctccctaagcttcaaactagactacttctccataatattcatccctgatagcattagtacgtatacatggtccatcatataaattctcactagtgatatataaactacagacccaaagcattaactcagttcttcacaatatctactcattctatcctaattgaccatactacatctatagttaccagctaacaaccctattccaatctgttc

SEQ ID NO: 726536 - DNA, 118 bp, Homo sapiens
  misc_feature (42)..(42): n is a, c, g, or t
  misc_feature (55)..(55): n is a, c, g, or t
ggctcctagggaccaaggccgcatttctaccctgactcccanttctaattcctcnttattgttattattattattttctctgctattgtaatatttttttgttaattaaagttttggc

SEQ ID NO: 726537 - DNA, 435 bp, Homo sapiens
gcttgttctgtttcatgccaaattccgaagattcacagtaagaatttaatcagaggtctttatattggaaaatattgcctaactgtagcctgcttcagcttggttaatatagttgtgaactagacattaaggccctgtaatacagacaaaactttaaagaaataggtcatttaaaatgtcccgtagaaaaatgaacaaaattctgttacttcagtttgctaaatagtgttttgtttttttaccaagttacaaacacgattacactaatatattcacacgtcgattatggtagtcttaagaagagcagtttagaggagacaggagcttgagtaaaagggaacttaagaccaagttgacttgtaggaagatacggaagataaaagagaattgaggtaattaatctatcagtcatgctagagacaggaatgatttttc

SEQ ID NO: 726538 - DNA, 159 bp, Homo sapiens
tatacagaatcccctaatctgtatcattgcggtatgattttacatttcctgaataatttgtgatattgggcatcttttcacatgcttgttgtgccatgtttatagtcttctttggggaactgtctattaaagccctgtgcccattacaaaaatcaggtc

SEQ ID NO: 726539 - DNA, 832 bp, Homo sapiens
  misc_feature (257)..(257): n is a, c, g, or t
  misc_feature (368)..(369): n is a, c, g, or t
cgacaaggagcagcaccgtgagttatgtgacgagaatctggttgaagacatctcgcggattcaaatcgaacaggtaatcagagcacagcattttgtttgggttaaatcacctgggttagagaactgaggccagtgagactgcctgtgatgcacaggatcccaccccaccagccccttttcaaagcactttatcccgtgagtctcaagggaggagctgagtgtgggggtacaggtcctgtgtgcagccacagtatttnaagtccattcatggaagcttggcctttgcttcatattcactttctgcacaatgggaataataatatctatcttgtgggctcattgtgagatgtgaagcaccctttgggtgnnggagagtagtgaattccttttcttcctctgctccttgtatctgttgtaccctgagattgcatgtgcgcacgccctttctaatcttctgactttgagtgtggctggtctgtagcttttgctcattcttcctaatgaccatgggaataagggagtggggtggggggcaagaatggctgcaggtagtggggagtagttgaaggtgtgcaaaactgtgtctgcacccagcctgacccccaagagtcctgggcaggccccatggtttgggtgtgagtcctggtgagtgtttgctcaaaatctgcttgactattgatggttttttactgagtgttaaatttgattaaactcttaagtcctcctaagtgccaggaagacactctgctttctctccctcttttttctccttgattcatagggggtaggtgagagacaagggcagcttttggaaagaaacatttatagatgt

SEQ ID NO: 726540 - DNA, 157 bp, Homo sapiens
  misc_feature (14)..(14): n is a, c, g, or t
gtctggcatcaggngacatggcatgggctgagtcttgacttccattcacagatatgtatttgatggaatggtaacccttttcaattgggcagcagcctcggaagggtatcttggccccgtgtatttccgtgtagataggttgttaaacattaggagc

SEQ ID NO: 726541 - DNA, 160 bp, Homo sapiens
  misc_feature (47)..(47): n is a, c, g, or t
  misc_feature (94)..(94): n is a, c, g, or t
  misc_feature (106)..(106): n is a, c, g, or t
tggctcggtacccccctccccgggtacaactgtttcagagctcacanagaaacaacatggacttttccatccgcatcggtaacatcaccccagnagatgccggcanctactactgtgtgaagtcccacgaagagggtccccctgcaaggtgacgtggggt

SEQ ID NO: 726542 - DNA, 134 bp, Homo sapiens
attgacaacaatagactgagaaagaaatactcgacgcttttgacaaaatgtgctcgaaggcttgccgaagtccctgtcggaaggagtgtcatggaggtgtgtggacactgtactggcagcctcctatccctgtc

SEQ ID NO: 726543 - DNA, 490 bp, Homo sapiens
acacacgaagcaaaaagtctcccaccaaagagcggcccaggaccggatggctgcacggctgaattcttgccagtattaaagaaactaatacaggtcaggcatggtggcgcatgtgagaaatgccagcagttcgggaggctgagatgggaggattccttgagggcaggagtttgagacaagccaggggaaacatagcgggactttgtctctacaagaaatattttaaaaattagacaggtgtgatggcacatttctgtggtcccagctactcaggaggctgaagtgggagaactgcttgagcccaggagtttgaggttacaatgagccatgattgtgccattatacaccagcctgggcaacagagaaaaaccctgtctcaaaaaataaaaaataaagaactaataaggccgggcagggtggctcatgcctgtaatcccaacactttgggaggccgaggtggggggatcacctgaggtcaggagttcaagac

SEQ ID NO: 726544 - DNA, 231 bp, Homo sapiens
tctgagtcttctacgtgatgggacggctatattcaagtctgttagagtaactgttttaagtaactgttacatgtgtacttcctttatcgcatttagatttttctgattattttatatactaaacagggcaatgtattccaagatgcagtcttcaatcaaacagttacagttatagaaagagaggatgggttagatggcagaaacgtaaggtgaaagtggtagtacgtagat

SEQ ID NO: 726545 - DNA, 105 bp, Homo sapiens
  misc_feature (11)..(11): n is a, c, g, or t
  misc_feature (75)..(75): n is a, c, g, or t
  misc_feature (92)..(92): n is a, c, g, or t
aggaggacaangaggaggaggaaagaagccgacgcaaggagcagcggaagcgggcacgacagaggagccgggcanggccgaaagagggcggnggggacgagcccc

SEQ ID NO: 726546 - DNA, 168 bp, Homo sapiens
gtgcgcggtgatctgaggatcccgctgtacctctctatgcagtagatcctgtgcctcaagaaatttagacgcccacgacagcactacacagcatctccaggtgatgcccaaggcacagggctgcagaaaataaacctccagattccacacaacacgggtccaattctt

SEQ ID NO: 726547 - DNA, 454 bp, Homo sapiens
actgagtttctatgggcagggactcccatgtctccctatcccatttatgggcttgggagtctaggggtacgagactcacacgagtgagtttgcagtgacacagctcctttagcatctgccgcacgaagtatagagcatgtcctgcgtgggtgaagctgcaatggctgagacagggccagatgcttgcagtactgcaacacaaaagcaccacagtcaccgtcattatactgcctggccacattcattttgaagtaacctttccagccctggtgaaaatccagtcggactttctttaccgcctctgcctgtagatacttggcactatgcttagggcagcggcggttaagggtacgctgcgagtcaaaataggtgatggtgcgtcgccttcacatcaacagagatgagggaccattgcacctccaggtggatggggattagcagtagctgggtaccg

SEQ ID NO: 726548 - DNA, 320 bp, Homo sapiens
  misc_feature (210)..(211): n is a, c, g, or t
gcttgacatcttgcagagtgtgccagtcagggctggtcttgggggttgtctcagggccggagtggtgccctcctcatcccctcccaccagggtcaaaacccccgcctgccggtcatgtgactgctctcccccggtgccctgtgtgtggggagagtcagtgaagcccccactcaaatggttcagctccttctctggggacatccagcacgnntcttcagattcctctccaacaattcatggtccctgtaatgaactcccaccgttcccgctgtcatccgtcgatgatggagtgcgagccgggagctgcagccccgcggccg

SEQ ID NO: 726549 - DNA, 217 bp, Homo sapiens
gcccaggtgggagtgcaggggcgcgatctcggctcacggcaggccccgcctccgggcttcaggccattctccggcctcagcctcctgaggggcgggaattacaggcgtgagccacggggcccagcctaatttgggtacctttttataatggagacttacacaggggatttattatatccagggatgctcagccagcacaatggggggcggggtaccg

SEQ ID NO: 726550 - DNA, 394 bp, Homo sapiens
atagtcgcgctctctccctcgcaaattgccattccttctcacaaccgtcactgtgtaatgtaagggggccgcgttattgccttgaatccaggtcctcagaccgccactctaaacttataaaaattgggccccttcctcatatatataaatttagattaattccaaaatttaattaggataattggggaatgtttttaaccataagccttcacttatactatgtgtcctgtgcgcaattggctctgtgaaggccgtgtgaggaccaaagcacagccccacagctctccctctcagagccacgctttcacatctagagagaccaccgcctcacatgtgcgctccccgatatctacacagcgcgcgtaaaattctcgcacaacccggggtaccctct

SEQ ID NO: 726551 - DNA, 456 bp, Homo sapiens
tagggtggtgctcgaaactactgggagcgactgtacggaagcttctcagagccgggcggctttcccagtcctccgtgggaccagcatcagcagtacagggccagcatgtttacagagccagcaaatgataccagtggcagtaaagagaattccagccttttggacagtatcttttggatggcagctcccaaaaatagacgcaccattgaagttaaccgtgtgtaggagaagaaatccgcagaagcttatttacaggttaagaacaacattagacgtatgtcctgaatgtggtcaccttgaaacagaaacatgtcctttgtggctactgctatgaaaaggtgtgcaaggagacttgcagaaatcagacgacagctagggaagccagaaggggcgcctataaaggctcccaccatagagactgtggtgctgtacacaggagagacaaccgttctgaac

SEQ ID NO: 726552 - DNA, 194 bp, Homo sapiens
agtttacgaggaggacgggggaaggcgctttgttgaagtagcatatttctcttgtcctttcgtactggtacggaatgtgatggtagatatgacaccgacctggattattccggtttgatgctctaggagtcacgtaggactttaatcgttgaacaaacgaacctttaatagcggctgcaccttcgtgctgtcca

SEQ ID NO: 726553 - DNA, 1311 bp, Homo sapiens
  misc_feature (1236)..(1236): n is a, c, g, or t
gacgagagtgcgggacgtccggcttcggagcgagagtgttcgtctgtgccagcgactaccacgacgaattaacactatggcgtgatgcttgagaacaggcacacaagatttctcatcatgaagtgttcccagtgccacaccgttgacaacagggaggcaatgcacaacgactggcgccaacatctctcatgtgtcctctcttgcgcgccggcaagaccaggtcaggccccctgtgaacttacttctttaccaccaggccgcccaaatacgagaaccaaataggccatcattcttggggcgagacggaataccactgcatcggcagctactccggccgaactccccaaccgaacacgctaccatccctgggcaacccacacacactggccctccttcgggttccggcccagttacccgcaaggaaagctgcaccgcaccagggcgccccgaacttttacactcagcccacactccctccacacacgaaaggcctaacctacacttgacgctacctaaacttgggccccccttgcccctatatctccaatctcccaaacacacagtccacgagtggtcctcacttgaacctttctcaacacttgttgttacccaactcccctttaaactaagaacctcctccattaacaagccagcacactcccagaattccagtggaccttggacctggccccgccactacttctgggcacggggcccacgccccagtgactacttcgacccccttacagcaccttggcctatgctgccgtcaaccctggaccataactggtccaccatccctggaccatcctcccgttcgtaacactccaaaatccacggtacactggctatccaccggcctcacccccctcctccaagggacccttgactccgacctccggaaagtaaacggttcaacgtattctcaccaaacgactggctgacgtgcccctcttaacaagcttagcggcacgccttgccctcccctacttcacgcacttacataccacccgggccaacggcggaccatatcttccaccatccgggcggcacacctgcgcctcccgcgcctaacacaccacacgcccagaatcagcgcgggcacccgccgcaccggcacccccgcccctaaacgccggcgggcacccaacacggccaagcgccacaccgccgcgccacaccggccaccacaccaacacccgactcacacaagcgacccaaccacgcaacgcaccncgggcccgctccacacccatcacccccaccaccacacacgccagcacaaccggacaacaccccagcaacacaaca

SEQ ID NO: 726554 - DNA, 221 bp, Homo sapiens
tttttaaaaacctgccagtgataccatcaagcctgaggggcaattttgcaaagaatataactccaagcagaagtgaccgctgtgctgttttagtgccaggctgcggtgaacagccatgagaacaaaacctcttctgtatttttttttttccattaggaaaacacaagacttcagattcagccgaattggggtgtcttacaaggcaggccttttcctacagg

SEQ ID NO: 726555 - DNA, 307 bp, Homo sapiens
aggaggtccagtgggaggggccccccgggtttggccactggattccccgggttagttttgccagacccgttgtcatagtataaaaccggcagaggccttcctgccctggggtttagttaatgtgtttagaagggccgaagagccgttttcttttggaggttttgggtcccccccccgttttttttttttttttttttaacccggcttccttccgttgccccgggtggggtacagtggccccattacagctccctgaagcctcggccttccccgggtcagatggtcctcctgcctttgctccctttta

SEQ ID NO: 726556 - DNA, 267 bp, Homo sapiens
  misc_feature (2)..(2): n is a, c, g, or t
  misc_feature (9)..(9): n is a, c, g, or t
  misc_feature (73)..(73): n is a, c, g, or t
  misc_feature (77)..(77): n is a, c, g, or t
tnagtgctncctggggcctcccacctcccctggcttaggtgatcctcctgcttcaaccccctcttcccccacnaccnactacagtagctcggactacaggtgtgcacccattacacccgactaattttttgtatttttagtagagaccagattttgccacattgcccaggctggtctccaactactagacccaagcgatctgcccacctcggcctcccaaagtgctggaattacaggtgtgagccacctcgcccagccagtacttaa

SEQ ID NO: 726557 - DNA, 154 bp, Homo sapiens
aaactcctcccctgctgcctgctggcatgagagaaagcaaacagccagatatgggtcgatcccatgaaatggcaaatgtctaacacaggctttctctatcatacttcacgtttaccttattgcaccttaacagaagtgaagactagctagggtg

SEQ ID NO: 726558 - DNA, 1016 bp, Homo sapiens
ttcattaggtctggctgaacgggtctaatggacttgtacaatttagatttcttctaatttggttgatacttgatgggatgtcttgtaatcgaatgggcgtcacgtcccaagtgcttcattagtgtcctgaggaatggtgaattgaaccgttgaggtacgcactcatcatgaacgactcctgctgggattaaaagggaagattcacacgcttgtttactcccgcgtgacacgaacctttaacttagcatggtgaccgtttgttataagagagacgttatcgcgagtgagggcggtcgagcacgacttcgatgggtgaatctgagggacttgcgggtacattagcgagggcctttgtcctgtgtcatcgagctggctttggtagtggaagttccaggtgcaagcagtctgcgccgctcggaaggagtttggaaggctcgggcaagcaaagagacaggctatatacgcggagcgaatacacggctgcagcccttcaatgacagatatccatgcgggacatcgaaagagcagcattgagaaggctctccctgaagaaggaggcgcgccaccaggctgatctccagccaccgggggcacggagagccagccaacacacacagcagtcccactcagtccgggcacaggccgccccgtgctgcgtcgagccccaagcaagacgcagagtccgcgtgtgagctgtctctccaagcagaagaagaagaagacaaagaagcaccgaaggagcgcacagccggaacgagcgcgaacagccaagtagaagctgacaaattaactggtcaagtgtgtgcagtgacgtgcacattggtttctgttctctggctatttgcaaaacctctcccacccttgtgtctcactccaccacccaaccccaggtaaaaaagtctccctctcttcctacgtcacacccatagcgggagagacagtcatgcagatttgcaatggttctttggagtaagaattctatgcagcggctaatttaactggccatggtcgtgtta

SEQ ID NO: 726559 - DNA, 241 bp, Homo sapiens
taatagccgtcccgctattctggactcggggcagtctggacttcggggcaatgcatgtacgtacacgcattggcagtggtgcgtcattaggtggcacaagctattacacactaaccagtttgaagactacacaagattaataccatccagcatcaggatatagctgtggattttcaaaccattcttatttctaacttcaggagttgatgtttttcccagtccatcttaaaatattactgct

SEQ ID NO: 726560 - DNA, 692 bp, Homo sapiens
taacatcccaggtcacaaaagcccccatctcgttcctctggaccagagcctgcggtgggatcaagtccaactgaaacatcagaaccatattagagagacaataagcatagaatgagatgaccccctaaataggcgttttcgtgggcgaggatgtgctggattaggaaaggtgacatgagcacaggcagatgcagagtggcacccacctcatgatacacgtgtgtgttatttacgaggagccatgcagttgagcctaaggtccttctacctacctggtattggcatttgaggtcggaaaccctctgactgcccctataagcccagggaacaagtgataaagagaacaccagttcctttgaagaactggcagcaaggcttgaggccttatagtatgtgagactgagtcaagctaaggtacaatgatatctggtctgcttgtcccaaaggacttttcgtctcctcagctggcaggactccttccgttagttccaaggacagctgagacacgacctgctgtcgtgatgtagccatacttagtcgactggagcaaatagtcctgtgcgcttttacactgacggtggatcacttcaggattgatcgaggttgtatatagtgcccacaatgcataccccttatatgtacgaatgcataatcccacttgaactagtatacatcttaaagcaaaaaaaaaa

SEQ ID NO: 726561 - DNA, 150 bp, Homo sapiens
caaattaaaaaaaaaaaaaaaaaaaacccctgaatgatgattaaagacatccccgctaaaaaaccccatttaaaaggtaggatttgttaaaagcaaaaatttttcccctttttttttgttttgtttaaaccaaaaaaaggcctttgtata

SEQ ID NO: 726562 - DNA, 348 bp, Homo sapiens
ttgaccactccggatgcatcagacccagcggagggctgctcggtggggctggcctcactcctactcctggcagaccctggtcccggactagctgcacttgccctgtacttcaagggcagtgaccacgttccctcctccccgccccacctttcccagacccccatagatgagatgagccctggggagatgggaaaagcctctgtccttgcacactccagtggaggtgacctggcccgacatgatccaccagacttcttctgccctccaggagactttggacacttttgtcaagtggcaggatagacaatgggccccccatggacaagtctgatctgggacagaagcgga

SEQ ID NO: 726563 - DNA, 160 bp, Homo sapiens
tgttgtccatgcacaattgtgtagcgagatgccgtcacgtttcaaaacactacacgttgttgctggacgtaaatgcgatgcagtcatcgtcagcgatatatcgaggaactttgacgtcgacattcgatgaaatacgcggaggccaattcaatgctttcaa

SEQ ID NO: 726564 - DNA, 488 bp, Homo sapiens
  misc_feature (14)..(14): n is a, c, g, or t
  misc_feature (72)..(72): n is a, c, g, or t
  misc_feature (176)..(176): n is a, c, g, or t
  misc_feature (178)..(178): n is a, c, g, or t
  misc_feature (228)..(228): n is a, c, g, or t
  misc_feature (233)..(233): n is a, c, g, or t
  misc_feature (235)..(235): n is a, c, g, or t
  misc_feature (288)..(288): n is a, c, g, or t
  misc_feature (419)..(419): n is a, c, g, or t
  misc_feature (447)..(447): n is a, c, g, or t
cccggagccggctnccatgaataacatcaaaacaacgtggacactaagagaacacatgtaactcatggacgnaggggatgcatgttgtctgcattcctgtctgctgtgcctacatgtgctccaccccacacctgttgagtacatgctgggaagaccatgtcaacccttggagcagntngtgtttaaccatctcctgctagcgcctcatgttttacatttgggcactanctgananccagatcctcccctttccccctaaataagacactgtcacacaatatcttttanctcatcttgtatttgttacaactttaagcagaattgtgactcgagcactacatttccatccacaagactgggtcttgaggttattttgggacagctttacgatattgcttagggtaggtttttacttttgntcctccaaacaatacttttcttttgggnaaacaaggcccgggggggggtccctccacaaggtggttcca

SEQ ID NO: 726565 - DNA, 202 bp, Homo sapiens
  misc_feature (158)..(158): n is a, c, g, or t
  misc_feature (167)..(167): n is a, c, g, or t
cacagttgatccgcctgcctgggcctctcaaagtcctggaattacaggcttgagccactgtacccggcaacattctgtcttaaaaaaaaaaaacacgggccgggctcagtggctcacgcctgtcatcccagcactttgggaggccgaggcaggcgaancacgagacnagatcacctgggcaagagagggagactccatctca

SEQ ID NO: 726566 - DNA, 177 bp, Homo sapiens
tctggtatgataccagatgtagcacgaggcctactgaaggtgtttctctagaatacacgtgaatctccttctgaaggtgttctctagaatacacgagtccttctgaaggtgttctctagaatatatgtgagtccttctgaaggtgttcctctagaatacacgtgagtccttctgagg

SEQ ID NO: 726567 - DNA, 766 bp, Homo sapiens
ctcatcgaagatggcgggcgagctgtgtcgggcattaccagagagagtcttcgttgtggacggtctcaagaacaccattgtagagaattctggtctcgattcagaaaagagaaagagccagtggtggtagagacgagtagaagagaatataggaacctatcctagttgtgtcctagccgttgatcgaagtccgtagcgatacacaccaccatgagagaatctccagagtcgattgggaatcttacgtttaaagaagtgtataggtgtcatctcttcctagtaattggcaagagatctcccaggaaggactagtcggctaaatgttcaatcttctgtattcatttagctgatgactgggatcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttaaatatctcatattacaaatggacaaataacggactttctattttcatatagggctgaaaccattttcaacatgaacattaggtcattatatatgaaaagtttgagaggg

SEQ ID NO: 726568 - DNA, 153 bp, Homo sapiens
  misc_feature (13)..(13): n is a, c, g, or t
tggggcgggagangaaggtgcgcatcctctccgagcgtaagaagcctctggacattgactacatgggggaggaacagctccgggagaaagcccaggagctgtcggactggatccaccagctggagtctgagaagttcgacctgatggcgaatc

SEQ ID NO: 726569 - DNA, 593 bp, Homo sapiens
  misc_feature (165)..(165): n is a, c, g, or t
  misc_feature (222)..(222): n is a, c, g, or t
  misc_feature (388)..(388): n is a, c, g, or t
  misc_feature (471)..(471): n is a, c, g, or t
  misc_feature (517)..(517): n is a, c, g, or t
tacttccacagggcgaggtcagtagttcgagaccagcatggccaatatggtgaagctctgtctctgctgaagatataaagattggctgggcgtggtggcatgtacctgtggtcccagctactccagaggctgaggcagaggaatcgcttgaacctgggaggcagnggttgcagtgagccgagatcgcgccactgcactccagcctgggtgacagagcaagantccatctcaaataaataaatttaaaaaataaataaaggaactcataattgactggtgagaaagattagcaagtatgacgtatgcaaggaatagaagttatgtaccgagtggttaaaggttggggggatatggagatggatgagagggagctgtctgggaaggcttngcttcacttggattagagtagggttgcgtgaggaaataggtgtgtagagtgagaatgagggtcatgacatcctcctacaaaanaacaatattcaaggaaggaagagaatctggttggaggtaccagganatgtgtcgttaggaagctcagaagaaaatagtaagtcatagttagtatatcagacttaggtggcttagtggtgata

SEQ ID NO: 726570 - DNA, 1084 bp, Homo sapiens
  misc_feature (561)..(561): n is a, c, g, or t
  misc_feature (760)..(760): n is a, c, g, or t
  misc_feature (768)..(768): n is a, c, g, or t
  misc_feature (996)..(996): n is a, c, g, or t
cggctgtgcgtgtccttaaaagtccctgggaagcggccgggcgcggtggctcacccctgtaatcccagcagtttgggaggccgaggcgggtgcatcatctaaggtgcaagagttcgagactaagtctggccaagatggtgaaacccccgtctctacgaaaaatacaacaaattatgccgggcgttggtgtgctcatgtcctgtaatctcaggctactcgtggaggctgagcaccggagagattgcttgaacctcgggagggactggaggttgcgagctgaccgctgagtatcatcgtccacctgctacatcctatgcctagtggcgacgaggagcggtgactgccaaccttcaatacaatagatagaatacaataacaggggaacgttggagatctataattcagtggagaatgtcgcaaagaaccagatggggagagtttctcctttggtgacaaccaacattgttcctcctccctttcgatatcgtctcgagaagcgcttacagtgtggtcgaaagcgctcctgcgcgtcttgcgctgcggcaactctcaagtcacagngtcccttctacaacgcccactataacagtgataactccgggtgggagacccaagaaacgcttgggcgtgtgttacacgcctgagagccattgggcgcgcgtggagaccgctgttgggcgacaagctttgtgtgtgtctccctttggagcggagaacctcagagcgtcttgcgcgatgtgcgagcactgctcgcgtcttntcacaagngcgcgtcccaacacaggggaggcctaaaagccccctctgtgtcagggttctcatacacgggacagcgcatacagtgcggtgggaacactttggaagacccattgtgtctgcgcagttcggctaccggcgaacggcccttggaatgcccagttagcacacggtgtgcacaacggcctcgcggtgagacagttaccccgggattgactagcatgcggcgtggaaccgagncctccaggtgttgaccccttggaagcctgggggcccatgcgcggagccggtggcttggtggctagcactttcgactgcaacatacctg

SEQ ID NO: 726571 - DNA, 434 bp, Homo sapiens
cggtggccttggtgtcactggtctgagtgtctgcagccagctggaaatgcatgaccatctcctgtatcatctcactggcgtctgggcttgcttgatacttgagcagtaactcaatgcccctgaaatgtcagcagcagatgatcaggtccccctccctctgaattgcagactgttccgtgcccagacgtacccatgggatcatgctttgtgctacaactgaaatatcaaacaattgctaattgttaatggaacattaagtgcattttcccagaccacttattcaaagtgcatttcaccttctgtgggttgataatgaggctgtgtttgaggtctgtgttgaggaagaaatgaggggaggtgggattgggccacagaaatcgtgctggctgggggcataagcacattggcagctgatgggatacttccccaagccc

SEQ ID NO: 726572 - DNA, 1122 bp, Homo sapiens
tagtgggaagatttatgaggtagaggcgataaagctaccgagcctggtagatagcatggttagtccaagatagaatctgtgagttcaactttaatattctgcccacagcataccctctaaactccccttgtaaatttaactgtgtgagtccgaaagaggtaacagctctttggacacgtaggaaataaaccttgtagagagagtaaaacaagtttatacatccgcagtagtaggtcctaaataggcagccaccaattgatgaacagcgttcaatgcttcaatcaactctagctatccgtaataaaatcccaaagcatataactgagactcctcacatccaattgggaccaattctatcatcctatagaagaactgagatgttagtataagtaacagtgaaaacattcgtcctccgtagtaagccgtgcgtcagattaggatcactgaactgacaattaagagctccaagtagtctacagatcaaccgaactagtcattattacccgtcactgtcaagccaactacaggtcatgctcataaggaagggttaagaaaagtggaaggaactcggcaaaatcttacacaccgtcgtgtttaccatataaacatcagcatctagcgatcaccagtattagaggcagcgcctgaccagggacatcatgtttaagcaggacgcggtagcctaaccgtgcgaaggtaggataatcacttgttccttaagttagggacctggtatgaatgggtccgcgagggtacaagtgtattttactttgtacgcagtgaaattgagctgaccggaaagggggaatgagaagaggagagaaaacctatggagttgaattatcagggcaaacggacctaagagacgccacaggtcctaagtagcaacggtcattaacagatcccgagggggggaccggggataaagccaaccgcggaaggagcagttaaaattcaggggcaaaggaaaatatataaagggaagaagtaacagggaggatcccaggaatacagaacatatagacagacaggaggacacagggtacagcaacggacgacagcggcgcagacacatcaggagggagaataaggagacaaaatcgctatcctcgctgccacttg

SEQ ID NO: 726573 - DNA, 101 bp, Homo sapiens
aagaagtagaaaatctgaatatataaaattacatacaaatatttaatataaatgcaatttataaatgtaatttatatttatattctccaaaaattatattt

SEQ ID NO: 726574 - DNA, 325 bp, Homo sapiens
  misc_feature (5)..(5): n is a, c, g, or t
  misc_feature (40)..(40): n is a, c, g, or t
  misc_feature (68)..(68): n is a, c, g, or t
  misc_feature (124)..(124): n is a, c, g, or t
  misc_feature (235)..(235): n is a, c, g, or t
ccccntaaaggcttttggatggttttagcaagcccggcancctcgccttccccccccctattaacctnggggggaactctttgtgggaggaaccgcgttttccggatcaaaaatccctttcctncttacgggactcaacatactagcgcaggccctaactcccctttacatatttcccccaacccaatgggggtccctccccccccccattaacaacataaaaccctcattcacncgaggaaaaccccctcaggggtcaaacccctatcccccatttttcctcctatccctcaaccccgacatcattaccggtttttcctcttta

SEQ ID NO: 726575 - DNA, 176 bp, Homo sapiens
  misc_feature (16)..(16): n is a, c, g, or t
atctgcgagctgaggngagaggcctgggaggaaacgagtcctgcaggcaccttgatcttggacttccagcctccagaactgagaaaataaatttccattatttaagccacccactctgtgatatttcattacggcagctctagaaaactcctctaacctgccaagccacacatgat

SEQ ID NO: 726576 - DNA, 616 bp, Homo sapiens
caaaaacctttttattgaacccactcgtattagtttcctaaggctgctggaccagatgatcataaacgtggtggctttgccctcaacgttttggagagcagaagtcgaaactcaaggtgtcagcagggccaccatcactccagagcctcctctagcttctggcgcctgttgatgttccttgccttgtagctgctgcactccagtctctgcctccactgtcacaaggccttctcctctgtgtctcaattgcctcttctcttgtctctttgtcaaatatccctctgcctttctcttaaaaaagcacttgtcattggatttatggaccacctggataatttgggatgatctcctcatctcaagatccttaactttattatctctgcaaagaccccttttctaaggaaggtaacattcatggtttctggggattaggacatggttaagatgtagacatatcttttggtgagccaccattcaacctattacaccatccatattaaaacttatttgattagagctggcatcattatttaccaatatatatacttctctagttttaggccatgtaacccaaaagaatgtagcctccactttataagtctgtaacaaaaaaaaa

SEQ ID NO: 726577 - DNA, 1109 bp, Homo sapiens
caggagatgagatgctcgggaccagcacgaacccgcggacatggcccggccgacgacagccccccggaggtgatccgcgcggcgcagaaggacgagatactaccgcggtgggctgcggagacgcggcagggcggcgccctgcacagcctgcgcgggtgcgaggaagtggctggagtggaggaaggaggttagagctgcatctcagatgtggcctactttggcctcaccacacttgcaggctaccagaccctgggggacggagtacgtcagcatcatccaggtggacccatacgcggatacatgtgccctccatcgctgcgccagtggcgatgctggtgacgcatgcatgccgtccgtgccctacctgactggacaaggcccatgctcacccactggagcaggagcatgcaggctgaccccgacagtgggcagaccattgacacggggagcctaggggccaggtgggcgtggctgctcaggggcgcggcgctacgatgcgatacaacacacaggacaccactgcacctagagacaacaccaggaggcgcgcagcatgcggggcggacacaccgaaccctcaagacagggcctcgacctgacctccaagcggctacatgtagcctggtacaacatcacacgggggcacctacccacgatgcgccacagagggcctccacggagatcaagaaaccaccgagtaccgaagccctgcccggaacaggaccaaggaggaccgagtaaaacaaagagagaagaagccacacaacacatgagacaccatgggacgagaccacaggggcaaacaaacggaagaaaccaagacaccgcaggaacccagcacacgacgccagaagaacagcgagagagaaaaaaagagacccccagagagcacaaaccaaacgcaagacgcggccaccccggccgggagcagagcacgacaagacgacgcggcgcagccccagcccgacagaaaccacggagcgggaagcacccggagacgccccggcgggcccgaagaagcagcacagacaagggcacgagacaccgcgcacgcgagaacgggcaccgcacgcacgaaacacaaacagcaacggggacacaccaaacca

SEQ ID NO: 726578 - DNA, 272 bp, Homo sapiens
  misc_feature (6)..(6): n is a, c, g, or t
  misc_feature (13)..(13): n is a, c, g, or t
  misc_feature (25)..(25): n is a, c, g, or t
  misc_feature (27)..(27): n is a, c, g, or t
taagangtcaaancaacagtaaaantnattagaaatggagcacatgaacagacattcatgcagaggatataaaaatggcaataagcgcatgaaaagacatgaaagacagtcaacagactagtcactaggggactgcaactaatactacaatgagatatcactacatagctaccaaaattgctaaaataaaaaataatgataacaccaacgctgacaggatgcagataaccgggtcagtcatacctagtggtgggatagaaatggacagccac

SEQ ID NO: 726579 - DNA, 404 bp, Homo sapiens
  misc_feature (3)..(3): n is a, c, g, or t
agngggcacctgaagagtgtgtagctggggttatagcatgcttttatatgggtctcacaaatacacaagtctttacattgtgtgttcactctggcgcaccaatcgtactttttttttgttttcttagatggagtcttgctgtcacccaggctggagtgcagtggtgtgatcccggcccactgcaacctctgcttcccaggttcaagcgattctcctgattcagcctcccgagttgctgggattacaggcgtgcaccaccacgtccagctaattgcccatctaatttttgtatttttgagagagacagaatttcgccatgttggccaggctggactcaaaactcctgacctcaggtgatccaccacgcccggtagagccttgatctcttaaccactcccgtacca

SEQ ID NO: 726580 - DNA, 170 bp, Homo sapiens
cctagtgtcagaagtttcaagtagcacattgctgcctggcgtggcaggaaagctgatcttccctatgcagtcgctgtcacgttagccgtatatgcctttcacttggttgaaggtgacatgctatttaaacttctaaaactaggcctacttttgaaagttctaaaactagg

SEQ ID NO: 726581 - DNA, 305 bp, Homo sapiens
gacaactagggtagtttgcaggtggtaagccatttacaagatagttgtaggtaagaagggcagatttattagagaaatgtgaaaatatgttgcagtgggcagctcagcagagaaggggctacctgcaaagaggcaaaggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 726582 - DNA, 136 bp, Homo sapiens
tcccaaccaggacaaccggaccgtcagccagatgctgagcaagcggtggtacaccctggggcccaatgagacgcagaaataccacgacctggccttccaggtgaaggtggcccacttgcaacaaggaccgaaagaa

SEQ ID NO: 726583 - DNA, 659 bp, Homo sapiens
gagttgaaaagggaagggtgaagtcaaaggagagaagtcaatgagttggccaacaccaagcaaggatcatgggaccctctccacggccccacatctcaaatgaagtcaacaaaacccatcagtgcttggtgtaagtgttgtatgctcctggaaatgaaagcaggggccacatttcaggtcagtagggtcacgggtagaggcagctgtcatggacttgtgggccctggaggatgggatgattctgagacattgaatccctacactgatctcagtagaaatctcaggtagggcttcaacattcgtcgacaaaggactctgtgggcatcagagcaacagccttggtgcatgtccaagctccatcaatcccaactggggctttgaacaagttacttattttttttaactaacgttattttaattgacaaatcataattgtacccatgtatgtgatgttttgatatatgtatacaatgtgggatgattagatcaaactaatgaacacgtccatcccctaatttactgacaattttcatgatgcgacatttgaaatgtacccacttagttattttgaaagatacattattattgactatagtcacgctgctgtgctatagatttcaaaacatataatccagcaacccaacttctggatatagacc

SEQ ID NO: 726584 - DNA, 284 bp, Homo sapiens
atcatccatccggtgcgcttcgtcctgccgcacgaaaatgcgctgcggccgtggtggatggtacggctcggcctctatctctatgattttctgggcggcaagatgacgctggcgcgctcgcgcgggctgcggcggagcgacaccgccttcaccgcgccgctcaagggtgcgggcaagggcttcgtctattcggacgccttcgtcgacgattcgcgcctgaccgtgctcaacgcggtcgatgccgccgccaacggggccgaaattgcggtcggcaccgcgctcga

SEQ ID NO: 726585 - DNA, 641 bp, Homo sapiens
  misc_feature (129)..(129): n is a, c, g, or t
  misc_feature (146)..(146): n is a, c, g, or t
  misc_feature (155)..(155): n is a, c, g, or t
  misc_feature (163)..(163): n is a, c, g, or t
  misc_feature (180)..(180): n is a, c, g, or t
  misc_feature (256)..(256): n is a, c, g, or t
  misc_feature (467)..(468): n is a, c, g, or t
  misc_feature (532)..(532): n is a, c, g, or t
gctcgaccttggtgctccgtctccgtggaggaattcaaattttcgtcaagaccttgaccggaaagaccaccacccttgaggtcgaatcttccgacaccattgagtccgtcaagccaagatccaagatanggagggaatcccccctnaccaacaangtttgatnttcgtggaaacaacttnaggatggacgtaccttgtccgactacaacatccagaaggagtccacccttcacttggtgcttcgccttcgtggtgnaatgcagattttcgtcaagaccctcactggaaagaccatcacccttgaggtcgagtcatccgacaccatcgagtctgtgaagaccaagatccaagacaaggagggaatcccccctgaccaacaacgtctcatcttcgccggcaagcaactcgaggatggccgcactctctctgactacaacatccagaaggagtccacccttcacttggtnntccgcctccgtggtggaaactaagataccttaccagtatgcggtacgcgcaatgtccttgcccnaacgtacaatgtttgttgtataaactgtaaattgtaccctgttgtatatcttattagccctttgttgtattttaggggaagtaaaagcgtacttgaaacataaaaaaaa

SEQ ID NO: 726586 - DNA, 398 bp, Homo sapiens
gccagagcttccccgagcaattcaacgatccagggctctgtgtctggcccagtttaactcctccctctctctcccatccaggcttgagataaactaaagctctcctaacgctctgtccaggaccatgcttgggaactattaatgatccacaggtcactttccctaagttccggtcaatctgtcagtccatttctcccacccctcaatttgcaccctcagtctgtcagatagcttgcgcaagttgtcatttagcaatataactggccattcgtccaagtgtgtcctctgatcaagtccaacttcaagaatgctagcttgtccatcgcaatatgtgaaaagccgcggctcctatttgtttatatacactcctgttagtgtgtctgcattcggcgtaagct

SEQ ID NO: 726587 - DNA, 947 bp, Homo sapiens
gcgtgaatatacctagtgcatcttgctctactcagcagtcggtatgacacggatactattgtcgatgtctaagggttgcattgtctgcttaatgcacatattgcccgacgaagagaagagactctctcttgtcacattgtaggagcgacgtgatcctctaatccggacgggtagataatagtgagccctggatgactggtaggctgcgagtcgacacatcttatgagtcgatatggcagctggatgaagtctgaacatgagcggcgtacaacgcaggccatgataactacaacatgcttgctatgtgagcaaatctgattgacagttctcctgcgaaacatagtcgacattctggattccagaggaaacttcctgagaatctgggcggtcctggttcagaactcggagaaattgccatatctgtctggctcttgtcactttgtggtgtgtcctgtcaccagagtcagtgagtgtgtgaccacttcgggaaggtctaacagagtgccctctcagagtaaatgtcacaccatatgtagtctcataggccacgctatggattgtccatgtatatgaaactacttttttgcaccaagttgagtctcgacagacgactggacgtgcttgtgtacgattgtatgagtccagagagggggaaggtctcacgttatcccagagaagagatggcattattcgaggagttcagctatcgcagtgggcattttgacgtggcacgcagaagacgggatccagaggatggtaccaagtaggggactaagtctagccaatggaagccctcctgggcggcacctgagggattgaaaagttggcgaagtactcgcgagtataattaggggtccctctctgatgcggatgtcgttggaagcgttttatacccgtgttcgggggacttgcgaagcgaatttgtagacggtgcaaattacacgtaa

SEQ ID NO: 726588 - DNA, 123 bp, Homo sapiens
cctacctaagaagaacacgaggaggagatgaacgccctgcgagccaggtgggtggtgagatcaatgtggagatggacgctgccccaggtgtgaccttgagccggatcctcaaggaggatgcgt

SEQ ID NO: 726589 - DNA, 1101 bp, Homo sapiens
gcaggcccgtaggcagccatggctgcccagccggaatggcatggtcttgaagccccacttccacaaggactggcatgcggcgctgtggccactgtggttcaaccatgcctggccctgtaatgatcctgcagactgtaatggccctggcaatgccaatggctgctgcctgcattctgcccctgctgcccctgcgtctgggtcccattcctggcccatctgtgctgcttgccccactggttctggtaccacactgaagggtgctgcgccgtgccgcgtgcttcatgcctggagtgagctcatgggttgtgccgtgcatttcacaatgaaaggtggcccgtggaccatctggcatttctgttggatcctgaggatgtgcggaacaatgtccactggaggtcccttgcaggccaacgttgcagcgtgctgacagcgagtacctgctccaaactcatcctcattccccatggaagcccttcggcccccaagaacgggagacagttctgctgaagaactgacaactggccacccatgcttgacctggacctggtcatgccctgtcccggaacgtctataagaaggagaaagctcgagtcatcactgaggacgacgaagaatttcaaagccttcgctagtctccgtatggcccgtgccaacgccctggtcttcggcatacggggcaaaactgagccaaggaagccgcagaacagcgattgtgtgacacaccgaagcgaattacatgcccttcctggcgaccttgggaattcatagtaacacacacacaaattcagagcggcatctatggcacggatgccggaacaacgcggtactctgacctcgccccattggcgcactcacctggtttccttgcaccccgagctatactgtgtaccactggtggcaagcactcgtgccggatacccccaaaatagctagagacgacgcactaacaccttcccaatatacgccgaggttacccttgcttatgatgatgaatgcaccacaacacagcatcgacgacagacatgaatactccgagaaatcacaacgcgagatccacatctcaaaattagcacgagaatacaagcacgaagcagactacac

SEQ ID NO: 726590 - DNA, 195 bp, Homo sapiens
gataggacatcctgaccacccagcctgaagtggcaggcaggcgtctctaccacatcatcctatttataattctctccatagcacttctcattatctggaatgttctttcttttctttcctagagacagggtcttgctctgtcacccaggttggagtgcaatggcacaatcatagctcaatatagcctcaaattcc

SEQ ID NO: 726591 - DNA, 464 bp, Homo sapiens
gtgtccaaattcccgtttttggttttttgtttttcagttaaaaaaaaaaaaaaatttttcaggggaaatttttttttggggggggtgtttaaaaattcccccccgggggtgaaaaattttgggttttggttgggttttaattcccgggggggcccccccaaatttttgggggaatacggggcctttccccccgcgggggtttttccccattttttccaaaaattgggggccggggccggggcccgggccccttccttttttttttttaagtgggggaattttgggcccacaaagtcccccgggcgggtttttaaaaattttccagattcaaaatttaatttttcgttgccccccgggtttttgggcgtttggcaaaaaccagttttttcccccaaagggcccaaccctttttttttgggggggggccttttttggggtttgccccaattaaatttaggaaggcc

SEQ ID NO: 726592 - DNA, 391 bp, Homo sapiens
  misc_feature (54)..(54): n is a, c, g, or t
  misc_feature (135)..(135): n is a, c, g, or t
  misc_feature (150)..(150): n is a, c, g, or t
  misc_feature (153)..(153): n is a, c, g, or t
  misc_feature (189)..(189): n is a, c, g, or t
  misc_feature (198)..(198): n is a, c, g, or t
  misc_feature (219)..(220): n is a, c, g, or t
  misc_feature (235)..(235): n is a, c, g, or t
  misc_feature (298)..(298): n is a, c, g, or t
  misc_feature (330)..(330): n is a, c, g, or t
gtgtgcggtgactctagaggatgccagtgctactccacaaacagattgaggggnacttgttcacggagaaaagaacggacgggggaagttcttcttctttgatggcagcaccctggaggggtattatgtggatgntgccttgcagggccnggnagtttacacttacgacagatggggagagttctccangggcacgtnatgtagacggatgatgctgannacggtccagcccagngaatatgcacacacgatgggcagactggactcttcaaggggcacgtataacagataacattcngtcatggcgagtgtgctggatatattacccangatggaggtagcactcctgtttgtgggaggtagcactggcgtaccggagctcgacattcgt

SEQ ID NO: 726593 - DNA, 622 bp, Homo sapiens
  misc_feature (22)..(22): n is a, c, g, or t
atgaagagcagcactctgttgncgatcctagttctccaggcccttctggtctctacggccgtgcccaaaggacctgcaggcccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagactcatccacagcggcacagccgatggatccttccatgctcctccgtccgtccgccttgctacaagcaggcagccaccaataagctagctcttgttgttgttttgcatgtttgattgggtgtcccttcccagtcgagatggaataatgtcaggcgcacgtacagacgtgttattacgatatttctcccctacaaataaaaactcgatctgtggggttaacactgtcccctagtattacaattaaaaaaagatgttatcacgcatgttaagaaaacatctgaatccctatcttagaatgtatttggtttggctttgtcttttgctccataaaaactaaaatctagaccaaaaaaaaaaa

SEQ ID NO: 726594 - DNA, 134 bp, Homo sapiens
ccagggatgtgccagtctcactgctgggggcctcgccctcgaccctgtagcggtcagtggagagttgcattccggtgtccagcgagctcctgaccctccgcgatctgtctcgttcagaattgtggcggcggccg

SEQ ID NO: 726595 - DNA, 245 bp, Homo sapiens
cagcacaaatctcctgtggtgcatctagtgatccctggcaaatgactgcggccagacggcaggggtagatggcacattacagcgtgcgtcgaagcaataggttatgcaacagcacataggcaaggttatgaaacagtacacaggaaaggttaagtgacttattcaagctggtactaacaccagctgcttagtatcttagcatttatagtcattcattcacactacaaacggtttggtagcatgta

SEQ ID NO: 726596 - DNA, 345 bp, Homo sapiens
acgttctctccataatttattgtgatgtatcaacatcaagtaaaatgctgattttcatcatttgcttctgttcatgtttcttgaacacgtcttcaattttccttccataatgctgcatgccacacttgatgtaacgaagcagaagtatttttacacattacagctaacaacattcattctacagcaatcctatttgctcaatacatgccgtcgtgatcctagtagttttttcaccaccttcttatcgagtttttggaaaacatctgttatgatgactttcattcaccttcacctcaaaggctttcttgcacctcgcatagcccagctactggcccgcattctccg

SEQ ID NO: 726597 - DNA, 942 bp, Homo sapiens
ttggaccgccttttttaccgagaggaggggggtggtggtgtggtgtgtgtttcccctgcgtcgactatatgaaactcctccttgctgttgcagcgtcactgatccccgactgtctttgcatggagacctatttgttgtgtcgtgacttggggagggactccatctctacattgggagtcatcgctcggctttcgttgttgtggggttgttgtgtattagctcgctccctccacgcaggttggggtgtggcccccacccactcatccacgtgtggcgggcagtccacatcttactgcttggagacgcgcatggactggtttccgtacgatggtttggcctcctcgtgtcgtgctccggtggttttttgtgtggtgggggggaacaacatccatgcggtctggccggtctctcctcccccctgtttgtctttgctctctttcgcagatgtggggatctcggctgcccctctcgtgctcgtctttgctggttgttggagtgactcgccgcccttgctttctctcggcacaccacctcgggggctgcttcgctcggtcttgtttctgtctcgcgccaccgctggtggttcgtctagatataagcttgtctctctcttggtgtgtcgtgttgttatgtgtgtctgttaacactccactccccctcgcggggggtccttctaccccctcctcctgcggtgtatttacgtacagagagcaaccactccttgtatgccttcttcttaaatgacctcctccagtattttgctgctccccccttctttctgtagaggaggacgtcttttttacacatctgttgctccattatacgggttggttttctgagcacccttctttaaaccccccccctttttttttccggggtccggcccccccttgggtcaacaaaggggtttttttccaaaaaaaaaaaatggtgacgggtgga

SEQ ID NO: 726598 - DNA, 183 bp, Homo sapiens
caaggtacttaaaggagacgaaggaagttgtggaagaatcagaaaatggaagagacgcccctgctaacgggaatgctgagaatgaggaaaatggggagcagtgaggctgacaatgaggtagacgaagaagaggaagaaggtggggaggaacgaggaggacggcctcacgacggtgatggtgag

SEQ ID NO: 726599 - DNA, 325 bp, Homo sapiens
actttttaaaacgagcctcttatatttttttaatttggaatttttgggggtttttttcccccccaccccttcccaattttttaaacgattccaagggggggtgcaaagtttggagcccttttggggagctgattttgcatttcctacgactttttttgggcaggttttaaaaaacatggaagcatatgctgaggggaggaaataaaaaactggtttttaaaattttgggtaaaaaaaaattttaaaattggggtagatttatttttaaaagggtcagacctcctgacattttaacagaaatttcaagcccctcgcaatattttta

SEQ ID NO: 726600 - DNA, 331 bp, Homo sapiens
gtgtggatttccagtggtcccggtcttactgtttcaaggtttttaaataaaaaaaccaaccctgccttggcccatgcccgcccctgcccgcagttgccaaaaaccccccttgtcgttgtgggtgtcagggtttggtgggctcatgccccacccccaaagtgcccttaaaaggctcctcctgggattgggaacccccgcagggccaggcggacggggtaaggtttgtgttggggctggttttgcccatgctagggggtgggggagctcccaggacagaccacccttgtttttcatgtaaagcagggacgctgtcattaaacacggggattca

SEQ ID NO: 726601 - DNA, 521 bp, Homo sapiens
catctgggtggtctgagtgcctcatttcaaggtaatacgtttttatagcgccgaaaatggaaaccttggcatctaaacgaaacagagctgaagatgtgaagagtaggacaaggcactgtactatggggtttggtttctttatgggaaaggtgtttgcatagattgctaggtatttagggtgcaggaaaagagagcccccagcgtgcatggctttgtgaggggtgaagctgcatggtgctccctcagccccaagagagcgcagtctctcattctccagccccagccttgtgggctgtcccgctggtgctgtcctttagaacccctacaggagagtttttttgctcaaaaagctgcacgtcaaaacggacccagacctccccggtggtgacctcatgcagcagcagtcggcgggtcataggggcttcgtgttcctgttctgttcgaatttttgccactggaatttcagtacgacccaggaaatcatctggtgaaaactggtctctgtcaaacagggtgagaca

SEQ ID NO: 726602 - DNA, 140 bp, Homo sapiens
atcagaagacggttacaggtagtttaccacaaagtgagactagaatcaacggcatcaaagccaggtaggaaaattcaactagcctgtcgcttgccagagcctcccagcccccaacccctgccttgaagatgcttggctgg

SEQ ID NO: 726603 - DNA, 259 bp, Homo sapiens
ccggttccctgaaaattccggggaattgaaaaaaaatataatggggggggtcccttaaaaccggcccaaaaataaatttttggcaggaaaaattttttggcaaaatgttttgggttgcccttttgttggggaaagccaggggaaatagttaaaaaatgttgataaaattgaaacctttgggtggggaattggggggggttttaaaggggttttgtttgtgaaagggagggtttaaaaaaaataaaattcccggacctta

SEQ ID NO: 726604 - DNA, 1104 bp, Homo sapiens
gggtggtgtctcgggataccttgttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagtttatgaagcagtgagaatgcagagagaggagaaggggaggtggaaaaggaaaagcaaaaatagaagaggtgtgggacatgctgtttagaagttccgcttgttgtgaatgtctggaatattatttttatttctccctgagttgggggaagaaagaatggaatatgcatggatggatttgaatcatatagcacatgagactttaacggaaacgcaaaggtttaattgctggatacattctgtttcataataaaattgccactgcccgttaaatctgctttggtgaaggctggattggaaacaagactcaaactaccttcaagctaattggtgcatcaaaatttgcagcatacaaatacctgagagctgtgatttaatgctcattatttccaaattatgagatgatgagcttcatctcaatgggatttaccgtactatggactatgaagtgtttatgcaaattcggaggcaacttttctagagttggattgattttaatttctagagggactaaaatctttgcccctatgcccaaaccaactgctttatttttctctacccaaatttgtcatctagcaagatgatttgacacaagttcttccttcattatttcatcttttggtcagattccactttgtttgaaagcttagttcatcttgttgctgtgccatcagctttgtgtgaacaggtcattaaaaagtcatttgcaaatcc

SEQ ID NO: 726605 - DNA, 445 bp, Homo sapiens
ggcctttcggccggaaccgaccatcttccagtaattcgccataatgatgaacacaacacgggaaagaggagaggcacccgactatatgttctctacgaccttctagaaaacatggagttgttcctttggccacatatatgcgaatctataagaaaggtgatattgtagacatcacggcaatgggtactgttcaatatggaatgccccacaagtgttaccatgggaataactggaaggagtctacagatgttacccagtcatgctgttggtattgttgtaaacagacatgtttaagggcaagattcttgccaagagaattaatgtgcgtattcgagcacagttaagcactctaagagccgagatagcttcctgtaaacgtgtgatagggacaatgatcatgaaacagaaagaagccaacagatgaaaggtacctgggttcaagtaa

SEQ ID NO: 726606 - DNA, 170 bp, Homo sapiens
gcgaccatggctgtgctggcggcacttctgcgcagggccgcccgcagccgcagccccctgctccggaggctggtgcaggaaataagatatgtgggacggagttatgtatcaaaacccactttgaaggaagtggtcatagttaagggcttacaagaacaacccttgtggtc

SEQ ID NO: 726607 - DNA, 973 bp, Homo sapiens
  misc_feature (721)..(721): n is a, c, g, or t
  misc_feature (783)..(783): n is a, c, g, or t
  misc_feature (822)..(822): n is a, c, g, or t
  misc_feature (835)..(835): n is a, c, g, or t
  misc_feature (843)..(844): n is a, c, g, or t
gggtggtgtctcgggataccttgttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagcaaccttccaacataaaaagggagctcacagagtctgaagcaagagcactggcaaagagaggcngaacaaggacaatcacaacctgattgaacgagaggaagagtttacataatgaccggattaangaactaggactttgattcccagtccatgatccgccatgngggacagggaacntttaaagnncgggatatatcgaagtgaagagaaaggaggcaaagaatttaaacggcgagaatggggcacgattgtggccgaaacggatgagggggtgatgcttccttaacgggtgccaatggaggtaagaacgttaag

SEQ ID NO: 726608 - DNA, 187 bp, Homo sapiens
agaggcacagtgtccgtcagaggtagcgagtttcttcatatctcacacaaagagagaagacgatccgtttgatccaaacgcatgagagcggaggatgagggagggaaggacatggaccccctccctttaaaatctcatctgggccttcaaggcacttcaaaagacacagagtggtatagaccgtacg

SEQ ID NO: 726609 - DNA, 1287 bp, Homo sapiens
  misc_feature (1131)..(1131): n is a, c, g, or t
  misc_feature (1134)..(1134): n is a, c, g, or t
  misc_feature (1262)..(1262): n is a, c, g, or t
  misc_feature (1274)..(1274): n is a, c, g, or t
gggtggtgtctcgggataccttgttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagtttatgaagcagtgagaatgcagagagaggagaaggggaggtggaaaaggaaaagcaaaaatagaagaggtgtgggacatgctgtttagaagttccgcttgttgtgaatgtctggaatattatttttatttctccctgagttgggggaagaaagaatggaatatgcatggatggatttgaatcatatagcacatgagactttaacggaaacgcaaaggtttaattgctggatacattctgtttcataataaaattgccactgcccgttaaatctgctttggtgaaggctggattggaaacaagactcaaactaccttcaagctaattggtgcatcaaaatttgcagcatacaaatacctgagagctgtgatttaatgctcattatttccaaattatgagatgatgagcttcatctcaatgggatttaccgtactatggactatgaagtgtttatgcaaattcggaggcaacttttctagagttggattgattttaatttctagagggactaaaatctttgcccctatgcccaaaccaactgctttatttttctctacccaaatttgtcatctagcaagatgatttgacacaagttcttccttcattatttcatcttttggtcagattccactttgtttgaaagcttagttcatcttgttgctgtgccatcagctttgtgtgaacaggtcattaaaaagtcatttgcaaatccaagttatagactgttttgcttggtttntgngggaggattttataagtttgaagagcaaaacagggcagagagcgagtgcccaggcatgaacacacattcacgagcgtcctgtatgcaggactgatgcttgcagcctgaggatgaaccttgtaatgagntatatttggggnggacccctttctg

SEQ ID NO: 726610 - DNA, 161 bp, Homo sapiens
gggggttttccccctggggggggggggggggcccccttttttttttttgggggggggggggggggggccccccctttttgggggggcccccccttcccccccccttttgggggccccttttttggggttttttttttaggggcccggggggccccccccca

SEQ ID NO: 726611 - DNA, 398 bp, Homo sapiens
  misc_feature (60)..(60): n is a, c, g, or t
  misc_feature (142)..(142): n is a, c, g, or t
  misc_feature (265)..(265): n is a, c, g, or t
cttggggttcctgtttgttggggaaccagggaagttgaaaggcctccacagggaaggaanaggttggtcctccctcctcccatatggtggcctgtgaatgtaactctaagtttgaagtgttagcccttaggctctttgtgtncctcccctagtcccaagggcaggagggatagccactgttaactgtggcagtggccaaggggctgtcgtatgcctttgggagcctcttctcagggaaactctgtgtcactaacagtgggtatgnctcagccatggctggggtgactgttctgcattcatgaccatggccctgcctagtgaagagtaggggtgggggttcctagggaggaggggctgcactcctgtctgtatggtggctgtggtgtgctaaaaaaaaa

SEQ ID NO: 726612 - DNA, 255 bp, Homo sapiens
  misc_feature (62)..(62): n is a, c, g, or t
agcctacacgactccccttggggcttacttatcggaggcacttacgttacggctcacgccanactccacggacgctcacacagtgaccactcctcacggacctttctcgtcggcccactctctcacgctacccctcggctacggcgttggctatccctatctcacgacggaggcctctccttactgtacggggcaacacggaacgacccattggcacgctccacgacgtacaccactacgttcttacccggtaca

SEQ ID NO: 726613 - DNA, 808 bp, Homo sapiens
tgcaggggctcacacctgataatcctagcacttatgggaggccgatgctcggtgggtcacctgaggtccggagcttaggaccagaactagccaacatggcgcaaagcccgtctactactaaaatatacaaaaattaggcaggcgtaggtagcgacacgcctgtaatcccagctactcaagcaggctgagcgaacggagaatcgcttgaaccacaggaggtggaagtagcaagtgagctgaaatcgatgcacactgcactccagattgtagcgacaggagggaggctcacatctcaaaaaaaaaaaaaaaaaaaaaaaaacagagaaacacgcgcaccaacaacagaacatcactaaaaaacatatgtgtcacccatatcattacttaccagcaaaggcaaaaatatatcacaatacgagtctaacaaaaatatacaaaaaacacacattcaaccaacgaaataaattatagtgtgcgcgcaagagcagataatatagcgacaaatgtatacccaaattgtcgcagtccacagtcagtctcaatgtagcctctcaggagaagacgatataagaaaaagtaccggagaacaaacacaagcgtaggtttcggcggccgctgtaacaccaacaattaacaaagtacctataaaacggaaaataaacataaccaaaaccctactctaacatctaacacagaccacaaacgagttccacaaaaatactactaacaacactccttaatcaattcaaactaaacacataaaaacaacaacaaaaaatataaccaccataaaaattatacacatata

SEQ ID NO: 726614 - DNA, 284 bp, Homo sapiens
gtcgacgctgcttggaaggctgaggcaggagaatcacttgaacccgggagcggaggttgcagtgagctgagattatgcctgggcaagaaaagcagcgtgggactacaaacccccggccagcatgcctggctaattttgtatgtttagtagagacagggtttcaccatgttggtcagtctggtccagaactcctgacctcaggtgatctgctggcctcaacctcctgaagtgctgggcacgtgctggcctctaaattcctcttacagagactcattttcatggtt

SEQ ID NO: 726615 - DNA, 134 bp, Homo sapiens
gatcgagctggtaccgggtggggagtcggaatctgcaacagacaacagcagcaacacagcagcagcagcagacaacagcatcataatgcgaggtacagcccttaaccacagcgcctagtgattccgtactcccc

SEQ ID NO: 726616 - DNA, 348 bp, Homo sapiens
gtgtgatctgggctcagtgcatcctttgcctcacaggttcaagcgattctggtacctcagcctcctagtagatatggggtttcaccgtgttcccaagcctgtatctcaaaactcttgacctcaggtgatctgcccgcctcagcctcccaaagtgctggtatcacaggcttaagcctgtgtgcccgcccttttttttttgtttttttttttaattattgagacgaacccttgcgctgtcaccagagtctaatgtgcactggcactgtcttgcgctcactgcaacctccgcctcgcgggctcaagcgactctaggagtctacaggttacagtgatctgaaaaggcgcccc

SEQ ID NO: 726617 - DNA, 120 bp, Homo sapiens
gtgcacgtgtgggtatgacgtgtgtgtactgtctgcattgaaacaatgtaatcatgtgtcttctttttgctttaactgacttatttcagaaattgtacagtgttgaaggagaaatctcgt

SEQ ID NO: 726618 - DNA, 419 bp, Homo sapiens
agattctcactgtaggataagggagatttggaatgaaagaaggaaaatgctggtgttttgttatttgtaattagttatggaaaaaaattactaaaacaagatttttaagtgaaaagaaaagaaaaaggctggccaggcacaggcctgtaatcccagcactttgggaggctgaggcgggtggatcacttgaggtcaggagttcgagaccagcctggccaacatggtgaaaccccgtctccactagaaatacaaaaatcggccaagcacagtggcgcgcgcctataatcccagctactctggaggctgaggcagaagaatcgcttgaacaccggaatcggaggctgtagtgacccgagatcgcgccattgcattctgcactccagcctgggcaacagagtgagactccatctcaaaaaaaa

SEQ ID NO: 726619 - DNA, 926 bp, Homo sapiens
taacgaatgaggcaatttataaccccatcatgtgttggttctaatgcttcttgtgtggcagctgccaccgtgtccgggattctgtccagaatctccttgtgtccctgaggtgtcagtttgcggccgccatttgtggtccttttccaccattttcagcccctccagtggcttggaggcacccggcggtgccacactcttgtgagcctcggctgaagtggctgggcttgaccgccgtttctctgacgtcccccatacctctgtggcccctggagccaaccccaggccccccggaggtacaggtgcctgctgcttgtggaagccagtcgcgtgtaaaaccagttctcatcgtagggagcaagctcttgtgtgctgtggccagcttgactggtcatctcacccattgtggcgactttcagcttcccggattttttgacgaaggctgccagagctctgcacgcaactcctgcgtggtccacgtctttcacagctacctcccaggcatccgtgcggcagcgcctcctgctccgcccccttcctatcggcagcacctccagcggtgtgaccgggtgtgcccttaactgccacggctacgtcggggcgccctcattccctgggcggtacccgtcccggctttggaccttcccctggttcccgaacatttctgcaccttcacctctctccgccccccccgtctccccttttgccgggcgcctccgcgcggtgcaatccgtcttgccggggccccgggcctctctgacatctcggctgtgccctgcgacggtgcccctgctggttgtctgcccgcaggccccccgctctttctccctgcatcgtcgcccgtccttgcacccggggcctcggcctgcgaccggctccccctgccgcctatctgtgctccggcgcgtgcccacccactgctcacgccg

SEQ ID NO: 726620 - DNA, 127 bp, Homo sapiens
cccgtgctaccagctacctgaatcacattggagcggacaggaagacacaccgagaggtcaagaacacaaccaagctgtgctgcaggaggtcgtcaactccaaaagctatttattggtttcacaagga

SEQ ID NO: 726621 - DNA, 895 bp, Homo sapiens
agccgggtggtctctcgaggccgtccctgcggctaatctctaagtccgggccgcggtcggcgtctcctctggggctcggcccgaaccttggttcctcatctgccctgagatgggataatccccacaggaagtaattaagtgcacaagacattggtcaacaatggtttccaaaaagaagactgtcaaaatctgaggataagagagcctggaagaagatgcctccaaaacaggaagcaacactttccaaaaagacaacagaaatctcatattgtaatgaagttgaagaaaatgacagcatcttgtaaagcttcttaagatatcaggaattattcttaaaagggagagagtcagaatcaactagctgtggatcaaatagctttccaaaagaagctctttcagacctgaggaggaaccttcctattccaaaataatagaagaattgttagtggctggaggtcttacattgaggatgaagaaccggtttcaggaaatggctttgtcttgtgagcgtttgcaaggatgaggaagcaagtatgggtggcatcttattctaagagtctcatcaaatgttctggggattgacctactggagctgcatttatcagaactttatttgtgagaagttgcagaatatttgttttgaaaacaaagaaacagtggatgaaatcaaacatactggaatcattgtcaggcaactaacaatgggttgaagagttgtggatggaaaggacttaacaggaagatcatgcaggtgatcagattgggacaggagaactggggatgagtgatcaaggtacgtgaggatctaagggaatcaggaaggtggtgtgggggaagaagagaggcagtgttagatataggagaggcatgggggttgagaggtgcaagtatatgg

SEQ ID NO: 726622 - DNA, 257 bp, Homo sapiens
ctcagaatccgggccagcttagccctccataacgtggacagatccatcggagaaaagacagaagcggctgtgaccaacaggggcgaaaggctgggaactgggggaggatgggtgtgctggcatccttctccttgtagcctgctgggacatcctggaggtggagacagctgcctgaagacgattgctccaggacttggcctgcgactgaaagggcaccccaaatgatcggccacccccctccccttatccagagcctt

SEQ ID NO: 726623 - DNA, 132 bp, Homo sapiens
  misc_feature (61)..(61): n is a, c, g, or t
cagtggcacaatcacagctcgttgaagccttaaactcctgatctcacgtgatccacccaantcaggttcccaaagtgctgtgattacaggcgtgagccaccgtgccaggcctaattcttgtctttattacta

SEQ ID NO: 726624 - DNA, 312 bp, Homo sapiens
  misc_feature (28)..(28): n is a, c, g, or t
  misc_feature (91)..(91): n is a, c, g, or t
  misc_feature (115)..(115): n is a, c, g, or t
  misc_feature (128)..(128): n is a, c, g, or t
  misc_feature (178)..(178): n is a, c, g, or t
ggccaccgagggggtcggggaggctgcnaagggggcgagccgggcagccgcgcaacccccgcccagccgcaccaccgccgcccagcagcanacaaggaagagatggcggccgagntggggaagcgtgngtcccccatggacgacgggtttgtgagctggactcgccctccctatgtcntgtacagggacagagcagaatgggctgatatagatccggtgccgcagaatgatggcccaattccgtggtcagatcatttatagtgacaaatttagagatgtttatgattacttccgagctgtcctgcagcgtga

SEQ ID NO: 726625 - DNA, 113 bp, Homo sapiens
ctcttgttcacttttcccgtatcttgtccccagcagagacattgatgtataccattggcatcaatgtcacaagtgacttcaatctgatggaacacctcggtgtacacggaagg

SEQ ID NO: 726626 - DNA, 790 bp, Homo sapiens
agcgggctggtttgtcagccccgcggctgcgggcggcgggcggcgagcgcgctctgaggttcgtccctcatcgctgaacccggcgtactcccgccgtgagctcctcggggaggggggcggtcggtgcctgtcgcagagccgtctcctcccgcgcttggatggagtccgagcgtagacaacagtgtggaagggagccggccgcacatctcaagggaagggctccgcagcaaaacgagccagagtggcatggcacagcgtgatctggggcaaaggcgcgagagccggcgatccgaggcagggacacgttgatggatgccacaaccaggaagactggacgaccagaacacggacgacacgtcggggcccacctgggaaaaggtcgagtcgcaaaggaggccggacgtggatgagaaagcgtggcacaggaaggcctaatcgttgcagaaaatgagccgggaggagttcgccgttttccaccgagaggaaataacacatcgctttaccgagaagcggatgagcgcccatatatccggggccacgagatcggagcaagtaagccccagggaacatgtgggcggaggcacataattttggcagagcgcagattagcaggcgcacgagaggggccgaaccaaaggaccaccggagatacttgcacgggaaaagggggaaaggcagaccggtatggcgccacagggaccccatagagggcgatagcggggcaccaaacattcccggtgggcggcccaggggagcagcacagaaacaaaaagaaggcggcgcaaaaact

SEQ ID NO: 726627 - DNA, 273 bp, Homo sapiens
ctattcagatagcatttacattgtattgggtattgtaagtaatgtagagatgaagtatatgagatgggctgggtgcagcggctcaagtttctcatcccagcaatttgggaggcaggagaatatcttgaacccgggaggtggagtttgcagtgagctaagattgtgccattgcactccaacctgggcaactgagcaaaacaccatttcataaaaaaactgctaaaaaaaccccccagtaccctgtttttatgtgttctgggctgttaattacaa

SEQ ID NO: 726628 - DNA, 179 bp, Homo sapiens
aatgtcgcatcggtctgttttctcacgtaggggccgcctctgctcatctcactagacatttgtaggaacctcctgccttgtggttcctcttttttctcacaaaacagggacactgaactgcgtcagcctcagctcacccctccttagcccaaggtcttcctcatgcttgccacctacta

SEQ ID NO: 726629 - DNA, 387 bp, Homo sapiens
  misc_feature (103)..(103): n is a, c, g, or t
  misc_feature (112)..(112): n is a, c, g, or t
  misc_feature (117)..(117): n is a, c, g, or t
  misc_feature (120)..(120): n is a, c, g, or t
  misc_feature (122)..(122): n is a, c, g, or t
  misc_feature (134)..(134): n is a, c, g, or t
  misc_feature (146)..(146): n is a, c, g, or t
  misc_feature (149)..(149): n is a, c, g, or t
  misc_feature (156)..(156): n is a, c, g, or t
  misc_feature (169)..(169): n is a, c, g, or t
  misc_feature (172)..(172): n is a, c, g, or t
  misc_feature (178)..(178): n is a, c, g, or t
  misc_feature (182)..(183): n is a, c, g, or t
  misc_feature (188)..(188): n is a, c, g, or t
  misc_feature (203)..(203): n is a, c, g, or t
  misc_feature (239)..(239): n is a, c, g, or t
  misc_feature (272)..(272): n is a, c, g, or t
  misc_feature (278)..(278): n is a, c, g, or t
gatccccttgtacgcttctgagaaattctaagctatatgttcaaaaaccccagaaaacgtatatagaacttctgtctgtgtcccaccaggactggtcacttgnttttcttgncgtantcngncaagatcagatncttgagctgganctngaacttnatccattcttcgncantcagantggnncagangtggtgtggttctgnaatagtagtcttgtctggcttcaggatcacttttgnccgatcgttgttcacatgtagggcacgcagaancaggangagacgggagaagtgcggttaagattgaatagtcttgagccagtcgtcatagaggtttgaagagaaccaatctgggtgctccagtgggctttaatggattgagatcccc

SEQ ID NO: 726630 - DNA, 357 bp, Homo sapiens
  misc_feature (73)..(73): n is a, c, g, or t
  misc_feature (82)..(82): n is a, c, g, or t
  misc_feature (87)..(87): n is a, c, g, or t
  misc_feature (90)..(90): n is a, c, g, or t
  misc_feature (92)..(92): n is a, c, g, or t
  misc_feature (104)..(104): n is a, c, g, or t
  misc_feature (116)..(116): n is a, c, g, or t
  misc_feature (119)..(119): n is a, c, g, or t
  misc_feature (126)..(126): n is a, c, g, or t
  misc_feature (139)..(139): n is a, c, g, or t
  misc_feature (142)..(142): n is a, c, g, or t
  misc_feature (148)..(148): n is a, c, g, or t
  misc_feature (152)..(153): n is a, c, g, or t
  misc_feature (158)..(158): n is a, c, g, or t
  misc_feature (173)..(173): n is a, c, g, or t
  misc_feature (209)..(209): n is a, c, g, or t
  misc_feature (242)..(242): n is a, c, g, or t
  misc_feature (248)..(248): n is a, c, g, or t
gtagggcgagatctcataccaggatgatgtctcgaactttctgattgtgtcagtagatgccacgttcacttgnttttcttgncgtantcngncaagatcagatncttgagctgganctngaacttnatccattcttcgncantcagantggnncagangtggtgtggttctgnaatagtagtcttgtctggcttcaggatcacttttgnccgatcgttgttcacatgtagggcacgcagaancaggangagacgggagaagtgcggttaagattgaatagtcttgagccagtcgtcatagaggtttgaagagaaccaatctgggtgctccagtgggctttaatggattgagatcccc

SEQ ID NO: 726631 - DNA, 453 bp, Homo sapiens
aatccactgcacagattcttcacttgttagaagccactaggacttaggagtttctaagcttttgcttttaactacatgtgcaataataatatttggataggcacattttaggaactttgtggcaaattattctgttgataagtagattattatgagctgtgaaatatcaaggattaccaaaaaagggggcaagggataagaaagaatccatatttaataaccaaagaaaactttaaacccggagcaaaacaatgttcctcaaatgcaaataggaaaggacagccgtgattataacgttttgctcaagcattttcttctttgttcctctaacttaacagaagttgaaacaagtgaaaataggaaatttccatttagaatacaaatcctgtaagtcacagagcaagtcggaaaataataaacaaacaaacaaacacccatgccctgtggaaaata

SEQ ID NO: 726632 - DNA, 925 bp, Homo sapiens
gaggcggagctggaaccgcgcagcgcatgggaacgcgtccgctgctatgggtcaggttcgccggtcgcgggagcgccgcgcgtgcagtcggaggaacacgtggccatcagataactcgatgatgcaagccagttcgcatcacgcttgcatgagccatcgtgatcgcgtgtacaagccaggaaaggaaattcttcaatcgctgaataagatgggaggatgtcaagatatgggacgcttaccattttcgatcagagtttcttctgggaaggcggccgattcaggaattagtgatgagtttaaggtgaagaacacgggatattggacagatattgctacatgggaatgtcgacgcagcacaagagacatagagagtgcccatgtcaagcctgctcgttgtcatcctgcaggacttgtactggtgtgtgcccgactgctcgtgttgacttagctgcgaaatgcgtgatgctgtgacacaagagttgaggaggagatccagagaaacatgaaaaccgtgtctggccatgggttgagtcttggcaattggattgggtgacacaatacaagggtatggattttcgaccggggaaaggggctatgcagggttaaaaagaaagatgtcgggaaacctggaatttgaaaatgaacataggagaggggagtagggaattttaaaaggtgggtgggtccactgggggaacctccaaagaccatggccgggagttcatgaccccaccaagggggcccggtgacggcaggccaaacccagcgaggacaacttgcgggacactatatgaggggaaagaagaggacatggacggaacagggaagggcaaagaaaagcaagcgagagaaggggacccagggggtccaggggaacagaggggaacacggacacacgaaaggagggggaggtcaggcaaaaacg

SEQ ID NO: 726633 - DNA, 460 bp, Homo sapiens
  misc_feature (252)..(252): n is a, c, g, or t
tgtttacatggaatgtcatgtatgtcatacccacacaagagtctaggtctatgctaagccttgctctctaaagcattccaccttgagagacgttttcactctgtcatgtctggcacaactttggtaaaaatattagctgtgaaattcttctgtgatcgcttttttttctctcctcagtaagcacaatatttatccttctaaaaaagtatcacaagcctccttaggatgtttcacctttctcttcctctctantcctggtgttacttggcatccaaccactttttcctctcactaatacaggtgcttccactgcaaaaccacatttcagccaaggactggctctgaatgaccaccgtggatctatggcctttccctccacttgggaaagctcttcagtcagcacaggtactgtaggcggccggagaaaaaaagctcataataactggtgggagtctggcct

SEQ ID NO: 726634 - DNA, 1033 bp, Homo sapiens
gtcggtcaatggtgttgacctccgcaatgccagtcatgaacaggctgccattgccctgaagaacgcgggtcagacggtcacgatcatcgctcagtataaaccagaagagtatagccgattcgaggccaagatccatgatcttcgggaacagcttatgaatagtagcctgggctcagggactgcatctctgcgaagcaaccccaagcggggcttctatatcagggccctgtttgactacgacaagaccaaggactgcggtttcttgagccaggccctgagcttccactttggggatgtgcttcatgtaattgacgccagcgacgaagagtggtggcaagcgcggcgggtccactctgacagtgagaccgatgacattggcttcattcccagcaaacggcgggtcgagcgacgagagtggtcaaggttaaaggccaaggactggggctccagctctggatcacagggtcgagaagactcggttctgagctatgagacggtgacgcagatggaagtgcactacgctcgccccatcatcatccttgggcctaccaaagaccgtgccaacgatgatcttctctccgagttcccgacaagtttggatcctgtgtcctcatacgacacgtcctaagcgggaatatgagatagacggcgcgattaccactttgtctctcccgggagaaaatggggacgggccttccgggggcacaaggtcatggagggtggcagtacaaaaggccaactctacgggaccagcgtccagcagagcgaaagagtaacaacacgggaaccacggatcttgaggctctagcaagccggtggggtgaagggcaactgacacatagcaatatacggccggacgggagaagggtgaaaaaacaggcgaaagagaaccgaagaccaaaggcaacggcgagcatagaggtacacaaagcggcaaagacaacaagaggggcgaacagccaaagacacagaaaccaggggacccacgggaaaggacaccatgacagacggcacccgagcagcgacaccacag

SEQ ID NO: 726635 - DNA, 235 bp, Homo sapiens
atcggatccagcggattatgaaattcattcattcaggattcattcacataaagaaagcacaacgatgacaaacgtcacgttacagaaaggagcaaagatcaggaaaggcttcgagagggaagaatttcacgtctccaagttgggccctcaactggtagaaaatgcagagaagagacctccaggtggggccggaaggccagcatgcgcccaggaagcccactttcttttccttttt

SEQ ID NO: 726636 - DNA, 351 bp, Homo sapiens
tatcgtcgtagcgagcttgatggaaatgttggtggtttcggcaccacacttcctcgcgtgtgggataacgtcaagaaggagttggagctcagcggcgaagtcggcagtggaagactggttggccatggtgttgtcctgggcgattgatttgatgcgcccagtatcaagcgggctttgctgtgtcatcgggggggtggccgccaaaatgcaaattcgtcacaacccaagctgggccgcgaggaatgccgcggctcgcgctgatcagaccaatagtggcatccccgcgatcctccttgctcctcatccagccggcttccaggcagcgttcggcggcaaaggtaccgtcggtga

SEQ ID NO: 726637 - DNA, 247 bp, Homo sapiens
acctccttacccacactacttatatgattcttgtctatacaaaactagcatatatacattctgtggtgcagcatgccaaaaaacattactctgtcagtaattacaaactctctggggaaccatctagagcctcttattctacccatccataaatttatttccactgatttatttaacactggcgcttaataaatacattatataaatacatagcagtgggtaccagcagctgcgaattacgtacatc

SEQ ID NO: 726638 - DNA, 210 bp, Homo sapiens
  misc_feature (59)..(59): n is a, c, g, or t
ggggggggcccccccttttggggcccaaggggggggggggggggattttttgggtcccncccccccccccccccggggggaggggtttccctttttttcccccccccgggggggtttaaggggggggggggggggggcccaaaacccaaatttttttttttccttccccccccccccctggggggggggaggaattttttttccccccca

SEQ ID NO: 726639 - DNA, 600 bp, Homo sapiens
gtagctctacacgagtccccttgcagggctctctaccctggcagtggtacaaccggtacaccggtagcgggggaccttgaatggtgataaggagtggggcgcgccgtgaggccagagacctatgttcatttagcctacataaaagacactcaataaatagcgggtacaataccaaatgaatacatacatatcatcggggtgggggtcagaagacagcagtgcccacgcgggcatccgtcaggaagtgtgggccttggtgtatggatgctacacatgtctagggcgggccacttcttctgtacgtctgtgggacctcagcatacccaataggcagcaagtttcagtatctcccagaggtatgtcctcaggggggggctatgtctcccccaccacttcccctctcatcaggctagactttaacatccatcaatcatgtctggagtctggctccttcctctgggctaagtcatgtgactacagatcagatgcgtggactagtgtctcaggtgtgcaggtaccatggccccaaatgctgttgtatctgactgaggacaatgcctgtctccggcgtccaggacggtaggtgagaggtaagagctg

SEQ ID NO: 726640 - DNA, 342 bp, Homo sapiens
aatcatccaccagcgcttcacctacgcaagaaaaaagggctccagcatggtcctagatgacggaggaattaaattatcgtcttccatgtccacccctatagtcagtgtttactgtgtggttactatggccaggtactcttctaagcactttattaaaactcaatcctcacaactactctgtgaagtaggtactcttaccacgaaacatattttgtgtaagagcaaattcaagcctagaaaaattcagttatttgcccacagtcacgaagcaagcacagtcccagcagtttgacttgattagcccccaccactctacagagagttctacattagcaaggacct

SEQ ID NO: 726641 - DNA, 117 bp, Homo sapiens
tgacagcctataagtcctaggatcacagttaaacactccaaatcacccgctaggatctcttttaagtgtactttcctgctgtaaaactttttaataacacgtcccactcctgctact

SEQ ID NO: 726642 - DNA, 226 bp, Homo sapiens
ctatgtaatcctagattggtctcgagcatttcggctttgacttggtggacaacttggtccaccagatccatgaacttgctcacctggtcttgttgccccacttaggaaggtacttagcacaagaggacagattcgacttcctgtgattcatctgcaacccaaccgatcagcacatcctgtcttccaaccctacccaccaaattatcctttaaaattagggtaggtg

SEQ ID NO: 726643 - DNA, 647 bp, Homo sapiens
gtcgcacgatgggccgccctatgggcactgagctgtcccgggaggcctgtccatccgtgaggaccgttggaggagccccgtctggatgttaagcggatgccaagcggatgccacagttgcacctgacagcggactccgtggggacatggctttgctggagtccctttcaccgtatctaagccccacgggccttctgctggtcagctgcgacctgtgcttcgtgcgagcagatcggtctacctgtactgtgaatgtgacggtcactcaactcagagccaactcggtgactgtgtcctgtgacgtcccacaaggcaacatcgtagttggctactccatattccaattacggcataatgtgcccgtgcagagtgtgattcgggaggtgaacaccaccacacggtgctgtgccctcttgagcctggctgaagacagtgactacacagtgcatggcatgagcatcggtcttcggcgagagagtccccctagggcccggttgcacttccgaactctcaagggttctgaccggctaccttccacgttaagctcaagtgacattacagtggaaggtctgatggagagcgggcactgcatactggtggagagtgcatcattcgggcggtgttgctcatgtgggctgatgttggccg

SEQ ID NO: 726644 - DNA, 157 bp, Homo sapiens
aatctggagagttctggacagcctgtgccacgggacactggcatcctgtacatgagcgctgcgtcctacaagtacatgccacgatgtgtctgagaaactgcgggacccaagaatttactacattaattcggcagcctcgttcttcgccttcatccgc

SEQ ID NO: 726645 - DNA, 127 bp, Homo sapiens
aggatcgagatggtcacaatggtggagaagatgaagtcacagaagtagttttgagcaacaagatcccaaagatgctcagagacctgacatgtgcttattatggctccatggggtttttcccatggag

SEQ ID NO: 726646 - DNA, 590 bp, Homo sapiens
ttgctgtcccagagtatctccatcaccctaaattattatggaactcctaacaattaataagaaaaatatggaaattttaggagaagaaaatgcttcttgaaaacatatgaatcagcataaatcagagaggaaatctgaatagttaacaagaatgcattataataagaaaaataaacagttaaaacatccgtatatcattttatgtccatattgttggcaaaattagaatgatgaatagtaacacgtattggtaaagatactgagaaaaagaatgcttatatatcgccattgggagccttaactaatgaaacaattccagaagacaatttgttaatatctactttgcttaaatatctatatacctgacaacccagttattttactcttggtatatatattgcaaataattctcataagacataagtgaatatgaataaggacatttatttgggttactggctagctgaatataagctgggttcctcttactaagagaatacaccattaaaagttggtggatgcagtctagggaaaactgtgaagcactgaagcaacataataaatttggggttgatggggtaccgagctcg

SEQ ID NO: 726647 - DNA, 469 bp, Homo sapiens
ccatgaacatgaatctttgtttgctttttgagcgtaagctttgagtgctacatcaatttctgatccttccggagctacaggtagattcaccggtgcatccttgtcgaagtatgcgaactcagagctcaacactgtaaattcaaaggcatttaaatcatgattttctgcatttcttttaaaagattccatgatagcatcaatccattggttgagtacttctgcactttctgtaaaaaatttgaacgattcacctgtggctgtatttctgatcttaaatgagaactcgtctgtgtttggattcgcgttagaaatttcagtattactagtctttctatctccatacgctgttgacatgtgatttccagaacttttaagcagaggtctcatggagttaatcggtgtcgaaaaattatgcattggggatttatgttctttctgagagtagtttctcagaggctgtttacttgtt

SEQ ID NO: 726648 - DNA, 160 bp, Homo sapiens
ggtggtctgaactccgacctcagtgatctgcccacctcagccttttaaagtgctgggattacaagtatgagccaccatgcttggccatgtttttcttttctttttttttaaatttgccttgccctaagaaatttttaataagttcccatgcacaactggt

SEQ ID NO: 726649 - DNA, 155 bp, Homo sapiens
  misc_feature (149)..(149): n is a, c, g, or t
  misc_feature (152)..(152): n is a, c, g, or t
ggctctgtggctcactcatcatgtcgtcctaagcaggtcacctgactcctgtggacctcaatttatctatccatgaaatggacacagtgaggggaaacacgtatcctggtgttacatcataatcccggaatatgcttcatctcattcantcntgt

SEQ ID NO: 726650 - DNA, 403 bp, Homo sapiens
  misc_feature (61)..(61): n is a, c, g, or t
  misc_feature (74)..(74): n is a, c, g, or t
  misc_feature (160)..(160): n is a, c, g, or t
  misc_feature (309)..(309): n is a, c, g, or t
  misc_feature (319)..(319): n is a, c, g, or t
  misc_feature (348)..(348): n is a, c, g, or t
gaagatgagtccaaagtaatttttttgtttttgagacagggtctcgctctatggcccaggntggagcgcagttngttgatcatggctcgctgcagcctccagctcttgggctcgggcaatcctcccatctcagcctcctaggtagctgggactgcgggtncatgccactgtgtctggctaatttttttttttttggcagagacaaggttttgccatgttgccaaggctgatcttcggactcctggggcttaagtgatctgttccattccctgctttccgcctcttcagagtactggggattatagggtncgagccactntgcctgggtccccaaagtaatttttttanttgtcccggcttctcatctgtttcccagagtttttccccattcaataaggtcaat

SEQ ID NO: 726651 - DNA, 490 bp, Homo sapiens
taggcccagagactgtttcagaagagatgggtgcatgagattgtaagggctggttttgagggacacagttagctgagacactgcaaatcaacgagggtacacaagtgcctaaacagcttgtaaaacaaagaactttgctttctcagctattacgtggcacctttttatccaccccaaccatgaaaaatgtcctgcttcctggaattaaaagaaaataagaggataaagatacctcatggccaagcctcctgggcataatactcccagttataagttttgcagatatatatatttagatatataaaattattttttagaaaaatgtatatgttttgtatagttaatcactgtaagcctataattaaaaccaagattatagtagctcaacgcatagaaatgaaagaaaactcaatttttgtaaactcgccattggctttttgtttttggctctttactttaaataaatcttttaaggggtaatgaaaaaaaa

SEQ ID NO: 726652 - DNA, 688 bp, Homo sapiens
tctggaggctgagatgccggagatgcaggtgccctaggaggccgagactcgtgtctgctatcgaactccagatggctcagacctgcatcgatagtctcagtcatttacttcagagaccgactcatatcccaggaatggtgtgtgatgtgcagccacagtacgactgtgatcgaccagagccacgcattctggactccagaggactgacaatcatcatccgagctgtgacatagacgagcaggagttgtcagatgttattgcatcctgggtcatgcttccggatgcataatgtagaattgccttgacgtctgcgaatgagaactagttccactggactgacaagttccatcacatcttcatggtcaattgggtgtcttgtggaccaatgtagtaacctgactatggttcatggtggatgcctatgacagaaaaggttgtcacaggcagggacatttatggcacgtatacaagattgtaaccgtttgatggaggtttgatatttcaactaatcaagatgtgggcaatctgcaaaagatgattgccatgcctgaggaaccgctctgaccctacaaggactgcaataactttgaacaactcggtgtctgactcttagcctctgttgtgtcatgccagttaagctgcagataaggaagaaataaacgttagccaaggtggagagcgctcagac

SEQ ID NO: 726653 - DNA, 795 bp, Homo sapiens
gccaccgccgaggaataccgtgtactattaggccatggtcaagccccaccgtgttcttcgtagcattgccgtctgacggtcggagcccttgggcccgcgtctccttgtgagctgtttgcagacaaggttcccaaatgacagcagaaaatttgtcgtgctctgagacagctggcagagaaaggatttggttcactaatgggttcctgctttcacagaatttattccaggcttcatgtgtcagggtggtgacttcacatcgccataatggcactggtggcaaagtccatctatgcggtgagaatactttgaagatgaggaacttcatcctatggcatacgggtcctggcatcttgtccatggctaaatgctggagccaacacaaatggttcccagtttttcatctgcactgccaatgactgagctggttggatggcaagcatgtggtgttatggcaaacgtgaaagaaggcatgacatattgtggacggccatggagcgctattgggtccaggaatggcaagaccagcaagaagatcaccattgctgactgtggacagacatcgaataagctttgacgttgtgtcatcatcttaaccaccagatcattccttctgtagctcaggagagcaccctctacccatttggtcgcagtaatcctagaatctatgtgctctcgctgcaggttcactttgggttccatgtttgccttgttcccttccatgcctagctggattgcagagtaacgttcactgattatgacattaaacactaaataacagaaaatataaacaaaaca

SEQ ID NO: 726654 - DNA, 207 bp, Homo sapiens
cctgctggaggtagggctcgtgtcatgttatatttccttcaataaactttccacccagaactagggctacaaacataacgacgttataggaatcatacggacaattttagtgggcaatcacatggccatctttggcaaagtcaaattcctcagaaagcaatccagacaagcaacacagttcaagaacatcattcatccaacagcaag

SEQ ID NO: 726655 - DNA, 449 bp, Homo sapiens
  misc_feature (8)..(8): n is a, c, g, or t
  misc_feature (33)..(33): n is a, c, g, or t
acggaaanccccaacagtccaaagtttggatgngggaaccggaatatttaccatattccggcaagtgtttcccccccacacattacttttttaattaacaaaaggtggatataacccttaacccaagcaattaaagcctagccatcacccaatattgggatgaatccaacatccatatgccctcttgatgtgatatactaagaaggacaaagtgtccaattcctttggtattccctgtgaaaaatttataacttgaatcttaggaggaaacatcaaacaaatccatgttgagggacattctacaaaataacttgcctgtacctttcaaaaatattaaggtcaagagacagaaaggctgaggaactgttccagataaaatgagactaaagagacataacaactaaatgcaatctgtgatcctgggttcgaacctggactaggaaaaaaaa

SEQ ID NO: 726656 - DNA, 132 bp, Homo sapiens
caaatctctccgcagcctcatacagtgtctgtgcatactgtctcacgagagcatctgtcagataattatcttcattcctcccaccagctgagagagacaacaggactcgctggaacatgaatgatgtgttag

SEQ ID NO: 726657 - DNA, 501 bp, Homo sapiens
agtcccacaggggcagtattctatccttggacagcagtgactgagccctggaagcaatgatgtgtccccaacccagcacagggcattcaacagctgctcaatcagtgtttgctgaatgaatgactccagagaataaacaaacaggatctgatgtggaacccaaccgatgaggaagtcacaaatgggaactggataatgtgcatcatcagaaagtgactagataactacagtccatctcatctggctcagggaacacccttgagcttctcaaacctctttacagccaaacaggttaacagtggcaaagctgggggaaaggacaaggaaaacggacagacacaatccaaaaatgattcataaaacttgtgtttgaggctgagcatggtaataatcccagtactttgggaggccaagggaggtggatctcttgagcttgggagtcgagaccagcctgggcaacatggcaaaactccatctctaataaaaatataagaattaaaa

SEQ ID NO: 726658 - DNA, 310 bp, Homo sapiens
agctattcaggtgactgaggtgggaagatgacttgagcccctgaagcagaagttgcagtgagccaagatcacgccactgtactccagcctgggtgagagagccagacgctgtcttagaaaaaaaaaaaaaaaaaaaaaaaaaaagttgttttggtagagatgggatcttgatacttaacccggggtgatctcaaactccgtgacctcaagttaattctcggggtctgggcctccaaaatgtgtgagagttcaggcatgggccacaacacccagccggaaggtgccagtaattatttttttttttttttct

SEQ ID NO: 726659 - DNA, 864 bp, Homo sapiens
gctagaggtctgtgttgccgttgcccaggtgtgatgtctctgcgttacaaactcctatgagggcttgctgtgctggagggcctgctatggtgtgctgcggttcatcatggagatgtggggccaaaggcgtgcgagggtatgatggtgtcttgggaagactccgaggaacaagaagggctaaatccatgatgtcagtggactgggactcatgatccacagacgagagaaccctgtttacatactacgtctagacaactagcgtgtgccgtccacgatgttgctcagcaccagggtagtgtcttggtgcatctaagggatgaccgatcatgctgcaccgtgggtaccgcaacttggtaacgtattggccacgtaaagtaagaccctgacgtgacctacgttgagcgagttgtgggaaactcgaatggatgatgatatctgcccaacgaggcccctattctcagtaagcgagaaggggtagtggaaagcacactagccggtccgtgacccatgactctccaagaaacgagttgcgcctcgaacacgcgatgaaaccacgggttcttccatatgggcctagcttggtatttctgggaagatcttggagtgttgtggctcatctagaagtaccgtgtgtaaaattaaacaaaactatcatggctaaccaaatagggaaccaccgagacgatacttacgagaagtatggaaaaaaaaggaccaaaaagaaagatcacaaagagacaagagaaggtaccgtacggaagtgtagaacgccgagggggagggccgcaagggatacaaaccaagagggatgagcaaggttggcacgcccgtacaagactaacgagtcctcagggcagggggcac

SEQ ID NO: 726660 - DNA, 138 bp, Homo sapiens
caggattacgatagtccaacataccctaataatttaaaactactatagaaactgcagcagcacaaggcaagtggcttaatgcatcctgaagagatatctatctgatggtagcttctgtatacatccaagtaagcattc

SEQ ID NO: 726661 - DNA, 103 bp, Homo sapiens
gagaaggagggctgaactggagaagtatgatggggaagcaaggaccaggacaagggttgggggctgggggaggctgcggcaggagatgcctcttctaggcagt

SEQ ID NO: 726662 - DNA, 609 bp, Homo sapiens
aaatatttattgggactgtctttgaatttagtagaatcactgtatcattaacagtacttccccaaactgttaatgatacagtgattctactaaattcaaagacggtgggggaagtactgcttggcgccttattgaaaacttaggtctagctgtgttgcatcaaaatttttgagctattcaaaaactaataggatctgtgtaaaatatttcactcaaaactactaaaaaaaagtctgggatggcagctcattatcaaatatactcctattttgtggtgatttatgaacatccccactaagtataactaaagatcataaagagcctcagatcaagttggtcaggtttgtcaccaagctttgtaaataaactggttttcatagctttttggagatgagaattgaggataagaaatcgtgtctctgtccctttttttttgtatttttggtaaagtcttacatgtatttaccggataccatcttttggacctggcaatatttacctaattcaacatattttccctctttgcagaagggccagtccatgtgaaaaatcccttttcatgggaaagagctccatgtaacagcattaataaaactggctacctagcag

SEQ ID NO: 726663 - DNA, 287 bp, Homo sapiens
ttattaaagggggcatgtcccctgcttgaaccctgaaaggcaggtggtaggccatggccacaatccccagtgaggaagaaggtgtccctgagaacccaaatttcccagagagtatttgagaaccaaccaatgaaaacagtcccatggtttttagccggtaagtaaacagtcaaaagattagcatgaaagcagtttagcattgggaggaagcacagatttttaaagctgtcctgtcgctgcccaggattgacctgggggtaagtcccaataaattcccctactcccca

SEQ ID NO: 726664 - DNA, 215 bp, Homo sapiens
  misc_feature (14)..(14): n is a, c, g, or t
  misc_feature (16)..(16): n is a, c, g, or t
  misc_feature (21)..(21): n is a, c, g, or t
  misc_feature (49)..(49): n is a, c, g, or t
  misc_feature (85)..(85): n is a, c, g, or t
  misc_feature (92)..(92): n is a, c, g, or t
  misc_feature (94)..(94): n is a, c, g, or t
  misc_feature (98)..(98): n is a, c, g, or t
  misc_feature (102)..(102): n is a, c, g, or t
  misc_feature (106)..(107): n is a, c, g, or t
  misc_feature (115)..(115): n is a, c, g, or t
  misc_feature (123)..(123): n is a, c, g, or t
  misc_feature (129)..(129): n is a, c, g, or t
  misc_feature (131)..(131): n is a, c, g, or t
  misc_feature (136)..(136): n is a, c, g, or t
  misc_feature (139)..(141): n is a, c, g, or t
  misc_feature (144)..(145): n is a, c, g, or t
  misc_feature (149)..(149): n is a, c, g, or t
  misc_feature (155)..(155): n is a, c, g, or t
  misc_feature (161)..(161): n is a, c, g, or t
  misc_feature (164)..(164): n is a, c, g, or t
  misc_feature (176)..(176): n is a, c, g, or t
  misc_feature (178)..(178): n is a, c, g, or t
  misc_feature (181)..(181): n is a, c, g, or t
  misc_feature (183)..(184): n is a, c, g, or t
  misc_feature (193)..(193): n is a, c, g, or t
  misc_feature (207)..(207): n is a, c, g, or t
  misc_feature (211)..(211): n is a, c, g, or t
  misc_feature (215)..(215): n is a, c, g, or t
gcgcgggcgcgcgnangcggnctgaggcggcgccggggcgggcgcggantggcaagcggtgtggcggaggcggcgccacggggantgctgangngcgnaganggtnngcggcgcncgggagcntgttgntngcgcngtnnnggnnggangttcgncggcgngtngcagcattttgntngcngnntttaagaancatttttataatgngatntatn

SEQ ID NO: 726665 - DNA, 174 bp, Homo sapiens
aagaacgcgcgcaaaccggacctggttctcaagagtctctgtctctgtcgtccccccagattagacgattttcatcagagacatggctactggaactgtcacctgtgtactgggcgcaagcactgttacctgggtctacaccatggctggtcatacgaggccatccggtgagtc

SEQ ID NO: 726666 - DNA, 199 bp, Homo sapiens
ctcaagtgctgggcttcaaggactcgcattctgttgggcctgtcagccagaagagaatctgtgatgcggatgagtgagggtggggcgaccgatatgaagcatctttgcacactttttacatgtacttattggacaattcgggcagcttcaggcttcagaggacagctgtcatattcatcttgacacatgtgggcacaga

SEQ ID NO: 726667 - DNA, 424 bp, Homo sapiens
gagaatctaatccatcccggtctgggtatcatcacccgatgaggcacagccagaacgctagacgcaggcacatacttccctattctacaccctagtaggctccctatccctactcatcgcactaatttacatcaaaaaaacgctaggctcactaaacattctactactcactctcactggcccaagaaatatcaaactcctgagctaacaaacttaatatggacagccttaacaccaatagcttttataggtaaagatacctctttacgggactccacttatgactcccctaaagccccatgtcgaagccccccatcgctgggctcaatacgtacttgcccgcagctactccttaaaaacctagcgcggcctactggctataaactacgccgtcacagctccacttctcaaaccccgctggaca

SEQ ID NO: 726668 - DNA, 606 bp, Homo sapiens
gtaactaggtcggacatcgtaatatgctcggaaaagtaagttgcttaaaaaccctggtaggctagactcatttaaatcgatctcgcgatgcatagacttactagcagagattctactcacatctcaagctaatatcaagcgcactgagcagtggatctctataagattgcgtacgtattcgttagcatgtagggtagttcctccgtagctagagcagcacgtgtatgttatccagtcctggggtggcaaaacgacgtggcaatcggatttccagactcaaggtagtctggtctactgtgtattctaccttccccgtaaaatcccaccaaacgtgggaaccttttgacgcggacgcgagggtgcgcgacacggacgtgtcacttggggacgtgtcacctttcagggtaaggaagctcaagtgtacctgttgactacctggaacgtggacatgcataccccaatgggtccaatgatggcaaatgtgggcgaaacgcgttggggtaagtacttggccctcacaactggcatgttaccaaggagccttcaggtttaccacctttcttgggtcttctggacatttcatcgaccactctgaaaggagaagaa

SEQ ID NO: 726669 - DNA, 567 bp, Homo sapiens
caaggcctcccttttcactgcttttccgcctctactcaccccgaccccgagccccgagtgcccagcccgtgtccgcggcttcctccccgcccgcttcccggcgccccggccctccacgcttccgcggggagatctcacctaggagccccgaagcggcgtgtggacggactgttgccttcatgtgtcgtaagaccggcctagcgcttgcctcgcatgcttcctgtccggccgccgctatcattcgcagccgaggccccggggcacatggagggcggcgtgcgctgtgcttatcggcccctaacggggcctggagccgaggctcatggtgcaggagattcgcccgccgccgccaggcagactctgtcttggcattgcagctgcctaacagcctacccggccgtacaccgaacgcgggcagcgccggggatctgggcggaagagccaggagaggcgggacggcacggggtgtgaaggtgcggcctgatatagccaaccggcgcacggggccttccgcgggttgtgacgtaagcagctgggcgcccgcagggacacctgcgacctcccccg

SEQ ID NO: 726670 - DNA, 373 bp, Homo sapiens
cacggaaaggcgatgtggtgatcatctcgcccaaagccgttgggacggcatcagcatgatcgtcctcgtgtttgctggaacgggagcgcgcggacatcgtcgatcgcttcaaggcgtgcgatccgtgcgacgcgcgaagtcatgatcggctattatgtcaccggtgatgccgatttcattctggtaatcacggcaaaggacatggaggactacgaggccttcacccgccgcttcttttatgaaaaccacgacattaaagggttcaagacaatggtcgtcatggaccgtgtgaaggccggattcgcctttcctatcgaagactgaccggccagaggtctgctaacatgtctgtgtccttctccggtggcgtggt

SEQ ID NO: 726671 - DNA, 269 bp, Homo sapiens
ggggggggggtttcccccccccccccccttttttttgggggggggggtttttcccgggggggcccccctttttttttttggggaaaaaacccccctgggggaaaaggggttttttcccccccccggttttttggggccccaagggggggggcccccccttttcccaagggggttggccctttctttcccccccccccccccctgggggggttttgggccccccccggggggggggggggttttttttttttttttttttttttccccca

SEQ ID NO: 726672 - DNA, 982 bp, Homo sapiens
  misc_feature (584)..(584): n is a, c, g, or t
atcccccccgctgtgtagattaccggctttcacccacatattaaaagacccagttcacccctctgatgtgttataccgaaaaacccacccattacgcgatattttagagtggggaccacaccgcgttttagggtacattcgccaaagaggatcccccaccaaagattttggggccacccccagaaaatacgccccaggccctttttttttataaaacacgtactcggccccccacgtgtacacattgataacacccgggtgcccttaaaaggtttacaccgctaggggccctctgggtgtgggcccgaaaatttccgcgccgcacccgagaggcccgccccacacaaatatgggggcccccccgttttcccgcgcacccctcaacacccgcgtgtgagataaagaagcgctcggccacccacggggtgcacatactatatagagaaaaagtgtacttcaccacacgccgcccttgggccacacacgacattctccaccaccgtcacaccatgccgcgcgttgtcgccgaaggaagatcttccccccctgtattctccctcccgccacaaataagcctctctccnccacacacaagagttacgcaccgggttaaccgtcacccgcacattctgagatgagaagcggagaattctcaagagaaggccccccgtataagagaggtattcttccacctccaagcctctcaccggaaggaaggaagaagaagaaaaggaagaagacacacattatatgttcctcgaaggtttcacgcccctggaatcacggagaattatattgaaagtatgaatcccgaccacactaaaggaaaattctgaaagcttttggaacttcggcacactctgtcccacaccctcacggtcacactcacgcctacccttgggatgaatttccaaacccctcggggacccgtttgaaatttttctgtaatgccgtaattaattttccataaatctgggaccac

SEQ ID NO: 726673 - DNA, 151 bp, Homo sapiens
  misc_feature (63)..(63): n is a, c, g, or t
agttgtactgctgacacaggaaatggatgctgggaatacaggcatggaagctcaggcagcagnaattgcaggaagaaaggaagaaggaacatgatctcaaacctaaagggactttactgagaagcccacttccgaatcaataaaaagcagc

SEQ ID NO: 726674 - DNA, 953 bp, Homo sapiens
tggggccgttttttttttttttgggagaccccccccccaaaacccccggggggggcccggggccccccccccccccccccccgcggggggcggggtcaccacaaaaaaaaagaaggttggcctacatacaacaacccgagcgcgacagggagaggaccacggggggggtatatgaagctgggggtgggagaggaggaaaacatatgttgagggagatacatcacagaagagattgctcctccctcttataataccccaaaaagttgagtggggggcggctcgcgtggctccaacacaacgccagacgatgcggtatgggtggtgaacacgaggggggggtttgatagattaggtccccccccactctctgtgcggtggtgtagcgagggtgtggtgctcctcctctggtgagaaacactcacaaaagaaggaggcggcgggcgctactatgtgcgcaccataaagaagccaaggaggagggttcccagctgtggagagaaaaagaccgcctgcgggtactaaaaacctcgggtggtggtacgccaaggtgggtgcgtgctcctccagaggatgtggagtactacgagggtacttaacctgctgtagtcacgttgtgtttgctccccatcgaacgagcaaacaaaagtaatggggatttgctcggtcgtatggtgactaatatggtggcacgaacactccctcgtcggtggggcgtcctctctttcggcagttgtgttttttgcctcctcccgcggggtattcccacgtggtggtgggtgtttctccgcgcagcctgagaaccctgtggtcggtgttaataggaaaagcccccttacgttctgtgtttgtgccactgtcctggtggtggctgcttgggaaacaccggggggggttcccctggtgctgaggggacggtcttgtggggaatccttatcagggggtcccggcgtgtt

SEQ ID NO: 726675 - DNA, 585 bp, Homo sapiens
  misc_feature (393)..(393): n is a, c, g, or t
  misc_feature (401)..(401): n is a, c, g, or t
  misc_feature (409)..(409): n is a, c, g, or t
  misc_feature (434)..(434): n is a, c, g, or t
atgatgagtgatgcaagtgacatgtcggcggcagcgttgtagcagatggatggtatcatagcaggttctaaggctatggaatattccaatgggatttttgattgccaatctcccacctctccattcatgagaagtatgcgagctctgcaccttggacagacctgcatgaattgttagagagatgcaaccactagaaatgtagacatagatgccagaaccaagataaagagctagctcctgattcatgcgtgccacatattacaacagagatccacgagctcgactggtgctgaagaagcaaagaacgcaggcacgtctagcaaatgaaaaagaatccctcgttcttcagtaagtgtgttaacagaccaggtggaggctcagggagagaagatncgagattnggagtttngtcttgaagagcacagagagaagtngaatgccacagaagaaatgctgcagcaggtatgtgcagaggccagaaccaagatgggatttccctgctgaactatgtgagatgctgcatttctatgttgtgtttgctctgatgcagcagtaagtttcttgattcacttagaccagcacatt

SEQ ID NO: 726676 - DNA, 736 bp, Homo sapiens
  misc_feature (393)..(393): n is a, c, g, or t
  misc_feature (401)..(401): n is a, c, g, or t
  misc_feature (409)..(409): n is a, c, g, or t
  misc_feature (434)..(434): n is a, c, g, or t
atgatgagtgatgcaagtgacatgtcggcggcagcgttgtagcagatggatggtatcatagcaggttctaaggctatggaatattccaatgggatttttgattgccaatctcccacctctccattcatgagaagtatgcgagctctgcaccttggacagacctgcatgaattgttagagagatgcaaccactagaaatgtagacatagatgccagaaccaagataaagagctagctcctgattcatgcgtgccacatattacaacagagatccacgagctcgactggtgctgaagaagcaaagaacgcaggcacgtctagcaaatgaaaaagaatccctcgttcttcagtaagtgtgttaacagaccaggtggaggctcagggagagaagatncgagattnggagtttngtcttgaagagcacagagagaagtngaatgccacagaagaaatgctgcagcgggagcttctaagtaggacatccttagaaactcagaagtgggatctgagtgctgaaatatctaactggaagtggaaactgacagcggtagagaaggacagatgggattatgaagataagtccagagacacagaggggcgtgatcaggagatcaaggattggaggttaaaagttagtgaaagggacagtgagagacttcagttatgaaaaaaagcttaaatcaaccaaagatgaacgggcatctttaaaagaacaactagaagaaaagaggggtacc

SEQ ID NO: 726677 - DNA, 119 bp, Homo sapiens
tctaaggatcccgcgtatcgtacacaaactgaagaagtatcattactatgaaatcaagtactgcttaaaagcattacagactctcactcagtttcctgcagataagtgaatgcatactc

SEQ ID NO: 726678 - DNA, 136 bp, Homo sapiens
tggagattactatttcgcggggtggtggtacgaagttttttcatagcgaggtgtatgaattggtcgtaacggaatcggcgcgtatgctgttcgaattcataagaacagggaggttagaagcagggtcttggtgagt

SEQ ID NO: 726679 - DNA, 392 bp, Homo sapiens
tagaggaccttatgtcatcccccttcgtgatatcgcatgatccattataatataggcaggggatatactattggtggggcgtgcagaccctcccttgcttcagccagacagttcaacctggagttccttggtacctggcgccacctcccgcagcatgcctctccttttcctgcagacgttcaataatagcagctagatcagcctcacggttttccttaatttgttccattttcaggatcagcttttcctccgccatcttgctgaagttgttgttctcctccaaagccttctgaaggacttctcgctcgtgttccctcttctctgccaattgtttcagcacctgggcctcctgagactttcttctttcctctgcagcctccagtttcttctgg

SEQ ID NO: 726680 - DNA, 590 bp, Homo sapiens
atacaacaaaataatatccatttgtagggttccgcatatctcttgaccctaaagtaagaatgagtactgcttcttctaggtagtgcctccttagcaaatggaagattagttaggatgggttaagaaaggatgttggccaagtactgtcttttctcctattaaatcacttgttataaagtaagcactttttctttggtgccttggccttctgcccataattttgtttaaggcttcccaaatgtaatgtctataggtgtgaaatgttgaccctgtgcagacctctaataacagtagcactgatctggccgggcgtggcggctcaggcctgtagtcccagcactttgggaggccgaagtgggtggatcacgaggtcaggagtttgagaccagcctgaccaacatggtgaaaccctgtctgtattgaaaatacaaaaaaattagccgggcgtggtagcgcgtgcctgtaattccagctactcaggaggcagaggcaggagaatcgcttgaaccctagaggcggaggttgcagtgagctgagaccgcaacactgcacttcagcctgggcgacagcgcgactccatcttataaaat

SEQ ID NO: 726681 - DNA, 165 bp, Homo sapiens
atcagacttcagaccttgcaacaaacttaaaaccatcttgggagcaccgcacgtccaaagagatgatcttcttggggccacatcgcaatttccaccagcttcacgaagggctcttgctcaggattgcagacaacatgagaaaagatggacctcctcaaccaccac

SEQ ID NO: 726682 - DNA, 1359 bp, Homo sapiens
ggttttcagattgctcttgggaatcatgccgcaaatgtagtgtctcggtcacggtagctctgctctgtacacctcggtgacccggtgagcgaatatgacgacgagtggaagaagccccgtccatgttttacctacctgtttagtgtcgtgtgcgagcatgagtccataggtgctggactgtcctagttaaagaacattgccctatgagtgccccgggaatccggtctccgtgtgtgattgattcgctgccaaacatgcccataacgttcggtaaacacagaagatagagggcacgatctactgtattcggatgggatcacctgtaacgcgccattggaaccagagcagttagccatggtacacgaacttggtaggcaaagatgtcgtgtagctggccggctctttcctactcaatttccccacgactacaaggacactgtcctcactgttctaacccttttcaatttggattgggagttgagcaagccgagatgaagttccttacgcttttagggcgcacggtggctatcagagggcaaccaaacgggaaagcattattgagtagcgttccacgtataagccagagggacgacccttcctcgtgaacgtacacgggtcgagttggactgggacccgagaagccggaacccatacaccgatcctgtgctgtgtccagatggtatcacccgtgttctgtgatctatcagcgtgattgcataacacacgtttgcatgtgaacacgaacgcgaaacggatcgcggacagacctgtgatcgcgggcgtagcagggaaaaggagggttccggacgtgtattcccgcaagttagctgcgtgggaggaagaaatgtgcgcccatggggttggacatttgattcaacccaaaaggcttccgcggaaacccgggcccaaattcccgggcgagtgcgaccgtcgattaagcacagaggcgggacctttgccaaagatggaattggcttcgcgcgtttgccaccgtggggcgaatacggactcacaattgcattaacgccggagcgacacgagtcggccttaactgctgtgaaccggcgtcggtgtagttttatcgagacaataacccgaggcgcatacaggaagctaaattggcattgcgcgccccgtaattcctcctataaggaccacccaatagcaacataatcaggtgggatggaacgctttgtgaagtagtacaccggcagcgacagaaacccggttgaatcgtgcgtccggtgtgaaccagtacagatgggggagttccctaacctccatttcggcaccttcagggaggaaggggccgtttgccagttgtagttgatccccaagttcgcaagtggctcccataag

SEQ ID NO: 726683 - DNA, 435 bp, Homo sapiens
cccctaccccctgcccttccctcagtttccagccgggattggctattcattaggggacccgtccactttctcccctgaaaccccacacatgtggttcccttataaaccagtctttgtactctccctaaaacagcgcaagctctaggaatttttccaaggggggttctgcggtgcccttgccccccaaccagtttgcccccccctggggcatttttgtatggtgtttcccctgtcctgtaaaaacctttggatgtaccggaatggtatcctccagtcgcctttggaaataaatggtcattaatttgtgtacttagcattctgaattttagtcccaggtgttcctgttgttgaagatccttgaatgaaaaggaaccctcaccatggggcttactgttataatgtttcttcatttactgttattaaaagatttatgag

SEQ ID NO: 726684 - DNA, 311 bp, Homo sapiens
ctgcaacctctgccttacaggttcaagcgattttcctgcttcagcctcccaagtagctgggattacaatgcatgccaccatgcctggctaatttttgtatttttagtcgagacggggtttcgccattttggccaggctagtcttgaactcctgacctcaggagatccatccgcctcggcctcccaaagtgctgggattacaggcatgagccaccgcacatggccctaattctgtcatttcttctatgttcgttagctagcatcctgtaaagaagacattttcttttttactctcccttctgtcgtcttctc

SEQ ID NO: 726685 - DNA, 118 bp, Homo sapiens
catttgatgcccctttgatgcacctgcatcacgttataatcacgtggtcatcaacaagaagggctatgttctctggaggctaaatggctatatcagtcagtaccgacttgagtaggat

SEQ ID NO: 726686 - DNA, 478 bp, Homo sapiens
tgaggaccgtatatgcactgaactatgctgggagctagagacacaaaatctatatggagatgtatgggatggtcgtgaaatcatagccaaaaaaagaggccaggtagtgtaactctggcaggtgggcttacaggtcagcacggtgtttagtttcgtcatggtctatgaatgcctaccagggctttaaactgactcaccctggctggatggcagttgaacttgcagccattagaccaggggttctagtctcttgtcactccaattattgcttctacgaactaccaggtagtacacattcatcaaatgatgacttagcactgatctatcagtcacggatatgtgatgtggctaccataagcaggcaggtttgtagaatgagtcacagaaacactgtcgcgcaaggtgttcgtgcaggcggagagatgagcgcgagggtcacccctgacagcaagggggagcggggagaccagcttgggta

SEQ ID NO: 726687 - DNA, 656 bp, Homo sapiens
tgtatttttagtagagatggggcttcaccgtgttagccaggatggtctcaatctcctgacctcgtgatccacccgccttggcatcccaaagtgctgggattacaggcttaagccaccgcgcccggcagtttacatgaatatttttaaaaagggtggtcccaaagagctagagcatttggggacatctgactgatagaagtaaataagaaaatgcctatcatgaaaagatgttatctttattcaggtggcaatttcttgaggagctaccttgattttgagagaaaatgaagagaaaggtattcggcaaaggtgaaatgtgcagggaagagtccactctggatggtgttttggtcagcaggctgtggatggggtgtgtgagagtgaaagtttatcacactgagaaaaggcctctacgcctaaactaatgttcaggctgggttattactaaaatgtggtcatatcatgctccattaacagttacattaaaatataagaccaaagaacctgagttttgtttcaattttttaatatccccaaattttaataaaaattttaccttgagccacagatgcaaagcctgaagaaaacaaaaacaaaaaatttatcaaaggataatttttaatttggaaaaaatgcacactatattaatatactat

SEQ ID NO: 726688 - DNA, 900 bp, Homo sapiens
acaaaggcaggccgcgcgaacagatacacaagtcctgaggatttttcgccggaaaatccccgcgggacccccttggtgcaccccggggtggcgccgcaaacggtgtccagacatgacgcctttggccagaaaccaagctctgcacgggtcgcaaactcacctggtctcctctgggggtaacccatgaagacgccagtctctcgaagagccggtcgttggcttaacataagtggccgcctcacctccaaacaagagcggctgtcgccaacttccatggaaaggggtcccagggcctggccacaaaagggcccccgcctcttcgggggaaaacgtggaggaccgccaaaagttcggtggagccccccccccagggggggtccgccaccagcacggtgcccgcgaacatcatggagagcaaagttctccaaaaacggagtctacaaggtcccgaagctgcaatagcacaacgcccaagcttctgcaggctgggaccaccgcacaaggggagactacatcccccaaccgggggctccacacggagagattccgaggcccccccttttttggtggaaaatctaacacaaacggctggcccctacctgatgcagaccaccccctggtttcgtggtggtgagacaagcaatacagatgttgcacaccagaggatgatttcccacctacaacgcttcttcccaaaaatgggtgcccccttaggtcggtatacaatcggggggcacttcgcaaaaaaatggcaacacgcaacttccttcgtttgtctgcccagaagtagaattcctgtcccccctaagaaacaattacggtcatgtgcccccttttggaaaaaggcccccgggccaggcccccaacacccgggggatttttaagcaccccacaaaaaca

SEQ ID NO: 726689 - DNA, 704 bp, Homo sapiens
  misc_feature (504)..(504): n is a, c, g, or t
  misc_feature (509)..(509): n is a, c, g, or t
  misc_feature (516)..(516): n is a, c, g, or t
  misc_feature (537)..(537): n is a, c, g, or t
  misc_feature (562)..(562): n is a, c, g, or t
  misc_feature (582)..(582): n is a, c, g, or t
  misc_feature (585)..(585): n is a, c, g, or t
  misc_feature (640)..(640): n is a, c, g, or t
ctcagcagcggccctgggcctaggagcacagcacaataaagccaggaaggtcccggctcaagacctcagtctaagacgtcaggagcccagaggagaatgtcacagcctcagcagagagctgggggctgcatggcttgctggggggtgcagggagtggggaacatctcactttcataccacccaggcctcctataaaccccagctccagccagaggcccatccatggcgctgcactaaaccttggatgcagtgcgaagtcatttcgttgtcattgcctgttaggaccttatagacaccatagagcccaaccccacattttaccctagggaaactgaggcccaaagaagggtgatgacaactcaaggtcacacatagcggtggcaccccctccgattcccagtgtactcactctgactctcattctgactttacgacaagacagggagagatgagcctaactctaccgtccaggcgagcccaggaaggaggagctacccctttccnccctnacccctncacaccttctagtccaacttnacaccagacggagacctgaactctnctctttcgagagacaagttncgncccggccccctcctagtgcttttggccagccctggggagcatccatgccccccgngcccactgtctctcctcccactctagctctgcttgcacctgctatatcttcgcttctttggctg

SEQ ID NO: 726690 - DNA, 436 bp, Homo sapiens
  misc_feature (256)..(256): n is a, c, g, or t
  misc_feature (402)..(402): n is a, c, g, or t
  misc_feature (408)..(408): n is a, c, g, or t
tctagcaggatcactaccgtaatatgtaccatatcaagggagaaataacagtgagatagcttttttattgataggataaaaataagtgcagtccttaaatgccagtgaaaattaccacataatcaattgtatagccccataaactgataatagagctgaaatttagcagtaccaagttattagtctaaggggtgggtatagagggaagtataggaaagtgctgcaggaaggaaaatgagaaaaagtttccttctcnttttctagatgtacatacaatagacctcatgctaaacaaacttgaaatgtatcaggtttattattggcatcctgctagtctctttttggtttctcttctgctgccacctcttgttttctgtctaggatgtttagctccctcatacnctgtgntcccttacatggtgtgacatattacggt

SEQ ID NO: 726691 - DNA, 219 bp, Homo sapiens
atcggactgacaaacactcttttcatggccattataaagatgcttcactagcagctcagtctactggtctcatcagtaaaggcttgtgaaaatttctggaaagagcattgggctggcttgttcaatctctctggtttggtaagttgctgtgtttctcccggatcagatgagcagattggttagtgagggtcagtttaagaggaggatgtttctgagctt

SEQ ID NO: 726692 - DNA, 290 bp, Homo sapiens
tgagacacaatctcactctgttgcccaagctggagggcagtggcatgatcttggctcaatgcagtctcgacctcttcgggttcaggtgatcctcctgcctaagcctcctcacctcagtcttatgggtaactgagactataggtgcatgccaccacgcctagctaatttttgtatttcttgtagagacaggggttcaccatgttgtccaggttggtctggaactcctggactcaagcaatccacctgcctaggtttcccaaattggggaaattccaggcctaacccccggt

SEQ ID NO: 726693 - DNA, 597 bp, Homo sapiens
gagggacggaggtggaggaataggtgcaccgggcacgggcgtgaagcacatcacgttatagtgaaagagtggagagtgctagacttcctgctatattcatgcaacgctcacgggcgaggaaggctggaatcgggaagcatgtagatgaccaagacttcagccttttctttggactaattctatatttccccaattgggaccacaagagggatttctcaagactcggtgggggttggcaagaactggggttgtggcacatgcttgaggcagtcttatcaagtttcaagtcagccctaagaaccgagctgcatccacgtgggtgggctctcttcttggtgtggagctcggacgtactctgaaagccccaggagaagctcactgtagtaagaggctctgttgctgtacaagagactattatagtggcctcccctgatcaggcatcagcttggtggggcagcgcacacctccacatccacccaacaggcctttgaaggtctgagaatgctgagtcccacctgtgtcagaatgaaatgggagagttccctgactcctctcaggacttgtgacaggggtgaagctcgtttgcttgttccgctg

SEQ ID NO: 726694 - DNA, 887 bp, Homo sapiens
tggagcagttgttaatttccccgaggggctgtatttgttcgccccgccctgtgtgtgtcccgcccctggtggcgctggcgtttagtgctccctaatcttctcttcccgcccccttggaagagtgtgttgtatgaattaccccaaagggggggtcgtgctcacccccacttggagacccgctgttccgagaaaaacacaagaggtgtatgtctgtccccgccggatcattcgtccgcgtggttgctgtgtcgccagaagcatcttgctgctgtggagttccccccggaaacattattgagggccgcatttatttttccccgccgaagtcctcacacaccggggtctttccaacgcccacaatttttctttcacggaaccccaaggtcccatcaacctagcttcttcttatcttcgcgcccacaatgtaaccgccttcctaggacctactttctacaaagatgccgctcattccacgtactcacaaaaacaaagatcattctccctgttatacaaaagagttgtaatgaacatattcttggaagcatcctcacatattattggtgacatatatcctttaattgtcgccccccctctataccagtactacagaataaattttcttcccatgtcccctttttcgtaatcttggacactcgttcctcctttctggtcattcttcactccctgctctcatttctaatggaattagcctattttgaccacggaaaaacagaacacaaaaagtttctgtatttttttctctcttccgccccacatatgaggtccctcaggggcacgacctgtatatcattaagaccccatatgttttatgtctttacagtaccccccaaaaataaatcttttttcaaatcccccaaacaaaacaa

SEQ ID NO: 726695 - DNA, 198 bp, Homo sapiens
caactaagatgaagcatatttgaaaatgtatcaagtaaatcaaacaaaaagatttgctcagtgtattggccaaacatgctagatacatggaaggttctggggggttgtgcactgtgttcacagtttccaggagcgagtcttcctcttgttactggcagtttaacttgagcatgttactaagactcttaggagcctccc

SEQ ID NO: 726696 - DNA, 222 bp, Homo sapiens
gtggagtccatcaccaccatccatttccagaacttttttttgttgtttttttgatgacagagtcccactctgatcgcccaggctggagtgcagtggcatgatcttggctcactgcagcctccacctcccggggtcaggcaattctcatgcctcggtctcgagaacccaggattacaggtgcctgccaccgcacctggcgtctttttgtttttttttttttcg

SEQ ID NO: 726697 - DNA, 347 bp, Homo sapiens
  misc_feature (82)..(82): n is a, c, g, or t
  misc_feature (85)..(85): n is a, c, g, or t
tatttggggtggtttccccatgtacccccatgtattgggtcattatgaataatgctgcctatgaagattgttgtacaagttnttntgtggacatttatttttctgggatatatgccctaggagtgaaattgttgcattataggatgactgtacatttagccttttgagaaactgccagactgttttctaaagtggctacaccagttgagtgcaatggctcacacctgtaatcccagctactcaggaggctcagctaggaggatgcttgagcccatgaattcaagaccagcctgggcaagatagtgaaaccctgtcttgatttttaaaaaatccaattaaaatgacaa

SEQ ID NO: 726698 - DNA, 459 bp, Homo sapiens
  misc_feature (327)..(327): n is a, c, g, or t
ccgccagcggccctagacgtggggtccaggaaggggatggggagtgggggggctcagctatccgggcactcgatgctcctgtcctcgcgccccccaatctggacctggcggggaatttgcctcagcgcaattctgagtgccgtcgccccccgcccccgccagtgcccctgcgtgtacccccaccagcggagtcccaggccctgctccccagtcccacctccgctgcgggccaggagcgtgcaggtgagggggatagtgttaaacggggacctggggaggggagaggaagaagaaccagagggggagaagagggggcgggcggagcgngggcgcccggcgcgcctgtgccgagcgcgaaagctgcgagcgcccgcgacagtaaaacatctgtaatgtgccattcgccgctgctcgctgattgctcatggattaaagattaaaatctcggctttggcaaaa

SEQ ID NO: 726699 - DNA, 420 bp, Homo sapiens
tgcccctggatgccggagaggggggcctgtctctgtgccattgagggcccgtccaaagtcagaactcagctgccgtgacaaccaggatgggacatgcagcgtgtcctacctgcctgtgctgccgggggactacagcattctagtcaagtacaatgaacagcacgtcccaggcagccccttcactgctcgcgtgttcacacggtgacgactccagtgcgtatgtcccacctaaaggtcggctctgctgtccgacatccccatcaacatctcagagactggatctcagcctgctcgtacggccactgtggtcccgccctcgggccgcgaggagccctgtctgctgatgcgtgtgcgctttggccacgtgcgcattgcattcgtgccccaggagacgggggagctcctggtgcatgtgaagaa

SEQ ID NO: 726700 - DNA, 349 bp, Homo sapiens
gagtcaggtagcgggtatatatggggagaaaggggaggtctagaaagtccttggcagtacccagttatctcttcatgactcctcatgggtcccatgttcaaatttgggaggagttaatatgaagcatgtggtggcaattcaggctgtgatgacgctccttcagagtgaactctagttggctatattggttgcaactgatttcagccagttttgttatcttacaagcagaaggagtttcagtgtttcagaaagttgtttcttatctgctatcttgcaaactcaagactttccgttagttactggtttaagtttttggggcatggttttactaacaacttcagtccctggg

SEQ ID NO: 726701 - DNA, 256 bp, Homo sapiens
taccggaaggatctgtgggcagcttttctttgacatgagcaatggtaagcagtgctgtgatgacatcatgaaaattgaaactactgctccccggaaaacaacccaagcactgaggaagcaggggtccttggtaacatgagatggctattgagccgctggataacatcgcagcggtgacagacattctgtacccagcgggagggcgccaggctggagacacccccaccctggctggccatgtttacagaacaaactg

SEQ ID NO: 726702 - DNA, 226 bp, Homo sapiens
cgtgccatagcgatctctcggactcgcggcgttgggagattcggcgtgtgcagcaacaacttcgtccaccgcgattgagggtggggatgatgtgtctccatgtgccatgtatggtgtttcggcgtgtgcagcaacaacttcgtccatagcgacatgacttcaagaagtatatggaggttcggcgtgtgcagtatggagcctcggcgtctgtgtttcggcgtgtgca

SEQ ID NO: 726703 - DNA, 145 bp, Homo sapiens
  misc_feature (42)..(43): n is a, c, g, or t
  misc_feature (117)..(117): n is a, c, g, or t
  misc_feature (122)..(122): n is a, c, g, or t
atgcaatccacccaatcttgctctctacctgttgggctttgnnttgaaaaaacctgtcagtactacaaacctacaagatccaggagtgttaggttgccctcggacatgccttcacgncattntaaacatcttggagaaaggaacg

SEQ ID NO: 726704 - DNA, 168 bp, Homo sapiens
agatagcggtcctgacgtacccaatcacgtgcttctttattttttaaaccgataggctcattctactgtcttctccaggctcttctatgaaacagttacaaacctacggccaggccagtgcagtggctcacacctgtaatcccagcactttggaatgctggggcagga

SEQ ID NO: 726705 - DNA, 254 bp, Homo sapiens
actgggagaccagggcgggtggatcacttgagctcaggtgatcgagaccagcctggaaaacatgtgaaaccccatctctacaaaatatagaaaagttagccaggtgtggtggcgcacacctgtagtcctagctactctgggggaggcaggaggatttctttggcccaggagaagttgaggctgcagtggcctgtgtttgtgccggtgcacgccaggctgggtgacagagctggaccctgtctgaaaaaaagagc

SEQ ID NO: 726706 - DNA, 587 bp, Homo sapiens
  misc_feature (447)..(447): n is a, c, g, or t
  misc_feature (485)..(485): n is a, c, g, or t
ctcgcgaacgtgttatcctgctgggattagaggcgtaagccaccacgctggtcgtctatagtcttttaaattaagaaaaatttaaaacttctaatagcattattgtaggtatcagaggaaacaatatggtttttgttggatttcgaagctgaggaagcttgttgtctaatatttttactaagttaagttgattctgttgcagtttgctctgtgaaataatatatgcaaaataatgcaagttcttatttgttcctttccttctgattcttacagtgaagtgacttgctggctagaatctgaagtactcaattacatggtggtggtgatagaggctgccccgttctttctctttctaccaaaggagatctctggtagaaggtttaaccaggtgaaggaactagcttaagtcccctttccatagtttggagagaatttgtttcggtttanaaaggcgttatcctcttgcaaatacttttccttaaaanctattcatgtccatgcagtttttatcctttagtttatgaatgtggttaattacattgattgactatatgatgttgaatcatttattgctttctgggatacac

SEQ ID NO: 726707 - DNA, 160 bp, Homo sapiens
atagaacacctggtgtcccaagaaagaggggtggtttttttccagaacagccacatccctcccgtgcatgagctaaagagggactctgatacttgggaaaacaggacagtaaaggccactcctgctatccaaagggacaggaggctgcagctgattgtag

SEQ ID NO: 726708 - DNA, 505 bp, Homo sapiens
  misc_feature (7)..(7): n is a, c, g, or t
  misc_feature (21)..(21): n is a, c, g, or t
  misc_feature (55)..(55): n is a, c, g, or t
  misc_feature (66)..(66): n is a, c, g, or t
  misc_feature (92)..(92): n is a, c, g, or t
  misc_feature (311)..(311): n is a, c, g, or t
acatgcncccaactgaaaganccaacaacacctaaccaacctcaatttccccaancctccttaaanaaaaacccacattgaataaaggaaancctttgaaggttgccctatttgtattaccataaataattccccagaaggtttccttgggtgatttaaaaataggatttgggctgggccacagtggctcatgccctgtaatccccagcactttgggaggctgaggtgggaggatcgcttgagtccgggagtttgagaccagcctgggcaacatagtgagaccctgtatttacaaaaaatgaacaaaattncctgggcttggtgatgtgtgcctgtagtcccagcggcttgggaggctgaggcgggaggatcactggaccctgggagatcgaggctgtgatgagctgagatcgcaccactgtactcctgcctgggagacagagtgagaccctgtctcaaaaaaataataaatcaataaaagtaggatttgatttaaaaaaaaaaa

SEQ ID NO: 726709 - DNA, 151 bp, Homo sapiens
gtgcccaggcatgaagtgcaatggcagcttactgcacagctcacacctcctggttcaagcgattctcctgcctcagcctcccaagtagctgggattacaggcacgcgccaaacaacctggctaattctatttagtagaaatggagtctcac

SEQ ID NO: 726710 - DNA, 1197 bp, Homo sapiens
  misc_feature (498)..(498): n is a, c, g, or t
  misc_feature (539)..(539): n is a, c, g, or t
ggaaaatgaaaacaaattcacacacctttttaacatacacagccagttctgcctacccagccaaggcatattcttcttgtgtggaacttcaacctatgtctgcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgtgttcaacaccagaaaatttatattggagaaaaagcactgtaaatgtaatgcattngtgaaaacattttttaaaaaactacagcttagaaaataccngaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaataatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgttta

SEQ ID NO: 726711 - DNA, 1088 bp, Homo sapiens
gcagataatttttagcttagggcctggtggccctcaagcataaaacattcatctgccagatcatcaggtcaggccaagaagcatccagcagctatgatccccctctttgtatatcatgaggcaactggagctactgggcagcaacactgtatctcattgcgtctggccatttgtacaatccaagaatgatatgatgggacacgcaaatcaacccaaggagacgcctgggacagaaaagcatggcgctcaccaaactggactccaaggcacacagatagcgaccgtcacgtggaactgatggcaatgacaagacaagcatgaccggcaaggaagcgatcaccagacatacttcaccatggcagactgtagcacgacctactagacgacgtggcaacgaggacagtgagaggcacaggcacagaagcggacaccacgtccgcaacagagcgagaacgagcgtgcacgcccagcgcaacaagtagtcaccgtcccgtcgtaacaagggggaacctgcacaccgcacccgagttagggcacgaatcaaccatagtcagcagcgagacctgcgtacgtgggcgacgaaacgaaccacaggggcggaacaaagcgccgacacgacaacagaaaccaggagacagcgcggctgcgcagagagagaggagacgaacgcagagaaacaacaagagagaggcaacggacaaggcggtgcgggagcgggcagaggcgcgagagcggaagagcgggggcgaagccgcgagagaagcgagaaaagaacgcaaggacggacatgaagcgagacgagcacaccggagagagagaccgggagacgaagcagacgggaagaagacagaggcggcgaagagcaggagggaagagacgacggaggggacagagggcagaagaggggaaagacagcagaacgacgaccgacaagagagagagggaccgcggagggtggggagcagcaggggcgaaggcgagcaagagagacaagcaaacagaagggacagcccccggacaggcagagagaaaagatcagcaagacgagaaaggaagaagaagaaaacatgcaccgaggaaggaaagaa

SEQ ID NO: 726712 - DNA, 1779 bp, Homo sapiens
  misc_feature (52)..(52): n is a, c, g, or t
  misc_feature (958)..(958): n is a, c, g, or t
  misc_feature (999)..(999): n is a, c, g, or t
agaaaccctgcaaatgtgaataatgtggcaatactttaaaccaatcctcaancctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgtgttcaacaccagaaaatttatattggagaaaaagcactgtaaatgtaatgcattngtgaaaacattttttaaaaaactacagcttagaaaataccngaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaataatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgtttaaaaatttttggattatgcgtgaacttagttttttaattaaactttttttaacatgttaaaactattgtgcattcaatgaagtgttttcatgccactgactttacctatcccacattactcaa

SEQ ID NO: 726713 - DNA, 1657 bp, Homo sapiens
  misc_feature (52)..(52): n is a, c, g, or t
  misc_feature (958)..(958): n is a, c, g, or t
  misc_feature (999)..(999): n is a, c, g, or t
agaaaccctgcaaatgtgaataatgtggcaatactttaaaccaatcctcaancctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgtgttcaacaccagaaaatttatattggagaaaaagcactgtaaatgtaatgcattngtgaaaacattttttaaaaaactacagcttagaaaataccngaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaataatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgttta

SEQ ID NO: 726714 - DNA, 1716 bp, Homo sapiens
  misc_feature (52)..(52): n is a, c, g, or t
  misc_feature (958)..(958): n is a, c, g, or t
  misc_feature (999)..(999): n is a, c, g, or t
agaaaccctgcaaatgtgaataatgtggcaatactttaaaccaatcctcaancctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgtgttcaacaccagaaaatttatattggagaaaaagcactgtaaatgtaatgcattngtgaaaacattttttaaaaaactacagcttagaaaataccngaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaataatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaatttttaaacacattgcattttattacataaaagtacaaatagtaaaatgatatactactaattcactttaattttaactaaggtcgacgcggccgcgattttagtagtagtcgacccgggattccc

SEQ ID NO: 726715 - DNA, 1319 bp, Homo sapiens
  misc_feature (498)..(498): n is a, c, g, or t
  misc_feature (539)..(539): n is a, c, g, or t
ggaaaatgaaaacaaattcacacacctttttaacatacacagccagttctgcctacccagccaaggcatattcttcttgtgtggaacttcaacctatgtctgcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgtgttcaacaccagaaaatttatattggagaaaaagcactgtaaatgtaatgcattngtgaaaacattttttaaaaaactacagcttagaaaataccngaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaataatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgtttaaaaatttttggattatgcgtgaacttagttttttaattaaactttttttaacatgttaaaactattgtgcattcaatgaagtgttttcatgccactgactttacctatcccacattactcaa

SEQ ID NO: 726716 - DNA, 665 bp, Homo sapiens
tcttcaggggtactgccaggtagcaggctttattgggagaagggacaaagcctcaggagctgggtgccccaaaggctgctgggtcttgagccacagcttgcagccaattgcagcagcttcgcgcctccttcttccgtttctgttttccctccttgaggcgcttgcgctccttcttctctaggtcctggagcagctccgtggaagcgggcactccttgggtccacctgtggtagcccaggagctccggggcctcagcctgcagtcgggccctcctctccttgtcagccgtgggccttctcccagttctcccgctgctgctgctgccagttcacaatcatctggggcatctgggccatgcactcgtgcgatgttgctgctcccttctcccgacgcttcggctcttcggccagtgtgtttcacccgcagggactccgtgcattggtcgccaggctcgggttcccattcgcgtttcttcggcctccagctcccgacagctgctccggcgaacggccataacgaaaccggggaacccaccccggaaggcggcgccgtaaacgcgcgaaacggtttagccgcgtaagcgcggtccccgagttgccaccgcggggctcaggaggtccctcggggctctggccacccgggggttcccggccttgcggccgcgg

SEQ ID NO: 726717 - DNA, 266 bp, Homo sapiens
agcaacgatgcagagggtggtacgcgcgagtcacagtgtgcggcgacatccatggacaattctattgacctctacagagctgttcacaagtacgtggcgagtgtccgcttagagcaatctaactcttcagtgggtgcgacatttgtggaccgttgggttctatcgtcttcgaaacgttcctccttgtctgcatgtgtacttcaggttcgcgtatccgtgatcgcaatcagcactgatccgggcgcaaacatgtagagtcgccagta

SEQ ID NO: 726718 - DNA, 399 bp, Homo sapiens
ggtcgacctagctagaggtaaagcagcagcctacttgttgttcatgtttgggtggcttctcagtctcttctcacctgtggaactcattacctgcattaagttttctctgctttcaatattcagtttagccgggcgcgatggctcatgcctgtaatccagcactttgcgaggcggaggtgggtggatcaccttaggtcaggagatcgagaccagcccggccaacctggtgaaaccctgtctctactaaaaatacaaactattggccggacgtggtggtgggcacctgtaatcccagctgtctgagaggctgaggcaggagaatcacttggaccggggaggtggaggttgcagtgaactgagattgtgccactgcactccggtctgggcaacagagcgaga

SEQ ID NO: 726719 - DNA, 353 bp, Homo sapiens
aactaaccctacgactagtagaagtagtaatcgatcacgttaaggaggcaccatggctatgaaattcgcgctcagaagggcttagctcctgctgcactgcaatgtggccgcggcccctggatctagtgtgtaggtaaaggtaaggctaggtggaataaatagataccatcatttcggaccaaagttactggaacctggactggttgccggacccatctccaaccttctcggaatgcagaaatgtctgggacgacacagagcatactctctccacacctgaggaggaaatagaaatcacttaaaaacactttaaaaagcaaagtacatgttcaaaatgagacttcacacaaggt

SEQ ID NO: 726720 - DNA, 258 bp, Homo sapiens
gcttttgtcggcccaaagtcttcgtgaagatggataggtgagcccctctgggggacagtggcaaggagctccatgatcaggatcgccacaaggatgcaaaggacagggttggacccaatcccagaacagaggttagaagacaggagcaggggggtggccagtgtcccgagagcactgttcccagtcaccagtggctgcaaaagggccaccctagccttttaattgctttgtcagaattaaacgttttgtacgcagaaa

SEQ ID NO: 726721 - DNA, 499 bp, Homo sapiens
ttattgtgtgttataatgttataaaatagggaattagctaaaatagattaagatacagaaactctgggaatcaaatttctcttgggcaggcttagaaaagacaaaactgaaaatacttacgggcatagagagcagatgcctagggcccaccttctgtcccagttctgcccagatccaccctctgctgaaccttgtccaggtcttaccccacactgaaatctctcacagaactgcttagaggagatcagagtttggggtggctacccctactgcctctccagagctggtgctcacaatttcctgatacccaaaagcagataaatgaggaaaagcaatatacttttgtgccttaaattcttttttataaaattaaagtcagtgtttctagagacatcctatccagcaacctgttccccatctctgcagtttcagtggtttttttcacaagtctcataataactacaaacacaaaaataaaaaattcctctgaattgcaaaa

SEQ ID NO: 726722 - DNA, 331 bp, Homo sapiens
ccgtttacttccgatggggcgttgtctttcatgggaatcaaaacagtgactccaggctggacacagtgacttatccctgtaatcctagcaccttgggtggctgagagaggaagatcgattgagcccaggagttcaagaccaacctgggcaatattgcgagaccccatctctacaaaaaatacaaagctggccaggcatggcggtgcgctcctgtagttgcagcaactcaggaagctgaggtgggaggattgcttgagcccaggaggttgaggctgcagtgagttgtgatcataccactgcactccagcctgggccacagggccagaacctg

SEQ ID NO: 726723 - DNA, 564 bp, Homo sapiens
ggggcggtcgtgcaacttgcggtcagggtttccccccgtgcctcctcgcgctcggatggcggccgctgagttggacgcagccccgggcgagcggcggcaggccagaggacgccccctgcgcggctcgggccgggccatgggccgcgcgcccccggcgtgggcccctagggtcggggcgggatcggcgatgtcctcgtgggcccctctcgagtcccgcgtcctctagcgtggcaccatcacgcggacctctcgtggcctccctgtgtcgcctcggcagccacgcagttggcgaagaaagattgtgccatggggaaccgtgcctcgacacaggttcgcggcccggtgcgtcgagtgtgatcctagcgcccagcacgggaaggggtttcgcattcgcgatagagacttttttgtgttccggcggcggtcgcggaagccccggattgctcgcacccccgctagcggcctttggggcgcccgacattgccgctgcgcggcggtataggggtcacgccgctggggggcccggaagcaggggggtagccccagggcagggtgcaaggaaga

SEQ ID NO: 726724 - DNA, 101 bp, Homo sapiens
catgccgcagacgccggcccgctcgccgggggcggcaggaagggtttgtggccgtgacggaactgatccgcagcaacgacatcgtcctgatcggattcgcg

SEQ ID NO: 726725 - DNA, 131 bp, Homo sapiens
tgcctagaggacccactaagcagctatcagttgaagagagctgagagatgagaaacagaaccagtgaatgcagtgatctatccatactcaggttgggtggaggatgaaatataacaccagaggagtaaaat

SEQ ID NO: 726726 - DNA, 1606 bp, Homo sapiens
gtgagcgcgcggtggcccctgggtccgcccggccgcggtccggatctaggggctgtggggctggaggcgggggtggggcgtctgagagtgcgtcctgggctcgagggggtcccccgggggagtctgccttctaaggcgggtatgcggcaccgaggtttcctccttcctcagccctcctcggcacctgtgggcggctcaaccttccggcgggtcgccaaaacaggacagagataaggtgaaggaagggcgggcccgggtgaaagcggagtgcgcttgaggtgggcgccttgggggggccccttgaaccccccctaggcgaagcaagggaatttggccggagcggatgggagttatcgcggccgaagtggggcacctgttgcggggggcccacgaaggaacccaaagggcggcaactcccggggtttgcacaggtgtgtgccgcttttgcaaactgtggcgagagagacaggggaacgtttagtggagaggccccgtgaattgggccagagtgtttaccccagagtgttttgcgacaaaaaacatctggggagaatggccgggtatgttgacattggggcggcgcccgccacacgagggtcggccacccccaaaaataggtttcccgcggcccccaaagtgagccagaccgcccttttgcacacagaaaaagggggccgagacgcgactttaagaaaaaagtgtcgcccatacaagtgtgtggcccccaggggggaaggaaccccataaattccgcgtgagttattacaacccagagaaatgcccgcgtgtggaaaacccgccgccaagaagaggacaccgcaaaagaggccaagaagccggcccataagagtggcaccaatatgaccaccgcgggcgaccacggcgggacagcacagggggaacatataagaagcggcccaaacaaagcgcccttgtggggatatttgcgcacaaaaggaggaaagcgcccccccttgtatggcgtggtggcgtcaccacaatgtgttggggggggtcctcatgttggtgcgacacacaaaaggaggcctcccgatattacccagcagttttttctttccccactaatgtgggggccgcccgggaaggcatattgttttgttacgaccccccacaagcccaaagatggtttgccccattttacattgggtatcaattgagcgctcacacggatgataaagacgcgtttatataacagttcacaagagtttataattttggctcccctatgggcccttttgtggttccgccctttcatttaaagactttccccccgagaagtgaccccacacatctccttttaaaatggtttgcccccaagcatggtgtgtggcgcggacacggctgacacaccacaggggacgactatcctttgcggaagaacgtcgttattagatggtgcatctccaccgaataaagaagcgcaatagtgtggaaggatgtccgcctaaaaagagagcccccggcggtatttgtatgtgtttcctgtcactccagcaagagatttcccgtgtatacctagtaagagaacgacggcttttctatgttaacagtcgtgcggggttttctttcccccccacagcgaaaa

SEQ ID NO: 726727 - DNA, 111 bp, Homo sapiens
aacaccgccccggaaatccggaatttggggcaaggcggtttctggggggaaaaccacttccccgaaaaattggggattggggcagggcgttttcagggggaaaaacctttt

SEQ ID NO: 726728 - DNA, 541 bp, Homo sapiens
  misc_feature (223)..(223): n is a, c, g, or t
aaggatcccgtgtcatcccccttcggtacagacaggattaccatgatgccaggctggtctgagctcctggactcaagcaatctagcagccttggctcccaaaatgtagggattacaggcgtgagccacatgccagctaataatttaatatggcagaaattactttatttgcaactgtttgaactttcaataaaaaccaaattagatgccaactttatacaagntaggggacatagtttttaaaaattattttagggagtatgtgagtaaaataaatttcacaaatccctattatagagatctgaaccttaaaacaataaattttgaaggataactgggagaattctctgtttttagaaatttgttaagtttgaaaggactagaaaatgttcaggtgtgcaacactttaatatgttaacttaaaaaaagagtaacaaaacagaatttgaaactttgggcaagtgtatttttttttcctatctcaaattccagttaatagtctaaatgattccaaaatatctttaccagaggtcaccaaactg

SEQ ID NO: 726729 - DNA, 140 bp, Homo sapiens
acgattaatatctgtccccggggcccgtagaggcagtcagtggtcttctgctaaaaagtatggtacatccccctcccccagtgtgacttactatgcagcgagtccttacctgggctcaggtattactgtctggtgagtcc

SEQ ID NO: 726730 - DNA, 1499 bp, Homo sapiens
gggagcgtaggccgcgcagcgctggtcgccagtggtgacaggagccgtgcgatcggcaaaaatacactgggaggccgtcagccgcaaaagagtccgcggtcctctcctcgatagaacgacacgtctcctccaccggtcgcctcccctctccgacatcatgctgcgctcgtcccggtcttgggcgtccacgaagagccgcatctcggtactgctatgttgaccgacgaatgggcttgcagggaggaaggggacagggaatgaagaggctcatccgcagcgagtaaagcctcgcattgcatggaacgcaatggttgtgctgggcccatcgttcgtagcgaggatgctccccttcgttagccttctacgaccgggtcgcccctatatctggcatgctctagtggcgtgcgccgggcttcgtactttcgtcctttccctcggtggactgccccaagaccggccttcgcgtacctcggggttgacctagtgggttgtacggaatgaggagcgaagacgtgtgcggtggaagacattgcgtaccttgccatggatggtgtccttcaaaacaagtgacttgtaatggaaggcagcgcgaacggaaggaaaattgcgccagtggcttgctgacaggggtcggccaagcagttgcacgtcccacccgggctatccccttggtgggccttgtgccgacgcccggcagtgtgagagatgtccgtgttgtggcgttgggacactgtggcaagcgaccctgttttccccttgcgacgccaatcaattcgcccgtgagcttacaaatcccttacgtgatatccgggggatcaaaactggttgacaggcgggtgaatatgccaagacaagttcctgttgacatgcgttcggtggcggggtgaccactcacaggggggtccttccagtgaaaaacacccctttgggggaggcaaatgaacttcccttgtgcccacgctccgaacagggaggacgaggtgtaacagtgcgtccgcgccggactttgggcggcatcccacggggccgctcataaagctccctgggtagggagcccaagtccggccttgagcgaacagggaggcggcacgcgcccggacgtccagccagaaatgagagacgctccccgggcgaaatgggaccggcgcacacctgggtgggtccggcgtagaggttgggttggccaaggggccagacttgcagtcccaggaaagcccgccgaaggttcggcttcccggaacaaatcattggagcttgggttcaacacggcgccgcggttatatatggaggtgtctacgcttcacggaatgtttcccccgataaaactttcctttgttccttaaaagtagcagaacggggccctcttgttcacaggcccgatggccgctcattcacccacggtaggggtaccccccgcccatgtcggctcctcaatggagaccacctagagagcacacatttcgggttcagagaagtgttcccatagtggtggagaccgc

SEQ ID NO: 726731 - DNA, 134 bp, Homo sapiens
atggcacatgcagcgcaagtaggtctacaagacgctaccccctatcatagaagagcttaccacccatgatcacgccctcataatcaccttatctgcttcctagtcctgtatgcccttttcctaacactcacaac

SEQ ID NO: 726732 - DNA, 907 bp, Homo sapiens
agctgggcgcggctggcggctggcggcggctggtgggtgcggggcctgggctgtcagccggcctaggaggaggaaggagcctgctggctgtgcagttgtgatggggctgggacccgtgctgcctgtgctggtgtggtctatgctgggggacggtctgggccaatgctgtgtgggccatgtgtctgcttgggcctgcttggggcccggtgggtggtcaccggccgcgggttggtgctgcttgctgagcggcgtgtgtgtgcctgtgtgcactggctcgcgaggaccatcgttggctgggcttgcggttggcgttcgtcaacgtcgcgaccgtggacgatcacactactctctcatctgagactaacagcttgtacgaccaatgccatgggacctttgaacatacgcagaacagacttgttgccctctaataactcggttactttactgactcccgtttgtactgatacatggtggcgatttcgattctgaagatttgagcctccgcctagggtggcagttcgacgccgaccgaccgtggcagctccaatgtggcattgacgtcgagtgacactctgcccccaagggctggcgaccatcaacctcttgtcctttcagctgcggttcctcttgtcgacactggcccaggtccttcaaccacaaggggcaggcccctggtgtcctgcgggagttccaggtgtcctctgagaacacacttgggacccgacacgccaacgtatcccacgttccacatgttagcccagccgtgcgtgaaagttgtcatttttagaagttctgcctgcacaattatgaaatcttcgcaactccctccaacctggggcgcatcacagcagctatggacattgtgtggttcaacacattcacgtcgcatggtcgcaagtccctccat

SEQ ID NO: 726733 - DNA, 1345 bp, Homo sapiens
tctgtttgttgttgttcttgtgttttctaggttgtcgtgtgctgtcttcttgttgtgttgtgttgttgtttgtgtgtttagtgtctgtgtgtgtcttctgatgtggtgtatgttgttgttgtggttctttgttgtatcttgtagttgtgatggtgtgttcctcgtcggtcgagtactgtggtaagcaagaccacgccgctataatcaaacccttggagtgggtgcaaaaccacacaccgctgttttggggggcccccccttatagagtaactccgccggcaggggaccccaccccaaggggtgtgccccgcaagaacccgggggctgttgtttaaaccccctcccccccctgtttctcttattcctccgcgtctccctaaaggttttccccgggccccgtttggggtggcgaaaatttttccggcccccacggacgctgtggctttttcccacaagacgccaatggtgcgcccttctatccccggggcccccccttccaaggggtgtttcccccgcgggacccccatggtcccccaccccttggggggccgccccctttcgatttctgccccactttcttaagcctccggaaccgggcggtttcacgcgcccggggcccctttggtggggccgaaagattctaattcccagcccgctatctgaggccaagaaaaaggggatttctccgccccttcgctggcccctggagaaggtgttcccttccggggccctctctgagaggagaccacccttgggagctacgtcaccctacccactgtgagccctgtgaaagagtccgagcccactctgtttttccctcgggctcggttggagagtaccactgagaactctccgggccgccgtgtgtgggcccactcggttctgggaaggggcctgagaacgttgggtgagaagaacacggccggcaaagtgattgcttgggggaagagcccactccacgcacgagtttccaaagccacggcacccacatctcgctggggagactttctgcacatttcacgcgttgtgccacaggagacactcacattcactggcacgtgaattcacgtataaaagtgtctgagaaaaggagaatcacgcctattggtttatagccctgagagaaactggttgaactaaccaagtcttgtgctcacatgaactgggtctatatgaaatataagaaggtggagcacccaccacgcacagtctccttcacgcccggcgtggtgtgtccctggacacaccagctctttccatatcccttgacttagaggcccacacgggttgatccattctttttatagagccatatttgccccataaagcttttggaagcccggga

SEQ ID NO: 726734 - DNA, 317 bp, Homo sapiens
  misc_feature (41)..(41): n is a, c, g, or t
ggtgacctagaggattccagcaccgtctgagtaatcggggnaaatcagtgaatgaagcctcctatgatggcaaatacagctcctattgataggacatagtggaagtgagctacaacgtagtacgtgtcgtgtagatacgatgtctagctgatgagtttgctgaatacaatagccagtcaggtccacctgacggtggaaaagcaaagatgaatcctaggtgctcagaagcactgcaagcagtatcatttcatattcgcttccggtggatgtgtggcgatgtcagcgtaaatactttgcacgccggtgggcgatagcga

SEQ ID NO: 726735 - DNA, 773 bp, Homo sapiens
tagagatgacctctacagttgtgataatagcatatgggtaaccgcatccgcacagaaaatacgagaacaatctgcatgtgtgattatagtattaatggacccataagttttgataaatgtgagtatttctgttcctgtttggtaaatatgtgacattccctgattgattgggttttgttgtagtcgtggtgtgtgcagttttgtttttttgagatggagtctcactcttgtcacccaggctggagtgcagtggcgccttctcggtctctgcaacctctggctcctgggtgcacgtaatcctcctgagtagctgggatggcaggcgcctgccccacgctggccaatgctttgtacttttagtagagacagtgtcccgtcagtgtaggccacggtcgttggttgcaaactcctgacctcgaggtgatccgcccacctcagcctcccaaactggtgggattacaggtgtgtgggccaccgagcctgcctgattcagcatggctttatcaggcaggcaccaggtggcacttccagtctccagcctctggtgcctacccaagtggattcatgtgcgtagccttggaccgtcttcatacgttttcctaaatgtacaaattctttataggctagactgaggagatccattaactccagattccatgctttctatcagaactcagcattccgtaaactacataaatttttctcccacttgtggtggcacaccttccctaaaggcttttgaaaaattccccggtacgaaccttggaaatgcg

SEQ ID NO: 726736 - DNA, 809 bp, Homo sapiens
tgatctttatgaggatcattctgtttactaatattcaattctagatcacatgttatatatgctgcatgccaaaaaaaaaaaaaagagaaaactgccttggctgggtgtggaggggaagaaaacctaatattctaccttactagtagagttcaaaacaagttttcactgagaagcctttccagtaagaaggttaaaccaaggttctggtttgttaggagcttttggtcagttattgctatttcagaagagtcaaaatccaagcagcgattgaccaatttgttggaacgggcttggcacacacttgcttaaatcccctgattgagtcctctcgatactgggagagtggggaattgggagtaggatccgtggatttatggtgcccggtagattatgggcaaggactgacaacggggaaggtcgtttttccccaatacaacggcacgtctacgcaacactagggtccaccggtcatggtatctacaacgcctagtacacgagatcaataactggacggcaacgaaggattctccagtttggatggcagacgaccaattggtcaatgcggaggatcgtcaacacacttgcttgagcaatccacgagggactaaatctcttggcttttggactcttcagactcgggacaactcggtgtctcctaaaagctaaggatacttgcgaaattgggtccgaccaggttatgaatcctcggagattggaattgaagtcctttggagaatgctcccgattcgaagggacaggggtgaaccgattccccttggaaactgctgggttacatggcaaagggttaa

SEQ ID NO: 726737 - DNA, 742 bp, Homo sapiens
  misc_feature (71)..(71): n is a, c, g, or t
  misc_feature (186)..(186): n is a, c, g, or t
  misc_feature (292)..(292): n is a, c, g, or t
  misc_feature (329)..(329): n is a, c, g, or t
  misc_feature (363)..(363): n is a, c, g, or t
  misc_feature (397)..(397): n is a, c, g, or t
  misc_feature (446)..(446): n is a, c, g, or t
  misc_feature (448)..(448): n is a, c, g, or t
  misc_feature (506)..(506): n is a, c, g, or t
  misc_feature (566)..(566): n is a, c, g, or t
  misc_feature (587)..(587): n is a, c, g, or t
  misc_feature (596)..(596): n is a, c, g, or t
  misc_feature (612)..(612): n is a, c, g, or t
  misc_feature (618)..(618): n is a, c, g, or t
  misc_feature (620)..(621): n is a, c, g, or t
  misc_feature (623)..(623): n is a, c, g, or t
  misc_feature (630)..(630): n is a, c, g, or t
gtgcggagccgccgtaagatgctctgacctttgacccctgccgttcagctctagggcccgtgcaggccaancatgaacacctccccaggcacggtgggcagtgacccggtcatcctggccactgcaggctacgaccacaccgtgcgcttctggcaggcccacagcggcatctgcacccggacggtngcagcaccaggactcccaggtgaatgccttggaggtcacaccggaccgcagcatgattgctgctgcaggttaccagcacatccgcatgtatgatctcaactccaantaaccctaaccccatcatcagctacgacggcgtcaanacaagaacatcggcgtctgtgggcttccacgaangacggccgctggatgtacacgggcgcggcgaggnactgcacagccaggatctgggacctcaggtcccggaacctgcagtgccnangcggatcttccaggtgaacgcacccattaactgcgtgtgcctgcaccccaaccaggcnagagctcatcgtgggtgaccagagcggggctatccacatctgggacttgaaaacagaccnacaacgagcagcttgatcccntgagcccgnaggtctccatcacgtncgcccncnncnatcccgncgccagctacatggcgagctgtcaatagcaccggaagactgtgatgtctggaatctgagggggggcatttggtgacgaggtgacccaggtcatccccaagactaagatcctg

SEQ ID NO: 726738 - DNA, 141 bp, Homo sapiens
gtttgggttctggtttagcacgtcactcccattatgggttctggttttagcagatcactcccattgttttgggttccggttttagcacatcactcccattattttgggtttctggttttagcagatcactcccattgtttt

SEQ ID NO: 726739 - DNA, 885 bp, Homo sapiens
cggttgatgacgtctcatcagatgacaatggccaagatttaacgcacatacaagcttctccgctgacggcttccacagttcggccccaggagccaacctgtgcctgggctctggtcgtgcacggtggcgtggactggcatgaggaagctggccttccgctaccgggggtgaaggagatgtacaagtacctacattagaacaatcgttggtgggttgataggcaacatcccaaaagggagatctggacatacagcatccgagactgacgctgggaagctctcacagacctctggctgacccactccctgaaggcactaatatctcatcaactcccgggccgaactgtgtctaatgtgctggtcaccaccagctcagactaatttcctgcccttgtgcccaaagtcctggctagtatggcctggggtctgtgttgccgtattgtagaacatctacagtgcaaccaacgaaatgggaaggagagctgcattcgaggaggataatgcgggagattcggctagaaaagcatgtctacggtggtgatcggtgatggtgtggaagaggagctaaggtagcgaaaaaggagtaacatgcctttctggcggatatcctgcacgcagatctggagggactgaggcacgccctggagtcttggaagttattgataggcaggatcagcggcatcttgcatctgacattctcacctttgaaacgcgcatcggcttatcccagcttcctcgagtcgaagaactccagtagatgcagaatgtggggacgaggaagggggcccaaaggccgaacgagtgtcggtgagccatctcaaagccggcttcgagcagttggggttctgagagggagtccatggggttggggtttgactgggacggc

SEQ ID NO: 726740 - DNA, 835 bp, Homo sapiens
  misc_feature (71)..(71): n is a, c, g, or t
  misc_feature (186)..(186): n is a, c, g, or t
  misc_feature (385)..(385): n is a, c, g, or t
  misc_feature (422)..(422): n is a, c, g, or t
  misc_feature (456)..(456): n is a, c, g, or t
  misc_feature (490)..(490): n is a, c, g, or t
  misc_feature (539)..(539): n is a, c, g, or t
  misc_feature (541)..(541): n is a, c, g, or t
  misc_feature (599)..(599): n is a, c, g, or t
  misc_feature (659)..(659): n is a, c, g, or t
  misc_feature (680)..(680): n is a, c, g, or t
  misc_feature (689)..(689): n is a, c, g, or t
  misc_feature (705)..(705): n is a, c, g, or t
  misc_feature (711)..(711): n is a, c, g, or t
  misc_feature (713)..(714): n is a, c, g, or t
  misc_feature (716)..(716): n is a, c, g, or t
  misc_feature (723)..(723): n is a, c, g, or t
gtgcggagccgccgtaagatgctctgacctttgacccctgccgttcagctctagggcccgtgcaggccaancatgaacacctccccaggcacggtgggcagtgacccggtcatcctggccactgcaggctacgaccacaccgtgcgcttctggcaggcccacagcggcatctgcacccggacggtngcagcaccaggactcccaggtgaatgccttggaggtcacaccggaccgcagcatgattgctgctgcgggtatctgtgatccttgatctctaaatctcctgagctctggtgggtcgacctgaggcacagccaagcgttcagattcagccgtgtgtccctgaggttaccagcacatccgcatgtatgatctcaactccaantaaccctaaccccatcatcagctacgacggcgtcaanacaagaacatcggcgtctgtgggcttccacgaangacggccgctggatgtacacgggcgcggcgaggnactgcacagccaggatctgggacctcaggtcccggaacctgcagtgccnangcggatcttccaggtgaacgcacccattaactgcgtgtgcctgcaccccaaccaggcnagagctcatcgtgggtgaccagagcggggctatccacatctgggacttgaaaacagaccnacaacgagcagcttgatcccntgagcccgnaggtctccatcacgtncgcccncnncnatcccgncgccagctacatggcgagctgtcaatagcaccggaagactgtgatgtctggaatctgagggggggcatttggtgacgaggtgacccaggtcatccccaagactaagatcctg

SEQ ID NO: 726741 - DNA, 231 bp, Homo sapiens
gtatccacgcattgcacaggaaaacaacacaattcgttccaaagactatgaaaactgatctgtgtgggtggggggctggtaatacatagtactcggcgggacaaaagtcaaaacaaaaactgaaaaaagaaaaaaaaggaaccaaaaaacccctacaaaggttatcctataaaaagggggtcggtgggcaaattgtatccaatggggcgggatacccttatacagaggggg

SEQ ID NO: 726742 - DNA, 236 bp, Homo sapiens
  misc_feature (21)..(21): n is a, c, g, or t
  misc_feature (38)..(39): n is a, c, g, or t
  misc_feature (71)..(71): n is a, c, g, or t
  misc_feature (115)..(115): n is a, c, g, or t
ggcaggaggggccgctagggntgaaagttaatctaggnncgccttgtaggaaacccagctgcccagctggnatgcctggtacaatcacagctcactgcagcccttgactcctggnactcagtgattttcccatctcagcctcccagtggctggaaccacagttggacaccaccacaccctgctaatttttttattatggggtcttgtcatctgcctctaataaataaataaataaa

SEQ ID NO: 726743 - DNA, 107 bp, Homo sapiens
tatccccaaccccaaatcaagaccaccttttttcagggtcactatttattctttgttcctttttcctgtttgtaagaaacattcccaaaaaccagtgcaaaaccaaa

SEQ ID NO: 726744 - DNA, 798 bp, Homo sapiens
  misc_feature (259)..(259): n is a, c, g, or t
  misc_feature (482)..(482): n is a, c, g, or t
  misc_feature (631)..(631): n is a, c, g, or t
gagcgctcctggcgcaaacgcttgcggggcgcccacccgagcgcggggcatcacaccccacacaggccccacatgcagagcacacaccccacgggaagggccttgacaccataagatggggagatgaagcttgttgaccgcccgaccgcgaccacagcttgggacagcccccccgcgcttaaggaggagttgtccataggacatccccgccagggggtccagctcctacgagagcacgggacacccctatcgcccacgncaccgttgcgtacaggccagacgcctgcaaaaagtagtgcgagaatgcaggtaccacctaagtgggggaccaaccgcgcacggagagaaacccactccgccagcgcatcgtgggagacagccacatagtttgttgaggcgcgcacacacggcgcaagggaaacacacgcaaccccccgttggggcgttcgcacacaccacgcgagggaaggatgattaccccnacccggcacctgtgctctggtgatcatctggacataggagagcacacgcaactcaaatggatcatggggcacagcgagcggaccgcgctggggtgcgagaggcgacgactagcagagagccgcgcgacgctgcatgtgcgaggcggcgntagcccgaaacggcaacatcgttgctgatacacccggcgagatcaccatcagtgggccacgcagggtccggaggaccacacaaacaccgggaccacaccccactcgctcctcgggggtacaaaagaagggagaatatgtattctccacaccaaacaaaagaccaaga

SEQ ID NO: 726745 - DNA, 115 bp, Homo sapiens
gcggcggctaactgccggtagggtctgtgtgcgccgccaagtcggtcgggcggggacgcgaggtgtgatgaggggtcgccttgacctctgcctcaaccagtagcgcagttcggcc

SEQ ID NO: 726746 - DNA, 485 bp, Homo sapiens
  misc_feature (282)..(282): n is a, c, g, or t
  misc_feature (461)..(462): n is a, c, g, or t
  misc_feature (466)..(466): n is a, c, g, or t
acacctgctgtcacaggactgatatttcttaacaagccctgcctctccacccctgcctccaagaccaggactccgccccatcagctggcccctgtgacatgctcccccaaccccaattaattcttcctactgcactcaaaaagacatcgccacaaggaaaggagacatttatataattatttttcctgtactgttggtgcgaagccagttaccaggcactgtgcaggtaacccatgaatatctcttgaatttgctgaatcataaactgtcatcaaagagacncaaaccaacttagctcagcccactgatggtctcgattgagtgatcctataaaaatatcattatttcctcacttttgagttgtccacatgagaaaatgtggttagaggaaagcctttttattcaacatgatcaggatggatagctggttgtttaagcaaataaaatctgttaatgtaagnnctcncaaatacaaaaaaaaaaaa

SEQ ID NO: 726747 - DNA, 246 bp, Homo sapiens
gaaaataatgattcatattaccgggtatttcttatccagtctttcattctatgtaaattgtgtgtgtgtctatatatgcgtgcatgtctctctctacatgtatatgtgcatatgtatgtatatatatgcatatgcacatacatgccacacatgcacatatacacacactcatagagaacaaaattattccgaatatttcatgaggtttcttattataaggagacaatattgatgcaatctaattaa

SEQ ID NO: 726748 - DNA, 261 bp, Homo sapiens
tttataactaaagtttataagttataattaaacagttgcttgtctaattctcccaattttaaaaggggaaacttgttccccttttaaagatgaagaaactgaggcttggagaccttcagcaatcttcagagagtcatacagctgggcagtggcaaagctgggatccagtccatgttaaacagctccagagccagcacttaatagaacccacatttgactctgatgtgaagccaagcttgagaactgatgggtaaacgttcc

SEQ ID NO: 726749 - DNA, 126 bp, Homo sapiens
attatcttcgggaaacagaatatgtatggggtggtaggcagccacacagtactcttctgagccccctcactcacttcctatccccctgtgcctttccttatgtgagtgaaggtgggaggagtacca

SEQ ID NO: 726750 - DNA, 255 bp, Homo sapiens
  misc_feature (78)..(78): n is a, c, g, or t
gctcttttgggggtctccgcggtgtcaggacttggtgagcctggtcgtgggacttgatcaaaaagtccctcgctctgngggtgcttatctggtgactggggccctgaggtctgggacagacactgccagtctttctgggccacacccacggggactgcctgcccccctgggcttggctcagtggtggggagccttcccctcagtgggggtgagactcacccatggccctgggtgtgcccggctctctgcggctgt

SEQ ID NO: 726751 - DNA, 1016 bp, Homo sapiens
gctggtacgctcggatttcgggatcgaacctcttcagccgcccggatgccgctcccggagcccggccgtagaggctgcaagtcgcaggcctgggagccctgcagccctctgcgccccgtatgacccgtgcgtcgcccttcgagggctgccccaggccgcgccatgtgtgaaggtgacgttcaactccctgctctggcccagaaggaggccaagaaggacgatgcccaagagcggcgaggaggcgctcatcatttcccccgacgccgtcgacggtggactgcaaggacccagatgatgtggtaccagttggccaaagaagagcctggtgtaggtgcatgtgcttcggactagcatttatgcttgcacggtgtcattctaggaggagcatacttgtacaaatattttcgcacttcaaccagatgacgctgtactactgtggactaccgtacatcacagatgatgtcatcttacctgagccctctgcagatgccccagctgctctctaccagaccaacttgacagacaacatattcaaatctttgaaaggacagaagacgttgacacttatatcacggtgtgcctgtcccagagctcgcccgatagtgatcctgccaacatacgtccatgagcgtacaaccaacgacaaccttacagacctactctagcactctaaaccttggcactaagtgctcatgtgatccctcgtggaaccacgataccaataggttatagcacaagccacgaaaaacgctaactggcaagtcaccacaacctaagccatccgacgggcctgccacacctaaattcgccatcccgcccccataacattgaacttcaatccaagacaacaactaggccatcattaagcacgaaccacgcaatcgacacaacaccatatcgatcaccaccatcgggaaaacacatagaatcccaaaaccaaacctgatgcaaccaagcaccaagagagacaaaaagaagcaccacctacaacaaccgagcaaggcacacccacaccc

SEQ ID NO: 726752 - DNA, 962 bp, Homo sapiens
gatatcggtctagaaatatgaatgacagggtcacacaatattgaggcgcaattacataggctgtgcaaactctgaggctggtatagtcatgaagctccagtcccgtgctgtatcagctgtaaggaatatgcacatcttccatcgaggatccccaggatagatattaactattgtgtcgacatctaggtataaaaaagtgccaaaccatgtgctcttgttaattaatacatgtacagaagggcaacatcgctccagggtaaaaatcgcgagggggcacagagtcgatcataaccgtgtacctagtgcatgttgttgtaactacaaatagaggaaggcgagtcttcattttttgcatctagggtttaagatcaaggtactgtatagaagtttgtgtaagatcggttattgggagtctcgaaggcaggtgttcattggctaagtggtgacaatgccttgtgagtagtctcacaatgtgaggatggtgggaaattccgggcaaaatatgcaatgtcttgtgcacgcatactacaggggatgcctcatactagtaatggggtctaccagagttgggggcataaaaggtgtattaaaggtaatttctcttgaattatggttcaactctaaaatgaagggcgtggtgtatgggtcacttagtgcaggaatcccttaattccgtttgtatatgtcacacagttgtactgtggagaaccaaggtatgttttggcgtggacacccttactgagtatttctttaggttaaaattaacggccaagggaactgggttttaaaaaagacaaaaggaacaaaaacgttgggggcggcagagggggaaagttacaaaaaccggggcggggcgggcgtgtgtaaaaccgtgtaggctggcaacgaagatgtaaaagggagagtaaaaagcagggggggagcggaggaacacagggatggcgtggttaggacagcgatag

SEQ ID NO: 726753 - DNA, 112 bp, Homo sapiens
gtaacatgtcagccagtaggccagacaacccccagttcaatactttccttccccaactcggagctgagccactgatacgtaggacgaacggacgggccatctactgctacgt

SEQ ID NO: 726754 - DNA, 282 bp, Homo sapiens
cttgttccttattcttcttctccttctttttcttctcccttctccttcctctcctcctccttcgttctttttctttcttccttcttccttctccttcttcttcttagttcttcctccttcttctttcttcttcctctttccttttcttcttcctccttcttcttcttctccttagttctttcttctcctcctcctttcttcttcttagttcttctccttcttccttctccttcttcttccttcgtcaccgtcttctccttcttcttactttcttcttccttc

SEQ ID NO: 726755 - DNA, 297 bp, Homo sapiens
agtttgtggctgggtacggtggctcacacctggtaatcccagcacttcgggaggccaaggcaggtggatcacctgaggtcagaagttcgagaccagcctgaccaatatggtgaaaccccgtctctactaaaaatacaaaaagtagcagggcgtggtggcgtgtgcctgtagtcccagctactcgggagtctgagacaggagaattgcctgaacctgggaggtggagattgcggtgagtcgagatcgcaccactgtcctccagtcctccagcttgagcaacagagcaagactccttct

SEQ ID NO: 726756 - DNA, 255 bp, Homo sapiens
tgaacaaatggcatactacgaactgcgagcggaacatagtgtggatatagatgtggctatgactggcctatgcagagcaaagagtcttaagatatggctatttgggcaaagcgaagcttaaggaactaagcctttgggttggcactatcgatggatgtctcaccaatggccacatttatgtactcaggacgacccaaaaagacataatactcttactgactgtagaagactgctattgaaacttctaaaccctag

SEQ ID NO: 726757 - DNA, 517 bp, Homo sapiens
  misc_feature (26)..(26): n is a, c, g, or t
  misc_feature (59)..(59): n is a, c, g, or t
  misc_feature (113)..(113): n is a, c, g, or t
  misc_feature (115)..(115): n is a, c, g, or t
  misc_feature (180)..(180): n is a, c, g, or t
  misc_feature (188)..(188): n is a, c, g, or t
  misc_feature (194)..(194): n is a, c, g, or t
  misc_feature (214)..(214): n is a, c, g, or t
  misc_feature (228)..(228): n is a, c, g, or t
  misc_feature (319)..(319): n is a, c, g, or t
  misc_feature (395)..(395): n is a, c, g, or t
  misc_feature (427)..(427): n is a, c, g, or t
  misc_feature (431)..(431): n is a, c, g, or t
  misc_feature (440)..(440): n is a, c, g, or t
  misc_feature (476)..(477): n is a, c, g, or t
  misc_feature (486)..(486): n is a, c, g, or t
  misc_feature (493)..(493): n is a, c, g, or t
  misc_feature (503)..(503): n is a, c, g, or t
  misc_feature (516)..(516): n is a, c, g, or t
ccccagccgccagcgcccgtccccgncacggaccccagcggaaccatgcaccccgccgnccacccaacccaacccgaccccagaagcccccccccgcccccggaaactcgggncncaacccccgtaacaaccgaaaaaacaagtcccgaaacagagaaaaaagaagaaaaaaaaaacaangccgaagnggccanaggaaatccccatgccgacnggggtcggcccagncagatgtggcaaccaaatttggaggaagcccccgaaggcaataaggaagaaaccccaaatgaaaaacaagaaggggttgccagagtagaangggaacagcaccccgacaaagcccagagaaacaggaaaagcaaaaacccaacccccaaatcggcccgaaaagggangaggatgaagagagaaaacagggggcagcgancagngaaagcatnggcagaatacatcaggcaacaaaaaagggaccccanncaagaaatncgggacncagcagaaancaccacacccganc

SEQ ID NO: 726758 - DNA, 319 bp, Homo sapiens
  misc_feature (193)..(193): n is a, c, g, or t
  misc_feature (199)..(199): n is a, c, g, or t
  misc_feature (214)..(214): n is a, c, g, or t
  misc_feature (222)..(222): n is a, c, g, or t
  misc_feature (240)..(240): n is a, c, g, or t
  misc_feature (308)..(308): n is a, c, g, or t
gtcggaatctcgctccatcacccaggctgaagtgcagtggcacgacctcggctcactgcaacctccccctccgaggctctcgccattctcctgcctcagcctcccgagtagctgggacggaggccaggtacttccctgacacttgtcttattcctaatccccatcttgaatcaaaaaaaaaaaaaaaaaaagncacccnctatgcaattacagnggcaaggncttcgttggggaaaaggntcctgggaactctgtgttgcctttttggggaggaggagagtggtttaggaaggggtattatgaatttntaatttgaaat

SEQ ID NO: 726759 - DNA, 405 bp, Homo sapiens
tgtgttttttggctgaactccagaagaaacatttggcttggcttgcattttacacaaacacacacacacacacacacacacgcaaatttttttgagagacaaggtcttgtgctgttgcccaggctagagtgcagtggtgtgatcatactcgctgtaccctcaacctcctgggctcaagctatcctccctcctcagcctcccaagtagctgagactgcaggcacatgcaacactccagctaattttttaaattttttgtagagatgaggtctcattatgttgcccaggctgtctcgaactcctggtcttaaatgatcctcccactttagcctcccaaagtgctggaattacaggtgtaagccacctcacctggactgcattttttttaaaataaaaaagtatatta

SEQ ID NO: 726760 - DNA, 198 bp, Homo sapiens
  misc_feature (40)..(40): n is a, c, g, or t
  misc_feature (88)..(88): n is a, c, g, or t
  misc_feature (111)..(111): n is a, c, g, or t
  misc_feature (148)..(148): n is a, c, g, or t
  misc_feature (162)..(162): n is a, c, g, or t
attcggcacaggttcgtgaccatggccgaccgggcggcantgaagagggcttgcaaagacccgaaccccatcatcgacggccgcaacnagccgttgaacctggcatatctnggcgccaagcgcggacctccagacgggctttgcattngggttcagcagctncaccaccttgatccagcggacttacgggcttacccc

SEQ ID NO: 726761 - DNA, 1167 bp, Homo sapiens
gctgagggtcgcccggcggtagctgagccaacgcggctgtggtcttggagcccccatcctcctgccgggcgaagatgttccgagcctgtgaccctgcagccttcaccgtaccgtgctgggtgactaggagacgttccctggtggatgggcccgtctcgtgactcgacctcgagtcctggaacatcgatgcgcctcgtgcgatgcccaagcattgcatcaacggagcgtgatgggcttgccgtgcgtgtcatcatatgctgtgatataccacattgtgcacgcggagtcacattatgagggctcaggggcatggttccgtttcgcctctcgtcccttggcttgccgagtcgtggtcccatcttcacctgcctcttagtggggcccaagggtgtgcacgttaccactattggggcattggcagacatccgatccagatttccgtgggcgcttctgcagtagggagacccagggcccagtccttggtacagcaggccccaagggtctcgtgtcaacgctatctcgatccatgaagttgacgcacatgacattgtcccttatccagtttggatgagttgcccttgcttgaatccctgtgtgggctcgtaggatgccggaccagacccttcccattccaatgcggctgttgcacacatgaacctttagttaccaaacttcgggttccattgtaacaagaatacttttcagcatctttgcgcaagcgaaggactgttccttgagtcgtaacgcacattgacgttccaacgggagtaagccgagtgggggttccaacaagggttgtgttccaacccggatgtggacaggggaggggcagaagggcagcttccttggaaagccccttccgaggttccacggccccttcagagcattgttgcaacggaaaggtacatgggtgtcaaagacagattctattgggggtgcacatcgcttggaagattttaggtccttaaaggccattccaggcaggaagtcgcaccgtttttggcatgggttcccaaaggggccgcatacaattgcggcccatgatggagggggtggcaaggaacgaaccacacagggttggcccgtgggattctccaacttatccatggttcaggcaatgggatcccccagttccaaactgtaatttaaacgtcggcgccttaaggg

SEQ ID NO: 726762 - DNA, 117 bp, Homo sapiens
aaaaagggaaaaagggttttccccaagggctaaggggggggggattcccccccccccccctgggggggaccaggggggggggtttgaaaaaaaaaaaaaccccgcctttggttccca

SEQ ID NO: 726763 - DNA, 167 bp, Homo sapiens
cgcggcttagcttatcgtgtgtcagatatgttaaagccactttcgtagctctatatagtgtcgactggcagttatccacaactcacgtgagatttgagcttgtatgggaggagtggggtgatctaaaacactcttgacgccggccttctatagactcgtggttaact

SEQ ID NO: 726764 - DNA, 176 bp, Homo sapiens
agaatggcaaccccttgctgaaggcttgatgcgccgctggctgcctgccggtagacgccttgttgcagatgatcacctatcctacctgccctcccctgtgactggcccagtagagtaccgctgcgcagctcctgtagcgaggggcccccgtgacgacgagtgctgccatggggcat

SEQ ID NO: 726765 - DNA, 582 bp, Homo sapiens
ggcgtatacagactcaagtgtcacgaatgaagaatgtatagcatgcatgcctctgttgattctgttttctaaacctccacatgtcactcctaccttaccactccagatcctcgccgtctcctctggaccaaagcaatccatcttttcctaactggctttcctgcctctaagcctcacctaaaacccatcctctatatccaaaatgaccattcttttccttttctgtacttattttttgtagagataaggtctcaccaagttgcccacactgttcttgaactcctgaactcaagagatcctccagtctcggcctcccaaagtgctgggattacaggtgtgagccaccacacctggcctgtcaggacatcttcacctgttcctgtgtccaagatggtattgcctaggttgtcttctggggtttttatagcttggggttttacatttaactatttaatacatcttgagttaagtttagtatatggtataaagaaggggtccaatcttctgcatatagtaagccaggtatctcagcatcatttattgaatagggaatcttttctccactgctagattcagtaaggt

SEQ ID NO: 726766 - DNA, 383 bp, Homo sapiens
  misc_feature (351)..(351): n is a, c, g, or t
  misc_feature (376)..(376): n is a, c, g, or t
gcaagagtagtaatgaaggcatattgttataatcattttattttatctgtagttattgctgttaatctcctactttgcttgatttattgatttatttactgagatggatcttgctctgttgcctgggctggagtgcagtggcacgatctcggctcactgcaacgtctgcctcccgggtttaagcgattctcctgccttagcctcctgagtagctgggattacaggcacgcaccactatgtctggctaattattgtatttttactagaaacagggttttgccatgttggccaggctggtcttgaactcttagcctcaagtgatctgccctccttggcctcttaaagtgctgngattataggtgtgagccaccatgcncagccgg

SEQ ID NO: 726767 - DNA, 342 bp, Homo sapiens
gaaacttatctatatccattaagtagcattaatagttgtcatcatcttgtcaatctttattttaattatggtaaaatacacataaaatgttccaccttaaccatttttaaatgtatagtatagtaatgttaactatatgtacactgttgtgcaacagatctctagaacttttttatcttgtcaaactgaaactctataccattccctacttcttatttttgggtggaatattacagagcaaatcataggatatcatcttatttcccaacaggtaaggacttaaaaaataacaatatatcagtatgcacatttaataggaataataacttctttaatattaat

SEQ ID NO: 726768 - DNA, 1490 bp, Homo sapiens
  misc_feature (1)..(1): n is a, c, g, or t
  misc_feature (823)..(823): n is a, c, g, or t
nggtggtcgtatcatctgttggtgcgacataaatataattgatgtgtgtagtttgacggttgttcgtcgtcagctgacgcggacacaataatacgaacctacgtcgggtggtttgtatgatgattttgtgtctcattccactccagtgtggttgtgtgacgatctgtgtttagtacatcagcgtgtggggtcgtcaccaaaaagtattgtgggtggaccacaatcaattattgttcgatttcgttcgcggcatcccctgcgtcagtgggttggtttttgcaacaaccccaatagtatggggggccgccgacgtataagtttatgttttatattaaactccgcgctccaaatatgaagtgcgtgcggatacccacagaggcgttgcgtctcgttgtaatgttggtgcctccccgggctctttgtgcgccaggaagatttttgccaacggggggttgtctcactttacaactcagggacccgcctccgtttttttgttggtgagcatggggcttctttgtgccccccaacaagtgttttccgcggctccatgtagaatatggtgcgtttttaataatatggtgagaattgttttagtgcctccacctcaacgtgtatatccttctccgcgcaagttgtagatagtgggggcccacggggggcgcgcggggggggcggggtaaatttttggggttagcggtttggggccccccgccttttttattgaaacgccgcgccttacaccacaagatttgtagatactccacttatacccccgtgtaatatgtgtaagttccaaataaacacacacattatcggcaacatnttatatagtgtgtggacacacacttatatatgagaaatctctcgcagaagggagattcgcaccacacggtgtgtgttacacacacaatataagccacggcgctgtgtttaataacacgcagccgggcccacgctataactaatttaccggggtcccttataagggttatgcgcgagggcccctcgtgggttggcgcagaatttcgggccacccgaggcccacgctgaacaccactgagatcacatgccaccttgccacctccacacgctttataacgctgagataagaagtgagagacactctgttttcttaaaaagagaagcctcgggcgccggtgggctacaatgccataataaattcccacgcacctcttgggagaggtctcgaaggtgggtggaatacacacctcgagaggtccacaggagagttttcgagagagaccacgcctggccacaacactggtgaaaaccctcgttcttctaactataaaaataccacaaaaattagccacggcgtggtggccaccgcgcccttgtagtccctttctaacttgggagaggctgaaggcccggaagaaattgctccaaccccggaggtggagattgttgcagttacctgagactgtacccctgcactcccgcctgggcgacagagtgagactccctct

SEQ ID NO: 726769 - DNA, 169 bp, Homo sapiens
gagcagcctgggagcaggcaggggatctgctgtgggaagggacggcacacccattcctgtctgagaccttagcaagaccatggcacagtctgggcatccacgtgaccagctgaccaaagacttatgcaactgagagcactctgatggctcctcagacgagcagatcaga

SEQ ID NO: 726770 - DNA, 260 bp, Homo sapiens
tccataagtagctgttaatggaccaagggttggatataaagttattcaaatcttcagaactttggcccagaatggaatcacaagctttacaaagtttttccttacacaataaaaccagggataggggcaagctggcggaggggaccaaccatagcagtacgtagcatcggcaaacaacatacaaacactcacacaaccaacaacacaccaccacaaccaagcaagaaacaatacacaacaataaaaaaaacaaacaaggg

SEQ ID NO: 726771 - DNA, 341 bp, Homo sapiens
  misc_feature (129)..(129): n is a, c, g, or t
  misc_feature (254)..(254): n is a, c, g, or t
  misc_feature (269)..(269): n is a, c, g, or t
  misc_feature (312)..(312): n is a, c, g, or t
tctgcctcgcgggttcaagtgattctcctgcctaagcctcctgagtagctggaattacaggtgcttgccaccacgcccgactaattctgtagttttggtagagacagggtgtctccgtgttggtcggtntggtcttgaactcctgacctcaggtgatgcgcccgcctcagcactctgggaggcccaggtgggtggttctcgtgaggtcaggagttcaagaccagcttggccaacatggtgaaaccccatctttnctgaaaatacaaaanttagctgaaaatacaaaagtggcacatgcctgtaaatgccagntactgggggaggcttgaggtaggagaatt

SEQ ID NO: 726772 - DNA, 149 bp, Homo sapiens
tgctggcatttaggcttctggggaacaaggtgatgtttgcaggtctcgccttagacagggggagttggtgcctggttcctcctagaccctggccattagattccagatcagctgatttcatttgggatccttaactgtaaggaagtgta

SEQ ID NO: 726773 - DNA, 152 bp, Homo sapiens
  misc_feature (58)..(58): n is a, c, g, or t
aggcccttcttccgtacgccctcaccctgggcgccgtggacctgtacgagtattcgtncggggatgaggacctggagccgctgtgacgccgccccgagaacgccgccacggggccgctccccacgtgccaccaccggccaccgcggctcgtg

SEQ ID NO: 726774 - DNA, 872 bp, Homo sapiens
  misc_feature (215)..(215): n is a, c, g, or t
gtgtgatccgtcctgcgcgttgtctctggagcagcgtctttatctccgccgccttctctcctacctaatgtgtgtgccgccacccgatgaagattcgatgacatgccatgagccccctgaggccccagaactatctttgcggtgtgtgaactaaaggccgacaaagattatcacttagggtggatactgctgcaccaatgagcaccagttatctntaagaaccggccagtaaaggggctgtgccaacggatgcagttgcacttttgttgacggcaggaggcaattgaataacgaaggccggtcccattagtggtacccctggcacttttgaaattgtcttgtaccagccaccgtttccccttgggggctttgaaataacaccaccagtgttctaagggtggaacgtgtgtcccaggccagttgcctattagtgacagcaacttagtagcctgtggaggaagatgcagagtcagaagatgaaagacggacggcaggacctgttgaaacctctaaagtatatctgaaagcggtctgccctggtggtgttacaagtgtcccacagaaacaaagttacactttggttgtgatgaagatgatgacgatgatgttgagaaggttgatgatgacatgcttgatgatgactgacttgatgatgagggacgtgaagaaagggtctgtgaggaatctatagggatatccaggcaaaatgtcaaagttcattcgagggagggtcaacacttttcacccgtttaagggaggacttttgaaggagaattttaaccaagctttttgtggagctttgcaatgtcgggtataaggtgtcacgggcgcaatttaggtcgggccagaactcggggggaaaaagagatttg

SEQ ID NO: 726775 - DNA, 194 bp, Homo sapiens
tcgatctagaggatcccggctaccacttggtagcagtggttaaaatgagccttgatccctccttggagcccctacttccttgtatggagggcactagatatagagcctagtatctacccattaagtctagcacgctccctgagggcccagaccagtgtcacaatagactcaatacaaccatttttacatgagca

SEQ ID NO: 726776 - DNA, 885 bp, Homo sapiens
cgtcaagacatgcgcgcgcattccttcgtgtcgatgctgggggcgtttccgcgtcgagggccgctgaccgcttcctggagccgcgtgcgcgaggtgcgttccccagccctgtgtttgctctggtgctctgacccgccgccgcgaatctcctgctcgtaactccgtggccgtgaacctggaggagggaggatttcctctgtgcagcatttcgagcggtagaatcaacctgccaggcagacctagattggcataaccagagatcagttccagttgtgatgcagtgggtgtctacacacttctgatgacaccttttatttcaacagcttgattggttccaaggttaaagccggggattctcaccggtgttagccaggactggctctcagatctccgtgacctcgtagatcactgcccatcttccgacctctccaagtgctgggacttacaggcatgagccaccgctgcccggtccttgtatcttctaaactttgacctttatggagacgaaccaccatcgttttgctgcaacacttgaacacatgatgcaccgagccacagagttggccagacctgtttcgcaactgctgtgcaaccggtcttctctgtcttctttcatggccagtaacactgctccagaaagagatttctgcgcagccatccactcccagtagtttctgcatcagtggcgataaggccacacgcacattgtcctgcctatttcccaaacgcactgtgactgcttcccactattcccagctggctacatcgggaccggtcgtctgaatggatcctgcgcacacagtccatcaacgaaagtacgcactttgaccctggaacacctttctctggccctacccctcgtcactcacgcgtcaactcactgac

SEQ ID NO: 726777 - DNA, 319 bp, Homo sapiens
taagtgtctcggggcaagtgtaatgatgctgctatagccaagcaatacaaggattgctgggagccagcagaatctagaaaaaggcaaggaaggattcttccctagagccttcaaaagtaacaaggcgctgctgaacatttcagatttctagcctccaaatctgtgagataattaaatttctgccgtttacctaaccaagtttctggtaatttgttactgtaggaaaataatatagtggtcaagggacctagttaagccaagatggcccaagggcaattttactgggtcttttgtcagctattccttcctagtaacaaaa

SEQ ID NO: 726778 - DNA, 342 bp, Homo sapiens
ttcagctttcccgttgctttacaaagttacttaatgctcttttaaaaatttaaatgttttggctgggtgcagtggctcacacctgtagtcccagcactttgggaggccaaggcaggcggatcacttgaggtcaggagttcaagaccagactggccaacatggcaaaaccccatctctacaaaaatacaaaaatgagccgggcatgatggcgggtgcctgtaatcccagctgttcaggaggctgaggctggagaattgcttgaacccaggaggcagagcttgcagtgagccaagatcgcgccattgcgctccagcctggctaacagagcaaaactctgtctca

SEQ ID NO: 726779 - DNA, 327 bp, Homo sapiens
acaggctctgcagaaactcgggagtagcaagaaagcagaggagagagccaagatcatttcggccatagatcaagatgtggaggagaaaacgcgtgttcctggatggccttgaagaagaggactacaagactaagcttttccagtttctgaaactgcggaaatattccatcaaagttcactgaagagaagaggatggataaggacgttatccaaaaatggacattcaaagaccaagtgagtatgtgacgattctaacagatgcagcatttcgctgctaccttacaagcttctcttctgtcaggactccagaggatggaaagggggact

SEQ ID NO: 726780 - DNA, 95 bp, Homo sapiens
agacaaagggaagcgccgccgccgaccgccccgcctcggtcctccacctgtcctgctacgctcgccggggctgcggccgcccgagggactttgaa

SEQ ID NO: 726781 - DNA, 157 bp, Homo sapiens
aggaaggtactgcaccatactgaaaataggtgtaactaaagctagaagaggcacagaaaactagaatctagtagataacgagggagaatagaattgtcatgaaaaatatggggtatagatatttatagtaatctacttgtggtactacgcttaggca

SEQ ID NO: 726782 - DNA, 448 bp, Homo sapiens
  misc_feature (12)..(12): n is a, c, g, or t
  misc_feature (60)..(60): n is a, c, g, or t
gggagcccccgnacccaagggtgtaccctcccccctcttcggggggagtttccaaaaacncgggtgacctttccctggtggtttaaaggttttttttccacccactttcccttggaggtggagagcaatggggagccggggaacaataaaaaaacacgccttccggtgttgggctccggggggtctttttttttttttaaaaggtttcccgggggcaaaagaaggtgggagcaggggaagtttttttttttttccgttagggatgggggtttggccaccccctaaacgcaaaaaagctttttctttttcccggggtaattgggggggggggggggaagcccccccttcccgggttttttggtttgggggggggggtttgggggggtcccctttttattttttttcggggccccgggatggaaataaggcccccccccctgccctggga

SEQ ID NO: 726783 - DNA, 895 bp, Homo sapiens
  misc_feature (3)..(3): n is a, c, g, or t
  misc_feature (61)..(61): n is a, c, g, or t
  misc_feature (66)..(66): n is a, c, g, or t
  misc_feature (72)..(72): n is a, c, g, or t
  misc_feature (91)..(91): n is a, c, g, or t
  misc_feature (120)..(120): n is a, c, g, or t
  misc_feature (213)..(213): n is a, c, g, or t
  misc_feature (282)..(282): n is a, c, g, or t
  misc_feature (452)..(452): n is a, c, g, or t
  misc_feature (472)..(473): n is a, c, g, or t
  misc_feature (549)..(549): n is a, c, g, or t
  misc_feature (643)..(643): n is a, c, g, or t
  misc_feature (652)..(652): n is a, c, g, or t
  misc_feature (669)..(669): n is a, c, g, or t
  misc_feature (685)..(685): n is a, c, g, or t
  misc_feature (701)..(701): n is a, c, g, or t
  misc_feature (747)..(747): n is a, c, g, or t
  misc_feature (749)..(749): n is a, c, g, or t
  misc_feature (767)..(767): n is a, c, g, or t
  misc_feature (773)..(773): n is a, c, g, or t
  misc_feature (775)..(775): n is a, c, g, or t
  misc_feature (781)..(781): n is a, c, g, or t
  misc_feature (783)..(783): n is a, c, g, or t
  misc_feature (815)..(815): n is a, c, g, or t
  misc_feature (875)..(875): n is a, c, g, or t
ggncggggatgggaacactgtacagggagaactcacagctccaagagcttccctccaaatnatgangaagtncctgtcaataactagattncctacagcctggtcctctgcccatggganggaggggaaatggatgtgaaaagcaatgtggtctgcccccctgtcattcaaagatccagtcctgagcacagcccgtgtaacccaccagtcccncagggtgaaacacaagccgatctccttctctgcactctccacagaatcactgccatgtataaagttccngccaacttgtatgcagaagtctccacggatggccccaggcttggagtctgcagggttgggctccccgagcatgactgggcccgtctccaccacactcagccccccccagaccatggcaaccaccggccctgagtgcatgtctctcaccaggccggcaaagaatggacggncctccaggtcaacgtagttnnccttgagaagagctccggaagcctgcatgaatttcagaccaacaaggcggaatcctttctgcccaaaacgcttganaatctctcccacaagaccccgctggaccccatctggtttgatcgcaatgaaggtacgctcacagttggccatggttcctgtttcacagcttganataggaggnccctcgccttgaaagangatccctaaagtaganagttgcaccatctctnggccccatcttcctgttctttagttaacctcttcttacagcatctnancactgtagttcaattttntgtttntntttttncntcccctgcacaccaggttgacttagttctgtntagagactctatggtacctagccacagggccctcccagccgcctaggtttgaaccccttnttcctctccatccccctaaa

SEQ ID NO: 726784 - DNA, 191 bp, Homo sapiens
cggtttgaaaaggggtcaccactgagggggtctatggaggctgcctatgccatgtcagcacctcctggggaaagccctgaggaccggccacaagggtgtgcctggaccacgtgcctctgcctggcggagcctctgggaggaggaagaggaggaagggggagacgaatttctctcctggccctggtggcgcg

SEQ ID NO: 726785 - DNA, 310 bp, Homo sapiens
gccaacacatgctcggggcatcccacccactagggtctacatacagaccctcggaggcctagccacaactgtctcgttgaccagactgggtataggcaaatagggggttgcatttctgttcagggatactggatagggctgaccaggtgacaaacatggtgtagagggtgatgaccgaggcctgcagcagacccgagttgggctgggcgtcctggaccttgggcaggacagcagcgatggacacgcagacacagaaggtgaggttgcggctgatgaagaccttgccctcgtggcagccgctgggctcagt

SEQ ID NO: 726786 - DNA, 926 bp, Homo sapiens
gcccggcgggcccagcgtggagagctgaaggtcaggccaggacagtgagacctgactccttgctcctacacagactactatggcttacagagccagggtctagggtcccggtcgatgtaacgacgagcagaggaccagcagatgaatggacgccttgaagcagtaggagcagcaggagcagaggccagaacaggagctgaccgggtagctggggccacagggcctatgaagctaccatgtgtcgagggcctacaggccagtggtcgccggacccgctacacgacacgtgagtattgccaggcacgcaccgtgtccgatccattgcgacgaagcttatggactccttacgtacatgaccccgaaggaactcaggcttttgactcatcaatcccctgtagcaataccagcaaaggggttcactggggaagcaatcatcgtcgccgagcttggcagacgctcacaataaatcacttggcatatgcacaacgggcgcaccagagtgtgatgggtcgcttgtctacccacaggttcgagacctggacgggtatatcaaggagggcgtggcataagaaaactcgcgttagcggaaaagtcaccagacagtgcacacgattcagaaacgtccaagagtggccctatacaatattctgtagcttttcataaccaccccttgaacaccgcgttcggggggacccagggacaggcggagggacccacgtgattgcccaggaagcacaagagttcggcgaaaacaatgctcggtgtgtccacgaaaataggaggtggacgcggccgaagcctttcacgaacacttatgcaaaccctggggcgcctgtaggcacgcgctaggggtgcttggtgccatattgggccccattcaaaccctggatatccgggcacccccggagaggattggcccaactggg

SEQ ID NO: 726787 - DNA, 174 bp, Homo sapiens
catccggatgtatggcaaaagtctcaagacatatggtccacgactgatgatcatctgatattatttaagttatgttttgttctatgttttcagagacggagtctcacatattgtcccccaggctggagatgcagtggcagcgatctcagactcactagcgcacctccgacctcc

SEQ ID NO: 726788 - DNA, 111 bp, Homo sapiens
gctcagcacagacaagttcaagacagatttttatgatcaatgcaacgacgtggggctcatggcctacctcggcaccatcaccaaaacgtgcaacaccatgaaccagtttgt

SEQ ID NO: 726789 - DNA, 109 bp, Homo sapiens
agtcagaagtcccttctcgtggtgcctctcctccctggattggtcgtacacccagcttaaaaccccattcttgccgcaggcgtccatgtgatcaccatggggatcctct
